United States Patent 7,432,049 (COMPOSITIONS AND METHODS RELATING TO OSTEOARTHRITIS) - sequence listing, part 2

SEQ ID NO: 1421 - DNA, 273 bp, Homo sapiens
ggagagcaaagctgctctctgacagccagccaagatgcccacacctcagtgccatgtgaagggacatcagccaggagacaggctttgcagctagcaggttgtgtgctggttaaggcaagagtagctgctgtaacagacaggccccctgggtctcagtgtctgcatgtcatagatgtttatttctcactcacgtaaaatcaaagcagcagggagggctctctccccaaaaaactagaagtgatcccaggttttccccctcaccctcctctatct

SEQ ID NO: 1422 - DNA, 172 bp, Homo sapiens
tttttaattagttgctgttcataagtttattatctatatctgaaaaaatcatagaaattgctgggtttagctctcagcagcccgctcctgagctctgaggaagcttgccttcttttgagctcccgatccttcttctgagcaagggccaatttggggcgggtccacctcttct

SEQ ID NO: 1423 - DNA, 134 bp, Homo sapiens
gcatgatcagcaagcagttccaccaccagctgcgcgtgggcgagcgacaccccctgctgggtccccctgagtccatgcgggaacatgtggtcgctgcctccaaggccatgaagatgggtgactggaagacctgt

SEQ ID NO: 1424 - DNA, 250 bp, Homo sapiens
tgaagcctaattatgctggactgttttgacctggtttaacccttctgataggtagttgtggatgctggggatgagaactgattattctttgcctggagtgacactacactctagaatttcacttttgagaatactcagttccaacttgtgattcctgatagacagactttacttttctagcccagcattgatctagaagcagaggatcccagcgccttttaaaagttgttatgtggtttcttttaaaagc

SEQ ID NO: 1425 - DNA, 280 bp, Homo sapiens
cttcagtcgccaatatgcagctctttgtccgcgcccaggagctacacaccttcgaggtgaccggccaggaaccggtcgcccagatcaagggtcatgtagccttactggagggcattgccccggaagatcaaagtcgtgctcctggcaggggcgcccctggaggatgaggccactcttggccagtccggggtggagcccttactcccctgtagtagtcagccccattccttttaggtaagcccatggtcccttgcccctgctgttaaatataagcaaaatc

SEQ ID NO: 1426 - DNA, 171 bp, Homo sapiens
ctagagagaagaaaaaccagctgatatgcaatctgtgcttaggtattaaagcttctcttagcacctgccccctcttccacttttccttttttttgatgaacaacacttaaataccactagcaatatgtccacggattaataagtcaattttctatgattaaaggaagcatt

SEQ ID NO: 1427 - DNA, 220 bp, Homo sapiens
acatgtgataaaatagcacaagtggctggtgataaaatttgaaattattggttaacctcagctgtgatcttatgtatgtcaagtgaaatttaaataggtaattatagggttgattacaaaatccctagtgtcattttattttagtcattattgacttttaccctttactctgttcttctcataggcttaatttctatatctcggggtgactgattttatt

SEQ ID NO: 1428 - DNA, 230 bp, Homo sapiens
aatcaacctatcaaagcttcaaaaactttggggaaagggttggattaagtacaagcacattttgcttacagtaaatgaacttatttttattaactgcttttgcccatataacatgctgatatttactggaaacctaggcagcttcacggttatgactaaaggaccagattataatgccaggatataatgtgcagggaatcgctgggtgtctctgacaaagggtgtctcac

SEQ ID NO: 1429 - DNA, 280 bp, Homo sapiens
cctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctbtagaacactggccataggaaatgctgtttttttgtattggactttaccctgaaata

SEQ ID NO: 1430 - DNA, 156 bp, Homo sapiens
gaaatatggcctcaatatgtgccgccagtgtttcgtcagtacgcgaaggatatcggtttcattaagttggactaaatgctcttccttcagaggattatccggggcatctactcaatgaaaaaccatgataattctttgtatataaaataaacattt

SEQ ID NO: 1431 - DNA, 190 bp, Homo sapiens
cttttcctgttggaccattccattcaggagcacagagcaccatgattccaatcttgtgtgtgtttactaacccttccctgaggtgtgtgtatgttggatattgtggggttttagatcactgagtgtacagaagagagaaattcaaacaaaatattgctgttcttcagttttgtttgtggggtttgaaatt

SEQ ID NO: 1432 - DNA, 196 bp, Homo sapiens
cccatgagtctccttccgttctcagcgggcagggcacacctctcgcttgtagaagggacggctcagttcgctgcaccgacggtccttggaaatctcacataggtaggcactgcagcgttgtgaacgtgagcctcggatttctggccctctactgtaaatgtgccttagcctaagcctcccatcctgtgttagcgtt

SEQ ID NO: 1433 - DNA, 120 bp, Homo sapiens
agagtgtgtgcgagcagtagagatccgctcagcacaagtgtgacagaagttgctgccagaacttggacacactggccagctgaagctccgatgctggagatctgtgacaacagcgtgtgc

SEQ ID NO: 1434 - DNA, 265 bp, Homo sapiens
tactcttctggcagcatagcttcgctggatgagctggctctcaagggtgaagctccctgttaagttctgcttttcctgacttctagaggacagaggggctaggcgggcagctcatgattaatttttatgttgaggacttgtcgaaatatattttggtatgttgggtaaataaatataaggtagctgtaaaaaaaaaaaaccctcgagagcctctagacggccggcccactgatttccccccggggggcccaggaaggtcccatcc

SEQ ID NO: 1435 - DNA, 245 bp, Homo sapiens
acagacataatttgattgggaggtgattgatcctaaacagggccacagccatgacaacaaaagagccggttaacaaaattttttgttggtggcctttctccagatacacctgaagagaaattaagggagtactttggtggttttggtgaggtggattccatagagctccctatggacaacaagaccattaagaggcgtgggtttctgcttttttacctttaagggaggaggaaccagtcgaggag

SEQ ID NO: 1436 - DNA, 105 bp, Homo sapiens
gagcaccttctgtggtgcattttgtgcctacgattaagcttgacaacttgttcaattatgattgcataaatattcaatatttatatatggtcctccaatcttggg

SEQ ID NO: 1437 - DNA, 100 bp, Homo sapiens
tctgcccacgcagaacaaacaagtcttttcattttcgagagactgagatcatatcactgttttcaatcacaattttataagactagaatcaatataggca

SEQ ID NO: 1438 - DNA, 312 bp, Homo sapiens
gtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgagggtctgtcataggactctggacaatctcacaccttagctattcccagggaccccaggggacaactgacattgctccagatgttctcctgatgtagcttgagatataaggaaaggccctccacaggtggctgtttcttgtctatatgccaagga

SEQ ID NO: 1439 - DNA, 155 bp, Homo sapiens
tctgccgtctgccagactatgagggtctctctggcactagcctcatgctctgcagcctgctgctgctgctccaggccctgtgcagccctggcctggccccccagtccagaggccatctctgccggacggggcccacagacctggtgttttttgcg

SEQ ID NO: 1440 - DNA, 110 bp, Homo sapiens
  misc_feature 36: n = A,T,C or G
ctcgtccaattcggcaaacgcgacacttgagtgacnttgtcttagtttacgttgcgtacattattaatgtacttatatggaattgtaaccggaaagagcaattcaagcaa

SEQ ID NO: 1441 - DNA, 235 bp, Homo sapiens
gctagctgccctgctccacagcccttcctttcactccttgatacacgggcctgagaactagagaaggaccggagccttggcagccgtccttcagctctacagctaatcagcattctcactcctacctggtaatttaagattccagagagtcgctcctcccggtgcccaagatagattctgactgtactcctccaggcgccccttcccctacaatccaacaacctcagagccaccc

SEQ ID NO: 1442 - DNA, 115 bp, Homo sapiens
attttgatgatatttggtggtaagatagagaggaaggagcacattggttgttttggctccggtacctactggttattaaggatttgcctagatatccctggtggttagattccca

SEQ ID NO: 1443 - DNA, 265 bp, Homo sapiens
ctcgccattttgggcgagggcccaaaattgtttggaaatgccagggtgactgagtttccctgccccagcttttcgggatctctgggcccccatccccttgtgtgtgttccctctgccccagcttcctgctgtaattagctccacgtgtaccccgttcactccttccaccagctctccagccagcctatgaaattatattttagaggtgttcccaggacttttgggacctactaaacactgatggtatttagatgtgatgattata

SEQ ID NO: 1444 - DNA, 195 bp, Homo sapiens
  misc_feature 138: n = A,T,C or G
tggavcgtgtttgagctgctggtgcggtggtcagcgcgatgcccaaggccaagggcaaaaccccgcaggcagaagtttggttacagtgtcaaccgaaagcgtcttaaccggagtkgtcsacggaaggcagcccccggnagtcgagttgtcccacatcccacatgccttggaccacggtaagtcggtacggcagaa

SEQ ID NO: 1445 - DNA, 265 bp, Homo sapiens
atttactttataaaccttatctgtacaatatacgatgtgatgaaatttgctttttatccaaatattttgtatcttgtaaatatggctaattataggcatgcctataatcaacttagattccttatatctaataagagttcaaagagttatgagttgaagtcttgaatgcagggaactatctgatagtgttctaaaatttggttacttgggtttggataccttagtgggatgatgtaaatagaggctagctacctaggcttgtcta

SEQ ID NO: 1446 - DNA, 115 bp, Homo sapiens
aaaaaaaaaaggaactagtgtcaagttatctgactgactatcctatgtggaatagtatgttttcaaactaaattatctcttttctttccaaaaaaaggtcaggtgtgaagttttg

SEQ ID NO: 1447 - DNA, 267 bp, Homo sapiens
ggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgctggacgtacaataccacttccgctgtcacggtaaagtccgccatcagaagactgaagg

SEQ ID NO: 1448 - DNA, 266 bp, Homo sapiens
cgagagtctcgcttgcctccctcccgcgggagtatttctactctatatgaaaataccgtctgtagggttttaagacatttatcgacatcagggtatttattccaccttggccaggcctcctcggagaagcttgtcccccgtatggagggacggagccggactggacatggtcactcagtaccgcctgcagtatcgccatgactgatcatggctcttgcatttataggtaaatggagacttccggatcctgtcagggtgtccccatg

SEQ ID NO: 1449 - DNA, 267 bp, Homo sapiens
ccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagact

SEQ ID NO: 1450 - DNA, 210 bp, Homo sapiens
cacagaagacctcacgcctccccatcattgacattgcacccatggacataggagggccgagcaggaattcggtgttggacataggggccggtctgcttcttgtaaaaaccttaacccagaaccaccacatccgttgcaaacccaaaggacccaggtactttccaattttaggtactttagggcttttcacttaattggcgtaccttaccg

SEQ ID NO: 1451 - DNA, 170 bp, Homo sapiens
taaaggtaagcaccacagttcttgaaaaacaaggattatttattttgcaccatcgctgacccagagatgagtccttagagagtaatccatcttgtaccgtttagatctctcaaagccattcctaatctggaccctctctggatggccctcaagcttttacttgccagtca

SEQ ID NO: 1452 - DNA, 215 bp, Homo sapiens
gaaaagtcaacagtgtagttctaaaccttatcccaaacagaaaatgtggttatgatgtcactttctgcctggtcatcattaggcttaaattaaatgctgaagctgtcatcaaagggtttacactaaaatcttcagggctttaaataaaaggttaaggtccagcttccaaccacaattttccacattggcagctccattcttcttaataaggctcg

SEQ ID NO: 1453 - DNA, 200 bp, Homo sapiens
ctcgtgcgaattcggcacgagaatttgttctcagttgctagtctgtagagtatgaacccttaggaatgcccacaactttcccacttctcatagtccagctcagctcaaccccataaagcactttttgttcctgggtcctgaatgcacttgtcttctagtagaggaacaaattcaaggtttcccttctggcatgagaattg

SEQ ID NO: 1454 - DNA, 220 bp, Homo sapiens
aggaagctgccgcctggcaaaggcttggcaaaaagcctgctcaacgcagcttctcgccacacgcatgaccgcgcttacggaggcccgggtttggccttgagctcggcctcggaggcgaactgcgccttgccatggaccttgatcttgggctcgaagggctttttttgtacccgcagttgcgtggcaggttgtcggcctctcccttggcagcttgcgcatg

SEQ ID NO: 1455 - DNA, 135 bp, Homo sapiens
cacaggctgagaactcgttcacctccaagcatttcatgaaaaagctgcttcttattaatcatacaactctcaccatgatgtgaaggggtttcacaaatctttcaaaataaaaaggtatgacttaggaacctgcca

SEQ ID NO: 1456 - DNA, 126 bp, Homo sapiens
ggaagccttgctcattcttgaggagcattaaggtatttcgaaactgccaagggtgctggtgcggatgacactaattcagccaccgatttggaggaattaatttgcttcatagtatttggagcgcac

SEQ ID NO: 1457 - DNA, 135 bp, Homo sapiens
tggcctaacaaggccacaaggtaccaagaacgtagcaagccagcacagcgacgcgcgggcttttaccaaacacaacaaggttggtcgggacaatgattgggagggtttgtgcctttccccgcacggaccgcgcgc

SEQ ID NO: 1458 - DNA, 179 bp, Homo sapiens
cttttatggcaaacccagccaggtttcatctcgtcagggaaaagggatagaagtgaagagattctccctagtacctaattttcattttcattggtttaggaaaggaaatacaatgcacctgttctcttcgagactccagaataaaagtccttgcagctagaccaccgtttttatacacc

SEQ ID NO: 1459 - DNA, 223 bp, Homo sapiens
ccaatctcctggatgggcaacccaaaggtcacattcagcagctgtggccatgacctctctaacctcagaggccgacaatctcttgccaggttcatatttttgccactttgtgattcagcacataaacctttcatggccattatattccagggctgcaatgtgacttctgcgggccctatgcacttttcttaacaataaattgaaatcatacttatgagtgtgt

SEQ ID NO: 1460 - DNA, 229 bp, Homo sapiens
cggaggtgcaggtcctggtgcttgatggtcgaggccatctcctgggccgctgcgcatcgtgctaacaggtacttctgggccggaaggtggtggtcgtacgctgtgaaggcatcaacatttctggcaatttctacaagaacaagttgaagtacctggctttctccgcaagcggatgaacaccaacccttcccgagggccctaccattccgggccccagccgatatttttk

SEQ ID NO: 1461 - DNA, 217 bp, Homo sapiens
agatggtgagatttttgcaagtattaaccagaaggacggtatggtcagtttccatgataacctgaaaatataataacccagccatgcttcataacattgatcaggagatgctgaagtgcattgagctggatgagccgctgaaagcatggaccaggagatcacagtgaacctcagtttgtacaaagagtattggctcacaagaagatgattcaaggac

SEQ ID NO: 1462 - DNA, 104 bp, Homo sapiens
ggagcagccttcaagcattccattacgccccatctcgctctgtgccccttccaccaggcttcagcaggagccctggactcatcatcaataaacactgttacagc

SEQ ID NO: 1463 - DNA, 221 bp, Homo sapiens
aagaaaagaggggaaagagaaaaggaaggaagaaagatttcttctctagttctcttgtgacttacattctacattaaacataatctcagagggacttgattcttgccttacaactaactcttgcagtaaataccactgtgtgtggtatttaactgtataccctaatctttcctagggatcaaccaccactaatttctccctcacaaggactcctcgacagt

SEQ ID NO: 1464 - DNA, 219 bp, Homo sapiens
ctcgtgcgaaattcggcacgagctttccttgttctagccaggctgttctctgacagatggctttgaaaaggtgatccaagcaggcccctttatctgtacatagtgcttagttgggggtcttgcaagttttgcagcttcctcttggcttagcacagctttacccctttgcccctttcaatacttgatcaatgaattaataaactttctagaatttctgag

SEQ ID NO: 1465 - DNA, 147 bp, Homo sapiens
cttgaacttcagtgccctcactgtagaatttaaaagccttactgttgattgcccatgcttggacttgatggagaaattaaatatctttcattatgctttacaaaatactgtatatgtttcagcaggtttggggaattgggagaggac

SEQ ID NO: 1466 - DNA, 282 bp, Homo sapiens
ctggacccagcccctggagacaccattcacttttactgctttgtagtgactcgtgctctccaacctgtcttcctgaaaaaccaaggcccccttcccccacctcttccatggggtgagacttgagcagaccaggggcttccccaagttgcccagaaagactgtctgggtgagaagccatgcccagagcttctcccaggcacaggtgttgcaccagggacttctgcttcaggttttgggataagacacctggatcagactccagggtctgcccctgagtctggg

SEQ ID NO: 1467 - DNA, 344 bp, Homo sapiens
atttttttggaaacctctgcgccatgagagccaagtggaggaagaagcgaattcgcaggctgaagcgcaaaagaagaaagatgaggcagaggtccaagtaaaccgctagcttgttgcaccgtggaggccacaggagcagaaacatggaatgccagacgctggggatgctggtacaagttgtgggacttcatgctactgtctagagcttgtctcaatggatctagaacttcatcgcctctgatcgcgatcacctctgagacccaccttgctcataaacaaatgcccatgttggtctctgccctggactgtgacattctggactatttctgtgtttatttgtggcg

SEQ ID NO: 1468 - DNA, 351 bp, Homo sapiens
ctcgtgccgaattcggcacgagcctcgctcagcaccttctctcagacccaaggactatgaagttgatgctactctgaagtctctcaccaaccagattgagacccttctgactcctgacggccctagaaagaacccagctcgcacatgccgtgacttgagactcagccacccagagtggagcagtggttactactggattgaccctaaccaaggtatgcactatggatgctatcagagtatactgtgatctctctactcgcgaaacctgtatccgggcccaacctgaaaacatcccagccaagacctggtataggagctcaaggacaagacacacgtcttgctaggagagac

SEQ ID NO: 1469 - DNA, 311 bp, Homo sapiens
ttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaataaggccaacgtgagtttaaagttcgatgcagcagtatacctttcacaccctggtcatcactcacagagagaggacagagacactcacgcagtccctcccccccggtttggcagtaaggaccctcaaatgacccagacacactgattggacctgtattatataagatactaaaactcca

SEQ ID NO: 1470 - DNA, 350 bp, Homo sapiens
ctgaatcgctgcaccccagaggtacgctttcgtatgggctgtaagggaaaagggaggggggatgccgccttctgaagacacatgttggtcagttcccctgaaaaaccctgggcattcttaattcccaaattaatcctactggaccactctttgatctcctttcatacagtaaaaatacaatagctggcccaaggggaggttttcaggacagctcattccatcaggacctcatggccttgaccaaggcttgccaggaggtggggaaaggcagtgctttccttgacatcacgctagcaagtctctctcgactcttatgcaggatggtcagaacatcgagtccaggaatactt

SEQ ID NO: 1471 - DNA, 345 bp, Homo sapiens
ctcgtgccgaattcggcacgaggtgatttggaagatgatgagacaccccagctttctgcccatgccttagcagctctccaggattgacatgctgagcaaaagcaacagcttgagccaggcgaggatgataaatataacattggataatagaggagatttggatcgcatgtgtaagtcccctagtgtttaccagacactcagagagctgtccagagaaacttttcgatatacatctttgaatatgacaaggatttgccatgtatggagaggagtttatcttctatgattacaatactccattggactcacccgagagattcctgcacatagttttgacatcgtaat

SEQ ID NO: 1472 - DNA, 279 bp, Homo sapiens
gctttgataaacaatgtcagattttaactatgaaaacgacattaccttgtgcatttttatattgattcctatttgcaggttaagattaaagtttaaatgttttccactagtcatttcacttctaacttggtataggaggcttagctctcttaccaataccctataatgtccctgtatcacagaggattcaggaaaattgcacttgggatcaaagaaatggacctcttttggaaagacaaggcaccatgtaactgtatcgacacatcctcattaacacct

SEQ ID NO: 1473 - DNA, 207 bp, Homo sapiens
gtcgtaagggcctgaggatttttggtccgcacgctcctgctcctgactcaccgctgttcgctctcgccgaggaacaagtcggtcaggaagcccgcgcgcaacaaccatggcttttaaggataccgggaaaaccacccgttgagccggagttgcaattacccgaattccgattaccctaacaggccgaacggaaaatccttggaaaag

SEQ ID NO: 1474 - DNA, 95 bp, Homo sapiens
cggcacgagagtacttctagagcggccgcgggccatcgattttccacccggtggtacagtagtgtacccaattcgccctatagtcagtcgtatta

SEQ ID NO: 1475 - DNA, 174 bp, Homo sapiens
tagagatctcaaaccagactttaaagagtgagcaatgttctgtagcctttgatatcggaaataatttacaaataaatgatattctgacaactccctttttactgaattttatatgtgcctctaagcatatcactttaattacgagaatatgtctcacacagaacaagcatagar

SEQ ID NO: 1476 - DNA, 199 bp, Homo sapiens
gtccaggcctaatactcctaaagtaagagttgggtcctttttttcttcaatacactgtgcctgtacccttgtaaaggtattttatcttgctgcttatttgtggaatgaaacctcaaacaaacccaaagggggagggtagggcaggtacaggcagattggaaatctgcctccagattctattaaatacacccttttgcca

SEQ ID NO: 1477 - DNA, 110 bp, Homo sapiens
aaactttggggaaaaacttcgttttgtttacatccatgaatcatttgagcacgaaaaataattctcagcgtgagaggtacaaaatattgaggggcccctggggkgtataa

SEQ ID NO: 1478 - DNA, 145 bp, Homo sapiens
ttaagaagggcccctattccacttggcagcagctttatttctcagtagccatgatgatgacgatgatatttaatccccttaaactttgcttttttaggggaggagctcccccccatctaacattttcctcctgttctttcagggg

SEQ ID NO: 1479 - DNA, 154 bp, Homo sapiens
gtcttacttgtcttatttattctccaacagcactccaggcagcccttgtacacgggctctccttgcatcagcccaagctttctttgaaaaggcctcgttctaacaactttggcttgttctttcctttccctcaacctccccaattttccccctt

SEQ ID NO: 1480 - DNA, 107 bp, Homo sapiens
gtagtcgtgtcagtacgtgtccctccagtcccccgtccagtgtggggaaacaaaaaacccgtgtaaaaccgtgggggagaaaccgtgtagggtcccccgtcgtcgtg

SEQ ID NO: 1481 - DNA, 191 bp, Homo sapiens
gtcactttacagaaacagtgtgtaccattccgacgttacaatggtggagttcgcaggtgttcgcagccaagcaattgggcttggacacaaggtcggttgccccaaaaagagttcttaatttttttcttccacattcttaaaaacggagagagtatattcttaacttaagggtttagatgtgagagttctct

SEQ ID NO: 1482 - DNA, 110 bp, Homo sapiens
gtcaaatctttttcaaatttaattgtatatgtgtatataacggtagtattcagtgaatacttgagaaatgtaccaaatcttttccacccacacccggtgccaaggagcct

SEQ ID NO: 1483 - DNA, 215 bp, Homo sapiens
cgatgtgctgtctctggagtgataagaaagggctacatctcccgaaatgatttctttacgtcatgtattggtttccttctacaccttgaactttttgttgaactgtatgtactttaccccaaacctgttaataatttgagcgcttctatgtaaaagcaaagaaataattttaatactctggcaatcataaattttattggagaggatatttattt

SEQ ID NO: 1484 - DNA, 190 bp, Homo sapiens
atcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtgtgtgcacactccgaaacttttaactactgttttgtaagcctc

SEQ ID NO: 1485 - DNA, 228 bp, Homo sapiens
cacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgagggaagcagacatttgacctcaccaagaggggcgggagaactcactctaggatgaggtgggaacgtgt

SEQ ID NO: 1486 - DNA, 158 bp, Homo sapiens
ggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatc

SEQ ID NO: 1487 - DNA, 209 bp, Homo sapiens
cccagcccagggtccgggcccctagggccccctcaccaaggactcagggaagcctcttcacatcaaaccacgtctgttaggaccccagggaccggcctgcacctaccttagaccctcattcttggggaagaaagaggctcttttcaccactctaccctacaggaggggcggcccgccaccagagctcacctgggggccacagggacact

SEQ ID NO: 1488 - DNA, 201 bp, Homo sapiens
gtaacatacaatttttaagagcttatatggcagcttcctttttaccttgttttcctttggggcatgatgttttaacctttgctttagaagcacaagctgtaaatctaaaaggcacttttttttagagggtataaagaaaaactagatgtaataaataaggtcatgggaggctttatgttaaaaaagttgaatgttatatgt

SEQ ID NO: 1489 - DNA, 213 bp, Homo sapiens
ctttattccagagtggtctgtaggcctcaggtggagccaaagaacgttcatttctagtaagttcctatgtgatgacgctgctactgttggtaagaacccttttgagcatctgttttcagatattgtgcctcaaaagaggctatcctgattgtgatttttgtggtgcctgtaggttgactgtcccagtacactgtagataggatagagacccts

SEQ ID NO: 1490 - DNA, 236 bp, Homo sapiens
cggcacgaggtacccacaggactccacgcctgagagtcaggtcttaacaccctcattccttttcccaggctcctcctgctgaaaatgtttgctttcagaggtgatgtgaggaccatttttctggaagttctcttttgtcatccaaattctggtggtggccttgtttctattttggaaccagttgccgagcaaacatgtacatatttacattgagagcatatatggctcaggtgkgg

SEQ ID NO: 1491 - DNA, 189 bp, Homo sapiens
ggactttcggaggtgtggactctgcctgcctacctggtctgggaagatgttctaccatatctccctagagcacgaaatcctgctgcacccgcgctacttcggccccaacttgctcaacacggtgaagcagaagctcttcaccgaggttggaggggaccgcaacagggagtattgctttgtaattccggt

SEQ ID NO: 1492 - DNA, 173 bp, Homo sapiens
gagaagctgacccaggaccaggatgtggacgtcaaatactttgcccaggaggctcttaactgttcttgtctctcgccctaatgctggaagagggggcaaacaacttggcctcttggtgtcaccccttcaacccccacaaaggtccctctttttggggaagcacttggggggcc

SEQ ID NO: 1493 - DNA, 178 bp, Homo sapiens
gtgcaatgcaggcagcttctcaagcaggtgttccatttggtktaaaaaatacttgggtctcagggccttaaatctactccagctccaggtagttcactttttttaacacatgtcagcagcagcaacagcagcgtgtccagtttacaccacaacacccgtagcgacccacaaccttttg

SEQ ID NO: 1494 - DNA, 280 bp, Homo sapiens
gaacatcttcgcctggtgtggtggaaagtccaacatcctggaacgcaacaaggcgaggggaccttgcccttggccatcccgggacagttagcgacagggccaaggccagggttgagattgtcacttatggggaggagcctgctgagatgatccagggtgctcgggccccaagccttgctctttaaggagggcaaccctctaggaggacctctacagctgacacggcacatgtccagggccgcagctctgtatatgggttctgatgccactcgacagatgw

SEQ ID NO: 1495 - DNA, 135 bp, Homo sapiens
caaccttgcaaggaccacacttccccatacccttcagtgcagtgttaccagggcaggagaccttgttgccgttaagcagttggaccattggtcaccttgcttgggtagagcctaggtttttcctttgggcccggy

SEQ ID NO: 1496 - DNA, 111 bp, Homo sapiens
cggcacgaggataatttcccttggaagaacaaaggaaaggtctggaaatcaggaaggtatgaatcctaacctcaatacaacagaagtgcaattccctgtaaggatatctct

SEQ ID NO: 1497 - DNA, 135 bp, Homo sapiens
ttataagaagactctgaaaggtggaaagaagtagcagtattggctaagaactgctgggcatggtggcacatgcctgtgatcccagctacttgggaggctgaggcaggagaatcgctttgaacctcgggaggcaga

SEQ ID NO: 1498 - DNA, 239 bp, Homo sapiens
gggaatgtcacccgagactgtcacaggcttgcatacctttggcctacacaccgggctctagggccataattttccaaccttgggagtcttcttttcacttaaattccaggtaggcttcagtattcggctttaaggttttacacttttaaaggaaagtgtggtttattttgtctaatgggattcctggggcccgctctctccctagagggggttgggagagtttgggagtgggtctctac

SEQ ID NO: 1499 - DNA, 239 bp, Homo sapiens
ctttagtacgtgtggcttggtcacttcgtcgctaaggtaagaacgtgcttgtgggaagacaagtcctgtggcttggtgagtctgtgtggccagcaagcctctgatctgtgcagggtattaacgtgtcagggctgagtgttctgggatttctctgagagcctggcaagaccagttgttttgtctcgcgggtctgtcaggttggaaagccaggccgtagaccgagtttcctttctgagcts

SEQ ID NO: 1500 - DNA, 138 bp, Homo sapiens
gcagctttgggcagctttgagaagcggtacaagagttctgtgcctgtgtgtccagccctgggagccaagccaagtgcaatttattttaaagctcttaagagccactccttggcccaaggattgcgtggaacccctgar

SEQ ID NO: 1501 - DNA, 154 bp, Homo sapiens
gccgccttacgacacagccctcatctatgactacgagggtgacggctcggtggccgggacgcttgagcttcattctgttcagccagggcgattgaggaccaggactacgacttaccttagagacttgggggcccgctttcgtcccggcttgcag

SEQ ID NO: 1502 - DNA, 150 bp, Homo sapiens
gccagctcccacccatctttttcttgaatctcttctgatttccttaggacgactgaaggtgtgggctgacggaattgccctaagtttgaaggtagtataaggtgctcaaggcccctaatccagacactttaacctttggttaaccccctt

SEQ ID NO: 1503 - DNA, 135 bp, Homo sapiens
ttcaaatattcctttattaattcctttattaattgataatattcctctatcaattacctctactcatcttattaatagggaaaataaacaatacttgtttaaggccttgaatgttataaacaatagggtaatatc

SEQ ID NO: 1504 - DNA, 160 bp, Homo sapiens
gaaaaactcaggcccatccattttctcagatctccttgaaaattgaggccttttcgatagtttcgggtcaagtaaaaattggcctcttgcgtaagttttcaaggtttttttgaagctttttgtaaattgtgatagggactcttgggccctgaactctacg

SEQ ID NO: 1505 - DNA, 163 bp, Homo sapiens
atttttggtccgcacgctcctgctcctgactcaccgctgttcgctctcgccgaggaacaagtcggtcaggaagcccgcgcgcaacaaccattgcttttaaggatacccgaaaaacacacccttgagagccgaaggttgcacattcacaccaatttcgcgatta

SEQ ID NO: 1506 - DNA, 196 bp, Homo sapiens
aaataacaaaaaagagaaacgccaacaaaaatcagcagatgttgaagacaggggtcttgggggttggcttcggcaaccacattcttggagttaagacttttcttagttacttttttttagggggggtttcaaggcttaaccccaacttcctttccaaccttcttccaacctaacctttggacaccactgtgtaaag

SEQ ID NO: 1507 - DNA, 178 bp, Homo sapiens
gtccattttaactggcacctcagggattaaaatcctactttttagtgtagttccactcattcatgaaatgaataggacctatttgtattatgggaggatggtttcagttaacctaggaaaatgttcaataaccctcaaagggatgaaggggtttttatttttaaataggtttataaaa

SEQ ID NO: 1508 - DNA, 289 bp, Homo sapiens
ctcgtgcgaattcggcacgagttaagttgtggtctgacacacactgctgtggttccctggattagtgaatgccgtatgcgggacccccaaaagtacaagggcatatttaacggattctcagttacacttaaaggaggatggtgttcgtggtttggctaaaggatgggctccgactttccttggctactccatgcagggactttgcaagtttggcttttatgaagtctttaaaggtcttgtatagcatatgctggagagagatacttatctctgcgacatcactatattg

SEQ ID NO: 1509 - DNA, 216 bp, Homo sapiens
ctttcccccactttcagggctcaccaggcactggcagggagggtaagggctggctcagataccctccccacagattcctagcaatgaaaatctaatatattccttcctgttgccccttggggtttggagagtcagtgccttcagtcaagtgccttccagcctcggctcagcacatccttgccacaaatcagtgtcttggggcttggccacccttcc

SEQ ID NO: 1510 - DNA, 115 bp, Homo sapiens
cctggtgaagaattgcatcgtgctcatcgacagcacaccgtaccgacagtggtacgagtccactatgcgcttgccccttgggcccgcaaagaaggggagccaaagcttgacttcc

SEQ ID NO: 1511 - DNA, 172 bp, Homo sapiens
ggtgagcctggatcccccggccctgctggctttgctggcccccctggtgctgacgcacctcgtgctaaggcgaaccttggtgatgcttggtgctaaaggcgattctgggtcccctggcccttccggacccgctggaccccctggccccattggtaattttgggtctcctggg

SEQ ID NO: 1512 - DNA, 160 bp, Homo sapiens
ctcgtgcgaattcggcacgagaagaaacaaaaagaaaaagaagcagaagaagctgaaagcaattattcattggtacctccagtgtcaatttgagaatttctttaaattagggaaagccaaggttttattgccaggaaccttttgggaaattaaaaaggaa

SEQ ID NO: 1513 - DNA, 223 bp, Homo sapiens
accaggtataggccagaaaggaggtggccagtcagtaccttgctcacgtcagctaagggggacagtgatgtcatgtgggtgactcttcttcatttgaccaaggccagcctcctgttcttacctttgcccattcatttctggctattgggaaactaccacctgttgagttagccaattaggccagggagatcagaggggcttgggttccggccattgggcacat

SEQ ID NO: 1514 - DNA, 216 bp, Homo sapiens
gcagtgggacccaagtttaaggttgtgtgagggacaactccctccagtcagacgagtgaaagttactgcacatataatctcacttgggggatgatgtcaaatgtccatgtctgcgacctgtctaaactaggaggctgggctaaaaggctccttgccctcttcttccagcttcccccaaccacttgcaacaattaggaccggttggtaggtcacaca

SEQ ID NO: 1515 - DNA, 236 bp, Homo sapiens
ccatctttgcattgttcctcatccgcctccttgctcgccgcagccgcctccgccgcgcgccttcctccgccgccgcggactccggcagctttatcgccagagtccctgaactctcgctttctttttaatcccctgcatcggatcaacggcgtgccccaccatgtcagacggagccgtagacaaccagctccggaatcaccaccaagggcttaaaggaggaggaggaaggttttgga

SEQ ID NO: 1516 - DNA, 294 bp, Homo sapiens
cttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagactttgagaaagagaagggatttctacttcggaaagctacgggacaattgaattgatttgccaagggaacgcgaggggaaaacg

SEQ ID NO: 1517 - DNA, 265 bp, Homo sapiens
ggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttcagcagaagtatgatgggatcatccttcctggcaaataaattcccgtttctatccaaaagagcaataaaaagttttcagtgta

SEQ ID NO: 1518 - DNA, 334 bp, Homo sapiens
gccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatatgtcgaacaattcatatatttgaagtggagccatatgaatgtcagtagttttatacttctctattatctcaaactactggcaatttgtaaaggatatatatgatatataaatgtgattgcagcttttcaatgttagccacagtgtat

SEQ ID NO: 1519 - DNA, 388 bp, Homo sapiens
cctccttccgcaacacgggcgagatcaaagcactggccggctgtgacttcctcaccatctcacccaagctcctgggagagctgctgcaggacaacgccaagctggtgcctgtgctctcagccaaggcggcccaagccagttacctggaaaaaatccacctggatgagaagtctttccgttggttgcacaacgaggaccagatggctgtggagaagctctctgacgggatccgcaagtttgccgctgatgcagttaagctggagcggatgctgacagaacgaatgttcaatgcagagaatggaaagtagcgcatccctaggctggactccagatctgcaccgccggccagctgggaatctaacttcacgtggcttctgatgaatcttgc

SEQ ID NO: 1520 - DNA, 290 bp, Homo sapiens
ctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagagcccgttaaaaagcagagcaacacaattatagttatcctactgtagcca

SEQ ID NO: 1521 - DNA, 232 bp, Homo sapiens
gaggagaatgtttcttaggggaattcgctaggtttaacgatttgtttctcctgctcctcttctatcagacctgaccccacacaaacctgttccctcggttgtgttgaagtccctggacagtgggcaggggttggcagaggacacgagcagccacttcccgtaccccctcttctctctgtaagcccattccctgtctttccagggacttttgaggcctctttcctctacggtc

SEQ ID NO: 1522 - DNA, 218 bp, Homo sapiens
ctcgtgcgcggacaactcagcctgccaaggagccgtgttaggagggtcggggagaaatcaggctctagaggctcataaaattcaacgtgaggaggcaagtgacaaggccaagcaaggcacagtggacggtcatgaaggagcggggttttggcaggcgggtaacgtccaghgagaggaagcgcccctgttgcccttggcccgccgtctggacgcgcggc

SEQ ID NO: 1523 - DNA, 298 bp, Homo sapiens
gataggtacaagagttacagcccttatgacatgttggaaagcatcaggaaagaggttaaaggagacctggaaaatgctttcctgaaccctggttcagtgcattcagaccaggcccctgtattttgctgatcggcctgtatgactccatgaggggcaaggggccgcgagataggtcctgatcagattcatggtctcccgcagtaagtggacatgttgaaattaaggtctgatttcaggagagagtccggcaagtccctgtactattatatccagcaagacactaagggcgactaccaga

SEQ ID NO: 1524 - DNA, 119 bp, Homo sapiens
gggtcccttgcaaggtgacaggcccctcggctctgtctggtacgcctatcccttcacccaggggcaattggcattgttttcccacctgtccctaagaggcttctaatattgcttgtatt

SEQ ID NO: 1525 - DNA, 221 bp, Homo sapiens
gaaaaagcaaggggtttgtccaggtggcccctgaattctgcgcaagggaatgggcctgggggaacctcaagggaggcctaaagcacttgtaactttgacccgtctgtctggagtcagaccctgttggaaagcaggggtagaggggaccctggaggcaggcttttccggatccctaggggtggcaagtccagcccttcctcaccacttttcccctttcagtg

SEQ ID NO: 1526 - DNA, 99 bp, Homo sapiens
ggaacttcacaagagttttgggtactcagaggcaggcaggatcattgaggggtcatctttgaaggcttggtacccacttattccagatatatccttatc

SEQ ID NO: 1527 - DNA, 450 bp, Homo sapiens
ggaacttcacaagagtgtgggtactcagaggcaggcaggatcattgagggtcatcttggaagctggtcaccactaatcccagatatatctatatctatagatagatagctagatagatagatttagacagagtctcactccatcacccaggctggagtgcagtgtcatgatctcggctcactgcaacctctgcctcctgggttcaagcaattctcctgcctcagcctcccgagtagctgagattacaggcacatgccaccttgcctgactaatttttgtatttttagtagagatgaggtttcaccatgttggccagcctggtctcgaactcctgacctcaagtgatctgtctaccttggcctctcaaagtgctgggattacaggcatgagccaccacgcccagccaagagtgtgtatagtccagtgcaatgggagggacctgaaaggggt

SEQ ID NO: 1528 - DNA, 105 bp, Homo sapiens
cccctctgaacctgagattttggtcaattctctgcttgcacagctctaccttccttcctaatcaattggtcataaacgggtacgaggcagcttgctcacttccag

SEQ ID NO: 1529 - DNA, 160 bp, Homo sapiens
cctgcctccgttttcctggacagctcaatgctgacctccgcaagtttgcagtcaccatggtcccctttccaacgtctccatttccttaatgcctggctttgcccttttaccaagccgtggaggcaagcagtatcggagctctcacaagtccccggactct

SEQ ID NO: 1530 - DNA, 198 bp, Homo sapiens
gggaacatcgaggagatggtggcccagctgaggaacagctcagagctggcccaagagaaaagtgtgaggtcaacttgcagctgttggatggttccaacaaggaaggagcctgtcttccctggggcttcaacatcaaccaggaccccagccgtaatcccgtgggaccttccgaggaccgggtgccttgttcttggcttg

SEQ ID NO: 1531 - DNA, 218 bp, Homo sapiens
caagaaggccctgctcctcagggctcaacgagatcgagatcgcgccgagggcaacagccgcttcaacctcagcgtcactgtcgattgccttcacgagtaacaaccggagccctgggcaaggcaagtattttattcaaaaccaccaagaccctccggcctcccaataatgaagttgcccccttggacggttgggtccccagacccaggaatttggcctt

SEQ ID NO: 1532 - DNA, 150 bp, Homo sapiens
gggagaagctgagcagtcaagatgtgtgacttcaacgaagaacaagaccgcagagttcagggagggccttcaagctgttttgacccgaaacaaggtgaatggcaagaattcctgtacaagccaagttgttggggattgtgaatgaagggg

SEQ ID NO: 1533 - DNA, 275 bp, Homo sapiens
accaagtttagggaggactgccgcccggatcgcgaggaacctgggccgcacagctgggcctgtcctccacaccctggccgcctactaccccgacctgcccaccccagaccagcagcaagacatggcccagttcatacatttattttctaagttttacccctgtgaggagtgtcctgaagacctaagaaaaaggctgtccaggaaccacccagacaccgacccgggtatgcttacacagtgcgtgtccacctgacactgagtgacccgaagctggg

SEQ ID NO: 1534 - DNA, 281 bp, Homo sapiens
gtttgcttaggcgcagacggggaagcggagccaacatgccagttgcccggagctgggtttgtcgaaaaacttatgtgaccccgcggagacccttcgagaaatctcgtctcgaccaagagtctgaagctgatcggcgagtattggtctccggaaacaaacgtgaggtctgagggtcaaatttaccctggcaagagtccgcaagggcgcccgggaactgctgacgcttgatgagaaggacccacggcgtctgttcgaaggcaacgccctgctgcggcggctgg

SEQ ID NO: 1535 - DNA, 284 bp, Homo sapiens
ctgagatggcattttatctgccaactgcagacttatggcttctcaagacctcatttgtccccttcctcatatgttgtttttatatgactgaaatcacatgcagaaattcgtgattagtatggctctgcttttagtttttggtggatattggtatgtataaattttcagtacttaaattgattttagcactttgataggataggctctcaaaaggttgtgtaaaacagctgagtgtaatttcacagcgcttatgtctcttgcatatttaagagactctctgtgaa

SEQ ID NO: 1536 - DNA, 552 bp, Homo sapiens
ctgagatggcattttatctgccaactgcagacttatggcttctcaagacctcatttgtccccttcctcatatgttgtttttatatgactgaaatcacatgcagaaattcgtgattagtatggctctgcttttagtttttggtggatatgggtatgtataaattttcagtacttaaattgattttagcactttgaatagaataggctctcaaaagtttgttaaaacagctgagtgaatttcaaagcattatgactttgcatttgaagacactgctgagagccaggaaaaaggagtgggttctgacattggcttgacaggattgatccaacaggtttgtaattaatttatctggtaattggttggagtatacatgttatacatcacatctttaagtgtaagtgttgtcattaattcctttctgttaattaaaccagtattttttctgtgtagggctagatagtaaatattttaagcaagtcatatgctcactttttggtttggtttggttttggtttgggtgacaaagtgagactccatcctcaaaaggaaaaa

SEQ ID NO: 1537 - DNA, 190 bp, Homo sapiens
gtgcactggcccctccccacccctagggggcactcagtagctgctgagaaggcctgtccacgaggctgttggaacccctccaataaatacttaggaggtagtgtatctgatgcttggttttcggtggaggaaaattgtattggggaacttaaaacatcagggttatttttaataggatccgcagcaccca

SEQ ID NO: 1538 - DNA, 200 bp, Homo sapiens
tttcattgtgggagcagacaatgtgggctccaagcagatgcagcagatccgcatgtcccttcgcgggaaggctgtgtgctgatgggcaagaacaccatgatgcgcaaggccatccgagggcaccttgaaacaaaccagctcttgaggaaacttctgcctaaatccgggggaatgttggctttgtgttaaccaaggaggac

SEQ ID NO: 1539 - DNA, 190 bp, Homo sapiens
gtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacag

SEQ ID NO: 1540 - DNA, 240 bp, Homo sapiens
cttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgccgagatgaaacagaattctatttgggcaagagatgcgcttatgtatatatagcacaggacaacacagtcactcctcgcgggcaaccac

SEQ ID NO: 1541 - DNA, 195 bp, Homo sapiens
ctcattttacgctgtctctgacataaggagtgcctgaatagcttggaaaagtaacatctcctggccatcccttcatttaaccaagctattcaagtattcctatgccagagcagtgccaactcttggaggtccagagtccagccaatggcctttgtgtggtagttctaaatttcaattgcacctgaaaacctggca

SEQ ID NO: 1542 - DNA, 280 bp, Homo sapiens
cgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctgtgggaaaaaaggcagcagctaccaagaaccagcccctgaaaagaagcctgcagagaagagaccttcctacagaggggaggaggccttctgcataaactcttaaatttgattattc

SEQ ID NO: 1543 - DNA, 316 bp, Homo sapiens
tttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgacaactgaatgtataaaaaaattataaactggtgttttactagtattgcaatagcaaatgcaaaatattcataggaaaaaaaaa

SEQ ID NO: 1544 - DNA, 352 bp, Homo sapiens
ctcgtgccgaattcggcacgagccaagagcagacagcccacggacggactgcaagtcggaagcgcgggcggaaagctgtgcagcgcccacctcggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccgcctcgctcggccacttccggcaagggcggaccggcccagtggtgcgcgacccagataactccctggagaggcgggatgt

SEQ ID NO: 1545 - DNA, 353 bp, Homo sapiens
acaatccgggaaagtcgctgtggacttgccacgtttgtcatcatcctgctcttggttttttgtcacagaaggttgttgtagtggttttggggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagacttgggaaatacagattggttcaaagaaaccaaaaaccagagtgtcctcttagctgctgcagagagactgccagcaattgtaatggcagcctggccacccttccgacc

SEQ ID NO: 1546 - DNA, 358 bp, Homo sapiens
ggaagggggagaggagagaagaaagggaagaaggaacacccaccatttctgtccatgagaccaaccacccaatcactggaatggcaggctacatttataccctgtcccgaagagtttgcagaaatagctcttccagatctagagaagtgtgagtttatttttttttaacccaaaacatttccaaattctgagaaggaaaaatgtcttagtgtcgcaagagccaaatggtagaggcaatagttgagtcctatacaatgttattctccaagtgtaaaccttccagatcggtttttcacatttagatttgcaagacgccagcaatgtcagagccaaactatcatcctggttaactttctga

SEQ ID NO: 1547 - DNA, 229 bp, Homo sapiens
ggaagggggagaggagagaagaaagggaagaaggaacacccaccatttctgtccatgagaccaaccacccaatcactggaatggcaggctacatttataccctgtcccgaagagtttgcagaaatagctcttccagatctagagaagtgtgagtttatttttttttaacccaaaacatttccaaattctgagaagggaaaatgtcttagtgtcgcaagagccaaatggt

SEQ ID NO: 1548 - DNA, 344 bp, Homo sapiens
gttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgcccttttggctttggtacctacaccagcccttttttacttgttcactgcaaaatttaccgaaccttcaaggatactctcagaaggagccaatggacactgagtgtagacaatgtgaaatgccaaaacctgagagtgctcctaataaaaaggtaaatcaatcttaaaaaaaaaaaaaaa

SEQ ID NO: 1549 - DNA, 364 bp, Homo sapiens
aaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactaccaccaggagatagagaatcctgattattgacctgctagatatgattgtacacggagtctccattccttacaatggatcttttgggaatcttgttgtccctatggcttgctgtgt

SEQ ID NO: 1550 - DNA, 268 bp, Homo sapiens
tccaccagatcggggatgcctactccaactcggacaaatccctcactgagctggagagcaagttcaggcagggccagggaacaggacagccggcaggaggaccaggctcaacgaggactttctgggaatgctggtccacaccaggtccctcctgaaggagacactgcgacatctctgtggggctcagggcaaatacgacctgcttggcccttaccattagggagccatgggaccgactaggtcggctgagagtgagttatcttaagtg

SEQ ID NO: 1551 - DNA, 267 bp, Homo sapiens
ttacaccatggtataaagtgggcatttaatatgtaaagattcaaagtttgtctttattactatatgtaaattagacattaatccactaaactggtcttcttcaagagagctaagtatacactatctggtgaaacttgggattctttcctataaaagtgggaccaagcaatgatgatcttctgtggtgcttaaggaaacttactagagctccactaacagtctcataaggaggcagccatcataacatgtgaatagcatgcatgggta

SEQ ID NO: 1552 - DNA, 230 bp, Homo sapiens
atcagatggataatgtcctatttctctagtattctattcactttacacctatcttaaaggattaattttgttatatcaattacctaatagtcaagcttggggtgaaaggaattttatccatctaaatgatttggtatttatataggtaggattgatttatctgagattccccattggtccagtatgtcaccaccatcccctttgatagtatgtattttatagatataaat

SEQ ID NO: 1553 - DNA, 560 bp, Homo sapiens
aatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacagggtctcccttgttcctttaaattttgtgaaatataacttacaaataagtacttaaaacagagcttaatgggtaaagcaacagctgtgtatcacaaactagatgcagaggaggtcttgccagcactccaaaatctctgtgtgcccctctgacactcactgttcccccagagcaacta

SEQ ID NO: 1554 - DNA, 316 bp, Homo sapiens
atattttccccagttttttagccattgtgactaaagctgctatgaacatcattatatgagtctttgggacatatgctttaatttttccatggggtaaataccaaagaacggaatggctagatcatatagtagaatttaattttgattaatttctaactaacattaaatggccaaatgtggctagtgattaccatattggacagcacagttccgagtatattctttaatcagtgattctgtacaggaaagactcccctcttctgtaaatctgatttatttgctcatcatcacttggcaaggtttttgggggtcactt

SEQ ID NO: 1555 - DNA, 378 bp, Homo sapiens
ctaatttaagctgaaaggaaattatttagggatatatagataagtcactgtacccttgagatgactgaagaaacaaacaaactctagactgagattcctaggatgactgttagctctccatactgtagtacaagtcctccaaaggggcgacacaattgacacaatcaggagcactaagtcagtaggctgccacagactcccacggctcctagtaacagagtacataatttctgccatagttcagacactgctgaattaggactgccacacagctgccagtttcaggtatgctcttactgccacaatcagcatgagagagggggtatccattgtgtatctcttccctgtgtaatcagcagatcatgtcatagcagggca

SEQ ID NO: 1556 - DNA, 510 bp, Homo sapiens
ctaatttaagctgaaaggaaattatttagggatatatagataaatcactgtacccttgagatgactgaagaaacaaacaaactctagactgagattcctaggatgactgttagctctccatactgtagtacaagtcctccaaaggggcgacagcaattaacacaatcaggaagcactaagtcagtaggctgccacagaactgccacggctcctagtaacagaagtacataatttctgccatagttcagacactgctgaattaggaactgccacaccaagctgccagtttcaggatatgctcttactgccacaatcagcatgagaaaagggggatatcccattgtgtactctttccctgtgtaattcagccagaatcaatgtcataaacagggacatatgattttcaaaacccaaatcactaaaacacatcctacaagcaaggtaaccagaaaagggagcctgatagatttcactccgttatgatgagatttacaccttgcaaacaaacaa

SEQ ID NO: 1557 - DNA, 378 bp, Homo sapiens
ctcgtgccgaattcggcacgagggaaacatttacacccagtcagcttgaagagtttcaaatggaccctaccacttgagaaatcaaggctagcagtctactatggggaattgaggaaaaatggattaatacaagagtcctgtgataatatacaacccaggacagggttcttttaacatggattccatgcagtgaattgagacataggtttcttacccaacacaaatggacagtggatttgactttctaagactttttttgtggacatttgacatttgagagaagatgcacactaaccagatatagttttatgcctggaatttttgcagtttgattgaatcgtatacctctgaaatgttaattttaataaattgtacact

SEQ ID NO: 1558 - DNA, 253 bp, Homo sapiens
ctgactttgtcttctccgcacgactgttacagagggctccagagccttctctctcctggtgcaaaatgggcaactcttaagggaaaactcattgcaccagttgcggaggaggggggcaacagttcccaaacaataagggtcactgtgatgggggtttgggacaaattggtgtggctgttctatcaacatctgggggaatgcttgggctatgaaacctttcctctgggggttttgggagatgaaacttaaaagg

SEQ ID NO: 1559 - DNA, 273 bp, Homo sapiens
gcagagctgagttcaattcctgggtatccttgttgactttctgtctcgttgatctttctaatgttgacagtggggtgttaaagtctcccattattaatgtgtgggagtctaagtctctttgtagggcactcaggacttgctttatgaatctggggtctcctgtattgggtgcatatatatttaggataggttaactcttcttgttgaattgatccctttactattatgtaatggcctctttgtctctctggatctctgttgggttaaagctgt

SEQ ID NO: 1560 - DNA, 275 bp, Homo sapiens
caggccacgccttcagaagaggccaggcacaaagcacatgttatgtcattctatttgtatgaaatgtccagaatatttgtgggcagatttcacacacagggaaaaaaaaattgtcccgattgggcaattccttagggacagaaggcggttggtggttgcttagggttgggggaggatgagactcgtgccgaattcggcacgggcaaccattgagaggtgttacaagattgcagttaattttaacatgtgttaatgtgccatgggggaaagctact

SEQ ID NO: 1561 - DNA, 316 bp, Homo sapiens
aactactgtccgctaactagttatccaaattgtaaagctacagaagcccagttgaggggtaagtgtgcctggctcacacagcctgcaccctgtcacctcggcaatgagccagtgttggggcactggggacttctaacccttggattgctctttttgacctgtgcataccttctaattgtaaaatatatttcagaccgtggagtaccttgagatctgagcaactgtgttaattgaagtattaccaatggtccacaagtgaaagatgtttttgggggttgcaaaacaagaattccgtcactctttaataatgtcacag

SEQ ID NO: 1562 - DNA, 249 bp, Homo sapiens
ctgtgggaggatgaaggagtccgtgccttctacgaacgctccaacgagtaccagctgattgactgtgcccagtacttcctggacaagatcgacgtgatcaagcaggctgactatgttccgagcgatcaggacctgcttcgctgccgtgtcctgacttctggaatctttgagaccaaggttcagggtgacaaagtcaactttccacaatgttttacggtgggtcgccaccgccatgacgcccgcaagtgg

SEQ ID NO: 1563 - DNA, 110 bp, Homo sapiens
gaagagtgacagttcagttaggggtgtgaacttccagaggagcactgctttaagctggaaccttgaggagccattgtggcaaaaaggcacagttaggtctggttaaggaa

SEQ ID NO: 1564 - DNA, 102 bp, Homo sapiens
cttttatttttccttacacaatgacgtgttgctggggcctaatgtttctcacataccagttgaaaacccaaattttgttgttcatcttttcaaaggaattcg

SEQ ID NO: 1565 - DNA, 102 bp, Homo sapiens
accacgtagaatcctcaaccgtgcggaccatcaaccttcgagaaattccagttgtctttttccaagccgaatcctgcctgtagatggccggggagggcttct

SEQ ID NO: 1566 - DNA, 100 bp, Homo sapiens
ccaaagtttcattgcattctcccttggggaggctgtgagagagggcttgtatccctcttgtgctaagcagactctactcctaaactgacttcaatatttt

SEQ ID NO: 1567 - DNA, 100 bp, Homo sapiens
gagaatcgatagggttaattttggagcagtggcttataccattcacctctgtttttttgtgattatttcacagataatgagaccttaataacaaataggg

SEQ ID NO: 1568 - DNA, 100 bp, Homo sapiens
ccgcagcacccaccccgcaccggcgactccatcttcacggccaccccctgcggcggacggttgaccaccagccaccacatcatcccagagctgagctcct

SEQ ID NO: 1569 - DNA, 100 bp, Homo sapiens
cttgcaggaaaataatctgagtcccaagctagcctgtgctcatccacaatcacaatgaacatgtcaaggaagaatttgcagagactcaagggaagcacaa

SEQ ID NO: 1570 - DNA, 100 bp, Homo sapiens
caggagagtcccatcagcaggcggcattggagtctaggagctcagctgtgtgtccatcaacacacaaattcgtaaaaaacacacatggcctcgccatcgg

SEQ ID NO: 1571 - DNA, 100 bp, Homo sapiens
aattgatgtttagtttgctttagtcatttaaaaagatattgtaccaggatgtgctattaagagcacgtatccattattcttctcaacccaagaaccttgt

SEQ ID NO: 1572 - DNA, 111 bp, Homo sapiens
ccaaagaattcggcacgagccacggctactcaggtcctcttgaaatccgtcctctccatggacttccacatccctctctgctctaggtttgattaacagaaggttgtaaat

SEQ ID NO: 1573 - DNA, 303 bp, Homo sapiens
cgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacggtcctgtgcaggtgtcctcccgccaggagaacggcgccaggtgattcctccgtgacattgcgagagccagagagaacatccagaaatcctggctggaagttcaggcccggggcctccagcggcaccagcggagaccacggtaggttgtgtccggattgc

SEQ ID NO: 1574 - DNA, 304 bp, Homo sapiens
tcaaaggcatgacttgctcatttttgcacctccaatacatagcccagtacttggtatttggtggatatccagtaactgtttattggatgaacggatgaatatatcactgagtagtaggaaacagggagccatcaccaggatgtattacaccagtattcgaaatagataagctaagcagtgggaggtatatgagtttgtggggagaaaagtaggaatcacatgggtcggacggaaggctttttcaataattcagacttagatttgggtgtggtgacacacagggataagaggtcaaatgatcgtg

SEQ ID NO: 1575 - DNA, 220 bp, Homo sapiens
tcaaaggcatgacttgctcatttttgcacctccaatacatagcccagtacttggtatttggtggatatccagtaactgtttattggatgaacggatgaatatatcactgagtagtaggaaacagggagccatcaccaggatgtattacaccagtatccgaattagattagcctaacagttggaaggatatgaatttgtggggaagaaagttaggatcaca

SEQ ID NO: 1576 - DNA, 123 bp, Homo sapiens
agaaaggggaaaggaacacgcgggtagatgatttctagcaggcaggaagtcctgtgcggtgtcaccatgagcacctccagctgtactagtgccattggaataataaatttgataaggtggtga

SEQ ID NO: 1577 - DNA, 313 bp, Homo sapiens
cggtttcggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaac

SEQ ID NO: 1578 - DNA, 313 bp, Homo sapiens
ctttttccaggctttaggtatcaccactaaaatctccaggggcaccattgaaatcctgagtgatgtgcagctgatcaagactggagacaaagtgggagccagcgaagcacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattcta

SEQ ID NO: 1579 - DNA, 104 bp, Homo sapiens
ctagtctcgagagtacttctagagcggccgcgggccatcgattttccacccgggtggggtaccaggtaagtgtacccaattcgccctatagttagtcgtattac

SEQ ID NO: 1580 - DNA, 249 bp, Homo sapiens
acaagaattatatggattttgtgcctgagaataatagagcttgagctgtctgaactattttacattttatggtgtctcatagccaatcccacagtgtaaaaattcaggaattcaatgagaaaagtctacccttaaaccctcagatcagtctttccaaagagttactctgtttgcattgttgtgattgacatttgtgaagtccaagagaagatctgttttcatgacaagtggaaatagagtttgcaaatt

SEQ ID NO: 1581 - DNA, 290 bp, Homo sapiens
caggagccggcagacctgtcacccgcaggtggggtgagtcttggagcttccagaggggctcaccgaaatcggggttccatcacaagctatgtttaaaaaggaaaattggtatttggcaaacggaacacaacctttgatgagagctttcacagggacactgtctgggggttcagttcaagctccccggcctcttccctgggaacctctgaactcctcctctctctgggctctctgtacaattcacacacgtcagcatctaatcccaagacaaacattccgctgctcgagca

SEQ ID NO: 1582 - DNA, 167 bp, Homo sapiens
ggacaacctcaagggcacctttgccacactgagtgagcttcacttttacaagcttgcacgtggatcctgagaactttaggcttctgggcaacgtgcttggcttgtgtgcttggccatcacttttgcaaagaattcaccccaccagatcaggctttccattttagaag

SEQ ID NO: 1583 - DNA, 165 bp, Homo sapiens
ggttttgtctgagttcaaactagtcccttgttgttacggaagcagccagtttaccagtgtcactctggagtacagcgggagaaacacaaaatagtatacctgaaaacattacattcagacacactccctctgccttccggcttaaagcctgtggatgatccacgt

SEQ ID NO: 1584 - DNA, 302 bp, Homo sapiens
caggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtactcagtattactgaaaaggtaccacattttgatagtagttatcactcttaggtcagacagccatcagatatctccacaccaagtagctgtacgtagtgggggaaac

SEQ ID NO: 1585 - DNA, 155 bp, Homo sapiens
ctcgaaagtaacagattaatttccaattcttactttaagttttatagcatcccatttttctaaagtttcccttcctgtactaaagagtgctatcttgctactcagcagagaaattcagaaactcatttctatcaacaacatactcattaggctca

SEQ ID NO: 1586 - DNA, 213 bp, Homo sapiens
gtcaagctcacagtcaacaaagggttgagtaaccatttccaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggt

SEQ ID NO: 1587 - DNA, 201 bp, Homo sapiens
cggccgcgaaggtggcaagaagaagccactgaaacagcccaagaagcaggccaaggagatggacgaggaagataaggctttcaagcaggaaacaaaaagaggagcagaaagaaactcgaggagctaaaagcgaaggccgccggggaaggggcccttgcaccagggtggaattaagaatctggcaaaagtaagctgcttcct

SEQ ID NO: 1588 - DNA, 202 bp, Homo sapiens
ccacctcctgtgccaatgtcccaccctccacctgggggtggggtgcagcttccacttactgattagaagacaccactgccctcccttcccccctccctgtctgggtgtcctgtgcccccatcgtgtcgtgtcgtatatttggtcgtggtacgtcccctagggggaagggatttttgcccaatartataaaaaccacgtggtc

SEQ ID NO: 1589 - DNA, 317 bp, Homo sapiens
gggaattaggcaaggtttcctacattgttgcatctcagctgaggcttgaaggaggctgatgtagtagaagttggaagaggagtgttttcaggcagttgcaaacgatgtggaaaatttggatgacaaaagagagcaagcagcctgggcaacatagcgggaccccatctctgcaaaacaaacaaacaaaattagccaagtgtggtagcccacaccttgctttaacctgggaggtcgaggcttcagttagccatgattgtcccactgttctccaacctgggtatctcaaaaattttttttaaaaagggcagcatatgtgg

SEQ ID NO: 1590 - DNA, 312 bp, Homo sapiens
ttctcgtgcaatttcggccacgttggggccatgactcacatcgtgcgggaagtcgacaggccgggatccaaggtgaacaagaaggaggtggtggaggctgtgaccattgtagagacaccacccatggtgtttgtgggcattgtgggctacgtggaaacccctcgaggcctccggaccttcaagactgtctttgctgagcacatcagttatgaatgcaagaggcgtttctataagaatttggcataaatctaaggaggaggcctttaccaagtactgcaagaaattgcaggatgaggatggcaagaagcagct

SEQ ID NO: 1591 - DNA, 302 bp, Homo sapiens
aagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaaaaaaaacctggggggtacttgtgggggggccggggcccattggttttccccccggggggggtcccaggtaagtttcccaattcgccctatagt

SEQ ID NO: 1592 - DNA, 331 bp, Homo sapiens
ggaagattacctagacgcatgctttccagacagggcgttttggctgcatcacagccactggctggttcctattcatttccattttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggagagaaaaaagagtcaggcctggtggtgtgcgcctgtaatcccagctactcgggaggctgaggcaggacgattacttgagcttggaaatcaaggttgcagt

SEQ ID NO: 1593 - DNA, 308 bp, Homo sapiens
agaacgtgagcaagcccaggcacagccgacgccgcgggctttgaaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaga

SEQ ID NO: 1594 - DNA, 116 bp, Homo sapiens
ggttccaaagatcttcggcacgagatcttcggattaagttttgacatacttacccccagcttcttgagaacggggtttttcaaaggacgcgttattagggccctcacccatcggca

SEQ ID NO: 1595 - DNA, 433 bp, Homo sapiens
actttggaataagttcttacataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaa

SEQ ID NO: 1596 - DNA, 301 bp, Homo sapiens
ggggggcgggctcccgcggtcctgctcggcggagtggcctctctgctcctgtcttttgtttggatgccggcgctgctgcctgtggcctcccgccttttgttgctaccccgagtcttgctgaccaatggcctctggaagccctccgacccagccctcgccggcctcggattccggctctggctacgttccgggctcggtctctgcagcctttgttacttgccccaacgaggaggtcgccaaggagatcgccaggaccgtggtggagaagcgcctagcagcctgcgtcaacctcatccctcag

SEQ ID NO: 1597 - DNA, 298 bp, Homo sapiens
cagctgccctggctgtgatgagtgtccttgcaggggccggagtaggagcactggggtgggggtggaattggggttactcagatgtaagggattccttgttgttgtgttgagatccagtccaggttgtgatttctgtggatcccagcttggttccaggaattttgtgtgattggccttaaatccagttttcaatcttcgacagcttggcttgaacgtgaactcagtaggttgaacctgtctgacccggtcacggtcttggatcctcagaactctttgctcttgtcggggtgggggttgg

SEQ ID NO: 1598 - DNA, 305 bp, Homo sapiens
catctctcgggacaactggcacaagcgccgcaaaaccgggggcaagagaaagccctaccacaagaagcggaagtatgagttggggcgcccagctgccaacaccaagattggcccccgccgcattccacacagtccgtgtgcggggaggtaacaagaaataccgtgccctgaggttggacgtggggaatttctcctgtgggctcagagtgttgtactcgtaaaacaagggagttctatcgatgtcgtctacaatgcatctaataacgagctggttcgtaccaagaccctgtgaagaattgcatcgt

SEQ ID NO: 1599 - DNA, 195 bp, Homo sapiens
gtttacttaaaaaaattatgtctctctttttaaatttttaatctgttaacataagtggaggaaagaaatcaggcttccagaaagaggtcaacagaagcctttttaagcatatattgtattcccctaagaggtttttgaatcgtgacagtacagaccatacttaatcctctgtaaccccccaggcagggcaggctt

SEQ ID NO: 1600 - DNA, 570 bp, Homo sapiens
  misc_feature 42, 44, 80, 94, 139, 164, 167: n = A,T,C or G
gtttacttaaaaaaattatgtttttttttttaaatttttaancngttaacataagtggaggaaagaaatcaggcttccanaaagaggtcaacanaagccttgttaagcatatattgtattttttaagaggttgttgaancgtgacagtacagaccatacttaanccnctgtaaccccccaggcagggcaggcttgccccttgcaccaggtcctatgcttctgaagcactttgcttgttccacagaaccattagacccatactcagagtatgaagcagaaatcacaatcgaaattgtccctgaggctccctaaatctctcacaaaaaacagctaatccgtattccaatttacccggtcctatatgtatgtatgtgtaatgtgtatgtagaaattaataatgcctgaagtaggtggtttgagtttggaggctttgttatatgaaaaatttgtacctttaaacagtagcatccagctcagtgcagagaaatgagaagcgtaaagaaccagtgcctgactgtaggagggtacaaggcccggggcttcaatccaagtgtactcgggtgtgcatgc

SEQ ID NO: 1601 - DNA, 202 bp, Homo sapiens
ttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtc

SEQ ID NO: 1602 - DNA, 299 bp, Homo sapiens
gcgtgcttatgctcctgtactcttcagagaagaaaatcttcattggcctcatcccccatgaccagggcaactttgtcaacggcatccggcgtgtcattgccaaccagcagcaggtcctgcaggcggaacctggagcaggagcaacagcaacgagggatgggggggtagtggttaccccgggctgggccctccaggagtcacagatgaggcccccgcagagatctggtgaacaggcttcttagcaggggcccctgggacttcaactgcccagcaacatggaggatggtgtcctgaggcct

SEQ ID NO: 1603 - DNA, 299 bp, Homo sapiens
tgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctttgttcattgtggacaaagttattattttgcaacatctaaagctctttacgaatggggtgacaacttatgataaaactagagctagtgaattagcctatttgtaaatacctttgttat

SEQ ID NO: 1604 - DNA, 148 bp, Homo sapiens
cgcagcttggccccctcttcagcccagcagttctccgcagcgttttgccgcgtgactgctggcagacgaaagggctttaaccgcggcttaccttagccctttttaccctggcctagtttcgcaagcatccgctgaggccgccagcccc

SEQ ID NO: 1605 - DNA, 580 bp, Homo sapiens
cgcagctcgagccctcctccagcccagcagtgctcccgcagcgtctggccgctggtcgtcggcagacgaaagggcttgaaccgcggctgaccttagcctttgtccctcggcctagttccgcagctgccgtcgaggccgccagcccctcccccagcatgtttgggctaagccgcctcctttccgcctgcgttggagagagaggtaccagaaggaatgaaaggactggggcttgtctccatggcaactgaaagaggtgggttataaatccttcgccaccctcctgtggcgaaggaggggaagtgggagccgggaagtagagttggcttttgcaggagagtctggagcccctttctgggtgatgcattgggggccatagaaggatttggctgccgctttggagcatggattttttttttaaacatcttcctttctcttttggagagaaaaattggtcacctccaaggactgagaacctgacccttccaaggcaatccccaactaccaaaaggctggccaaagcccgggaagggatcccaatcccgttcctggaactcctgagggtcaacttccctcaactccg

SEQ ID NO: 1606 - DNA, 295 bp, Homo sapiens
gcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccct

SEQ ID NO: 1607 - DNA, 293 bp, Homo sapiens
taaagtggccacatttaagaaggccaagctttgtagtggttgcacagtcacactgatatgctgatttgctctttctcattgtatgtctatgctttgtcatcagtgctatagtaaattacaaagaaataggtagattgtatgagcatacccacaaatgcctatgatttaggttaccaatgtattctttctcatttggggttttgcttctgtctgtctgtttattggaaacttgtacttcaagtagggggaatcctaattctaataactccttagctaagttttattattcaggc

SEQ ID NO: 1608 - DNA, 294 bp, Homo sapiens
ggtttggtctgggagtcagcaggcatggagtttagttccgttgtattagtcgaaggtcttcaacaaatcatgttagccgtttgagccttggcttccatttataagagagggttgaacaacattccagctctgccagtcttacatacccagagcccttcctcagccggggagtctcctagtgggacattgtccttaagccagccttggttttgctctgcgtaggttttgtgctttgtgacaggtcattcaggcaatgactgcatacctagactaggtgttgtcaggggaaaggag

SEQ ID NO: 1609 - DNA, 297 bp, Homo sapiens
ctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagatttcctttacctaaaaaactacagtgcagtgccttttcccatgccttgtctacaggtgccagtgacaagggacaaagcagcacacataccataaatgcttatcatttagatcccaggggcccaaaa

SEQ ID NO: 1610 - DNA, 620 bp, Homo sapiens
ctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagacacttatgaagagaccacatctgctctgaatttttcaacagccaagcaaagaatttagggatgcctgtgcatgcagcttacaacagtgaactcagcaaaagcactgaaagtgacgctggctctgccttgttacagccccctcttgacagcataccgtgtgtcacttcttctctctgaatcagagatgtagctgccccgatgcctacaaacacttgactatgggccacactcctgcagcagatgggggactgctt

SEQ ID NO: 1611 - DNA, 298 bp, Homo sapiens
ctcgtgccgaattcggcacgaggcttcgggagccgcgacttatggtgcagacatggccaagtccaagaaccacaccacacacaacgagtcccgaaaatggcacagaagctggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaa

SEQ ID NO: 1612 - DNA, 284 bp, Homo sapiens
ctggagggtctcgtctgaggacgggaggaggctctcgctggacgtctggcctgtgcgctggtggacggatgcctacgtggttttggaggacccgatgaccaggcgtcctgcgagtccgcccgctggcctgcagcacccacctcggacttggctgtggacggttggtgcaagtgcatcctgcaggctggctgtgcgcagtgtgggctgacctttgcagagttttgtggagtagtttgcaatgtcataaaagtgcaataaaggtacagcagatgtgaaaaaaaaaa

SEQ ID NO: 1613 - DNA, 297 bp, Homo sapiens
caggtttcagcatctgccattagatttgagacacatatttgagtccatgaaacacctatcaagggaggctttgataatatcagtgtaattaaaatgggtatcaggtcccctctattcctcttgagtttgttaatacttttcttcctagataattacagttgcacagtttttcaggcttattggtataaagttgctcaaagtactcatgatttctaagtttcatatagctctcgttctcttttacttaatcctaatcggttttgacccgttctattccgtcctattttatctcattca

SEQ ID NO: 1614 - DNA, 517 bp, Homo sapiens
caattttcagcatctgccattagatttgagacacatatttgagtccatgaaacacctatcaagggaggctttgataatatcagtgtaattaaaatgggtatcaatttttttctatttttcttgagtttgttaatacttttcttcctagataattacagttgcacaatttttcaggtttattggtataaaattgctcaaagtactcatgatttctaaatttcatatatttttgttctcttttacttaatcctaatcgtttttgaccctttctattccttcctattttatctcattcatttgtatttctgtctttatttctgttcttatagtttccttacatttatctagctgtttgttaagagacagagtcttgctctgtcacccaggttggagtatggtgatgctatcacaactcattgcagcctcaacctcacagctgagctcaagtgatcctcccacctcaacctcagtagtagttggaactacaggtgcaggcagcatacctagctaattaaaa

SEQ ID NO: 1615 - DNA, 294 bp, Homo sapiens
ccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggacccggtgtgagcaggatggggccctgcctcccgtgggagttgtggactcgagcccaggggctgcccgtcacagcggtgtcccaggtccctgccatccgattttacctgggatgtcttctctggagtttggaattgctttagg

SEQ ID NO: 1616 - DNA, 296 bp, Homo sapiens
ggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaaca

SEQ ID NO: 1617 - DNA, 297 bp, Homo sapiens
ccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggttgcttttggaaacatgtgtcgt

SEQ ID NO: 1618 - DNA, 175 bp, Homo sapiens
cggcacgagacttcttttctctcttatttattaaccatggtctgagagttgtttttgttctatgtaacagtattgccacaaaactataggcaaatcgtgtttgcagggagatttctgtatgcctcttttggggtgttttttaagttaaaggtgtgccacattttaagagaggcca

SEQ ID NO: 1619 - DNA, 119 bp, Homo sapiens
cttgcggcatccacgagaccaccttcaactccatcatgaagtgtgacgtggacatcccgcaaagacctgtacggcaacaggtctttcgggcggcaccacattttattccggcatttccc

SEQ ID NO: 1620 - DNA, 153 bp, Homo sapiens
aggagatggtggtcacggagcatgtcagtgacaaggaggcccttgggtccttcatctaccacctgtgcaacgggaaagacaacctaccggcttccggcggccgggcaacggggaggcggatcaacaagcttggggccaaggacttccaattcc

SEQ ID NO: 1621 - DNA, 149 bp, Homo sapiens
cgggaagggcctgtcccagtcggctttaccctatcgacgcagcgtccccactttggttgaaggttgacatcttacgacgtgaaggagcagatttacaaacttggccaaggagggccttacttccttcaaaaggtcggtttaattcttag

SEQ ID NO: 1622 - DNA, 166 bp, Homo sapiens
cgaagatggcggaggtgcaggtcctggtgcttgatggtcgaggccatctcctgggccgcctggcgcattcggtggctaaacaggtacttcttggcccgaaggttggtggtcgtacgcttttaaggcattaacatttcttggcaatttcttcaggaacaggttaagg

SEQ ID NO: 1623 - DNA, 109 bp, Homo sapiens
aagaaaatgaggaacagaataatcaagaatgaagttaagaagcttcaaaaggcagctcttctgaaagcttcttccaaaaaagcaccttggtacttaaggggtacttctg

SEQ ID NO: 1624 - DNA, 132 bp, Homo sapiens
agctcctgagggaagctgggcctgagctcagttctgagtaccgggcccttggggcttgctgtacaacttgcttccgggaacaaggaggcccgttgcgagagaaccttcttggcccttgaagccgttcgttgc

SEQ ID NO: 1625 - DNA, 114 bp, Homo sapiens
gcctcctgcactgccacccagagcttctctaccttccggtagccctagacttggggtcaggggaaggtagaactggagcttttacaggaataaaacccaagagtttcattatta

SEQ ID NO: 1626 - DNA, 139 bp, Homo sapiens
gaccaatttaagaacttcatatacatggaatcatatagtgatttgtccttttgtgaatggtttatttcacttactgtaatgtcttcaaggttcatccatgttgtagcatgcgtcagaattttctttctttttaaagcag

SEQ ID NO: 1627 - DNA, 319 bp, Homo sapiens
cggcacgagctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttgggtttctactgttatgt

SEQ ID NO: 1628 - DNA, 298 bp, Homo sapiens
gctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgta

SEQ ID NO: 1629 - DNA, 318 bp, Homo sapiens
ctggatcctttgagtcaatcctccttattttagtaacccgtttacttgagtgccagaggttcttgatactgttgatttcttgagaattccaaggtgtgcatctagttggttctcaattttctctagtgtgggttggagattttgctttctggggcctgctaagtctgttaccattcttccatctgcttgcaaacatcgtggtctgctctcctgttatttgtgtgtgtgcacgtatgtgtgtgcatgtgtgtggttggatgtatgtctgtgcatatgtgtgtgtgtgtgtgaatctgtttactatcattctggtggact

SEQ ID NO: 1630 - DNA, 154 bp, Homo sapiens
cacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 1631 - DNA, 313 bp, Homo sapiens
gtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgttccctccataccacccctcttctaggatagcgctcccttacccagtcacttcttggggtcacttggatgcctcttgcagggtcttgctttctttgacct

SEQ ID NO: 1632 - DNA, 314 bp, Homo sapiens
tccgtttgtcccctcagattcactcttcacttagggtggaggtcatctgtgcaatgaaggaactgcttgatcttgcttcactgtacagttgggaacccgtaagaaaagacagatctaaagatagatgttaaaatagccaggatagagtgttgccaggactgccctggaggagacgactatacgctgaaagcttattggaccttgcaggtccatgctggcaaaagcctgggcagcaggagtgggagtcggtccaaggcggtggacccaggagcaaaataaaggtcttgattggacttaattcattgacatgagat

SEQ ID NO: 1633 - DNA, 613 bp, Homo sapiens
tccgtttgtcccctcagattcactcttcacttagggtggaggtcatctgtgcaatgaaggaactgcttgatcttgcttcactgtacagttgggaacccgtaagaaaagacagatctaaagatagatgttaaaatagccaggatagagtgttgccaggactgccctggaggagacgactatacgctgaaagcttatgggaccttgcaggtccatgctggcaaaagcctgggcagcaggagtgggagtcggtccaaggcggtggaccaaggagcaaaataaaggtcttgattggactgaattcattgacatgagagtgctctctatggatttgggttccaagtgttgggttgaccacctgctagtggtgttgatattctggccttatcatggctccagataatgaggtcagaatgctaaaatgtccttgcacactgccgagggagggaggaaggagttggaatgcataaggacaggcatggtggtatggagctatgatgtgcagtctgctcagcatccctaatcttgcctgctgggagaagcagagctcacacttttcatcacagcattggcaagggaggcgccagcgtctttgaagagccctgtgcatggctgt

SEQ ID NO: 1634 - DNA, 294 bp, Homo sapiens
acatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgttgcaggtgaccattggcacacgctagagtttatggcagagctttacaaattaaaaaaaacctggca

SEQ ID NO: 1635 - DNA, 303 bp, Homo sapiens
ccacagcgctccgcccccatcctgcagcgccgacttcctgcacctgggggatctgccaggagagcccagcaagatgacagcctcgtccagcaacccagacctgctgggaggatgggctgcctggaccgagactgcagcgtcggcagtggcccccacgccagccacagaaggctcaccagctggattccctcctggggggcttcattccaaaacggccaccacgccaaaggcagcagctcctggcagaaagtcggccgccagcccaggcgcctatggcccataggccaagccgcccccaaagct

SEQ ID NO: 1636 - DNA, 318 bp, Homo sapiens
attttttagctttttgactagcatatgggccaggcgcagtggctcatgccgataatcccagactttagggagccaaggctggaggatcacttgaggccaggaggtcaggaccagcctaggcaacatagcgagactccacccccacctcttgtgtataaaaaaaaatttgccaggtgtggtggtgcacacatctagtcctagctactcaggggcctgaggccgaagatctcttgagcccaagagttggagttccagtagctatattggtgcctacactccagcctaggcaacctaccaacagagtagacctcttttcga

SEQ ID NO: 1637 - DNA, 224 bp, Homo sapiens
cggcacgagcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccaccctttgagagccatgtgggctgggtgatggattcccgtagcacaggccccgtactg

SEQ ID NO: 1638 - DNA, 230 bp, Homo sapiens
gttggtgccccagaccaggaattcggcttcgacgttggccctgtctgcttcctgtaaactccctccatcccaacctggctccctcccacccaaccaactttccccccaacccgggaaaaaagaaaaggaaacccaaacttgaacccccttaaaaggcaaaaaatgggagacaatttcacatggactttggaaaatatttttttcctttgcattcatctctcaaacttagt

SEQ ID NO: 1639 - DNA, 199 bp, Homo sapiens
ctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaacc

SEQ ID NO: 1640 - DNA, 292 bp, Homo sapiens
ctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtggagagccacaggtagctggaaaagatactcccagctgacagggtgataaaaggcagggaagaattgggcctgtgctgatccaggaaggttttattgtttgcttgttttttgtatttactcgtgact

SEQ ID NO: 1641 - DNA, 130 bp, Homo sapiens
gccatgcttggggttaaaatttcaacatgggttccagaggagacaaactatattcaagccacagcaatatgccaactgagagaagatataagtacagacagattcagagtataacacagagctcggagat

SEQ ID NO: 1642 - DNA, 219 bp, Homo sapiens
tggagatgaagatgaggaagctgagtcagctacgggcaagcgggcagctgaagatgatgaggatgacgatgtcgataccaagaagcagaagacccacgaggattactagacagcaaaaaaggaaaagttaaactaaaaaaaaaaaggccgccgtgcacctattcaccctccacttcccgttctcaaaatctaaacgtggtcaccctcgagatagagagg

SEQ ID NO: 1643 - DNA, 185 bp, Homo sapiens
aagcattcaagagccaggcactacattagagtctgagaatacagcagtgaacaaaatacaattttaagtcttcattttttaaaaaagttattataagccaggagcagtggctcatgccctataatcccagcactttgggagaccgaggcaggcagatcacgaggtcaggagatcgagaccatcct

SEQ ID NO: 1644 - DNA, 196 bp, Homo sapiens
actcgtgccgaattcggcacgagctagggaccactgtctttaggagtttaatgagggcaaggaattgggtagtaggagacagggcagcaatagtgattaaacttttggtactaattggttgcaaatatgcatttgggggttaggaggccacttgttttggacgttgagctttgtagttggaacgattggacgttcc

SEQ ID NO: 1645 - DNA, 580 bp, Homo sapiens
ctcgtgccgaattcggcacgagctagggaccactgtctttaggagtttaatgagggcaaggaatggggtagtaggagacagggcagcaatagtgattaaacttttggtactaatgggttgcaaatatgcattgggggtgaggaggccactggtgttggacgtggagctttgtagttggaacgatggacgtgccctttgtgtgggggtcatgcagtcacgtgctcggtggctttcatgcagtgtcttcgtagggtggggagggatggcaggcattcagttggtggcaggttgtgttgggtcctttccaagctttgcttcattcaggctttaagcaggacctggcccgtgaggcacttggtgcagagtgagaacacctcggctgtccctgggaactgcagggacagagggtgtgtggcaagggtgacaagcggagaagcagctgtgggggctggcgagagcctctgtgccccagagtggaggaggaaagaagcgatgctcgaggtttgagtggagctgtgtgtgagaaagggccccttggtgctcactggacaggaagctgctgctgggcaatgctgtgctg

SEQ ID NO: 1646 - DNA, 192 bp, Homo sapiens
ctaggtcgcggcgacatggccaaacgtaccaagaagtcgggatcgtcggtaaatacgggacccgctatggggcctccctccggaaaatggtgaagraaattgaaatcagccaagcacgcaagtacaatttctctttctgttgcaaaaccaagatgaagacacgagctgttgggatcttgcactgtgtgttcc

SEQ ID NO: 1647 - DNA, 253 bp, Homo sapiens
cttttggaaggtctctgataatttaggggtgctggaaaccagcactgtgttatccccaatccctcctgtgccaccagttttgtgatttaggttgctttagtgggttactaacttttgttcaattaaaccagggtttgttttgggtttttttctttgctacttacatatttaaaggtacaagtttcttatttcaaatctctactgatagtgcccctatggggagatgctggaacacatatttgcaaatagtgac

SEQ ID NO: 1648 - DNA, 166 bp, Homo sapiens
caggactgggtcaacaggcccaagaccgtgcgcggcacgctgctggcgctgcaccagcacggccactcgggggcccttcgggagcaagtttaagaaggagccggccctgacttccagttgcaagaacagcaaggaaaaggaagccctctccagaacccagaagggt

SEQ ID NO: 1649 - DNA, 198 bp, Homo sapiens
cttggagagagcacccttggggcctccgtgtcggggtacacccagcacttttgcgacctgcggcccagcaggcgcggaggattggcggggaaggaagccagcagcccctgtcgtttaactgtcgtaagaaaggtcttgtgttttggttttggggtttttgttttgtttgtgttttgtttggcttgtttgtttttaaag

SEQ ID NO: 1650 - DNA, 342 bp, Homo sapiens
ccagcgtggtctgtttcatctggtgctcctgacaaaacccttcccagggcaaggactctctgagtccccccagagcctggcaagggaggtggtcttggccctaccctgacaccaaaaattatcttggagaacctctgccattccctggtgtgctgagagattctgaactggaacgtcttgtccatccaacataggcacgtcccagttcccccgtggagccacctacatatacagttccacacgggagcgtgcacggtgtgcggggcaccttgccaggctttgaaatgagcaggacccagcccctgactctcaggagtcctgttctaatagaggggtcgaggc

SEQ ID NO: 1651 - DNA, 601 bp, Homo sapiens
ccagcgtggtctgtttcatctggtgctcctgacaaaacccttcccagggcaaggactctctgagtccccccagagcctggcaagggaggtggtcttggccctaccctgacaacaaaaattatcttggagaacctctgccattccctggtgtgctgagaaattctgaactggaacgtcttgtccatccaacataggcacgtcccagttcccccgtggagccaccttcatattcagttccacaagggagcgtgcacggtgtgcggggcaccttgccaggctttgaaatgagcaggacccagcccctgactctcaggagtcctgttctaatagaagggtcgaggcaaacgcattctccagagaaggacaacgccaggcaaggggagaaaaaaaaatgccagcgagacacttttaaaagagggaaagtctgcatgtgcaaaaccattctttgaaatgatgcatttggttatgtgcatatttgttatgcatttgggtatgtgcatatttgttaatcctagctccgtgatttttaagtgtcctaaaccacagattttttttccaaataaaatctttcctgaaaacccccagtgtgtgtacagacatg

SEQ ID NO: 1652 - DNA, 241 bp, Homo sapiens
cctgtgcccttcagccctttcacctaacaggcccatattcgggcctttgcctgaccaaagagaagaaccgtatgttccctttactgcacggcctttatcctcctgggcccctggggcggggacctgagctggctgtttcctgctttgcctgcacattgtcctccttcctccaactcctcagggcctctctgtatctgtgcctggccagtggcagcactagcagtggtatgagcttatgcca

SEQ ID NO: 1653 - DNA, 244 bp, Homo sapiens
acctgacggtgcaactgcacagacatcagcagatggttcccaggctcagaatctggagtcccggacaataattcggggcaagaggacccgcaagattaataaccttgaatgttgaagagaccagcagtggggatcagaggcgggccccactggctgcagggacctggagtctgcaccagttccagtgaccactcagaacccacctggcgcacccccattgtgctctggcagacgcattggcttg

SEQ ID NO: 1654 - DNA, 219 bp, Homo sapiens
atttaaagctctgttgattttgtttccgtttggatttttgggggaggggagcactgtgtttatgctggaatatgaagtctgagaccttccggtgctgggaacacacaagagttgttgaaagttgcaaggcagactccgcatgtctctaatgctttgtatcattctggagcaatcgctcggtccgtggacactaaacagtattatcagagaaaaactcgt

SEQ ID NO: 1655 - DNA, 152 bp, Homo sapiens
ggactaccccgatgcatacaccacatgaaacatcctatcatctgtaggctcattcattttctctaacagcaggtaatattaattaattttccatgatttgaggaaggccttcgcttcgaggcgaaaaggtcctattagtagaggaaccctcc

SEQ ID NO: 1656 - DNA, 194 bp, Homo sapiens
ttgacctccatgtaactgatttgtgtctagtttctttccttcttctttaaaaacaccagaagggcccttctctttttattgtccctgtaccttctctagctggttgaattgtttgcttgtccaaacttagttttaatttttcccttaaacctgttcaggccaattgtgctcctaataggaattccaataattaa

SEQ ID NO: 1657 - DNA, 625 bp, Homo sapiens
ttgacctccatgtaactgatttgtgtctagtttctttccttcttctttaaaacaccagaaggcccttctcttttatgtcctgtacttctctagctggttgaattgtttgcttgtccaaacttagttttattttttccttaacctgttcaggccatttgtgcttcttattagaatttcattatttaatattgtgaaaaccagtaaaagatgagtacaaataaaaagagtccttgtatccttaaagtctaagttacatgtctcggaagaaatgtgaatcacttaaagacattgtaaaagttcggcgaaaatgaaagatgtagtttaattctgcactcaaatttcttcacatgggtgctttaagtttaaaaactctgaaacatgaaatcaagaaaacaagaaactcctatcaaagaggaggctatgatctctcatccaaagcttggctaactgatgaatattttatattttgagctaaaataaaatgcttaggatatgaatgcatacttcaattttctggatttcctaaccaataaatttccctggtttggattaatctgatcccctttggaggtcagggtaaagaaagggttgccaacaagaagtggtagaataatgggtccaatgt

SEQ ID NO: 1658 - DNA, 144 bp, Homo sapiens
gtcgtttagatcagggtaaggcagtcaggcgggtgttcaccactgccttttcttcctctgagcgtgagaacactgaacccagccactgcccctgggttcctgttctgggaatggtctaataaattcctttcccttcttaagcta

SEQ ID NO: 1659 - DNA, 294 bp, Homo sapiens
cagatgtgagattctgatgtggaactctgggtggattgtgtgcgtgggtgtgcatggcacacacacacatgcacgtaagacggaggaaaaaacaaacagaaaggtgagcaaggtgactgaattttgagctctccagggtgcttctgagatgtggggcttgcacacgctgttgctatagtacgtgttgatcctgactgctgtcatggcgtgccctctggagaaggcccggatgtgatggtgtcaccttccacaagtactcgggcaaagagggtgacaagttcaagctcaacaagt

SEQ ID NO: 1660 - DNA, 296 bp, Homo sapiens
gtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacggcaacaccatcgtgtgcaacagcaaggacggcggggcctgggggaccgagcagcgggaggctgtctttccctttccagcctggaagtgttgcagaggtgtgcatcaccttcgaccaggccaacctgaccgtcaagct

SEQ ID NO: 1661 - DNA, 181 bp, Homo sapiens
ttaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgat

SEQ ID NO: 1662 - DNA, 160 bp, Homo sapiens
atttgtattttataagaatttgtatttattcactcatttattttccaacttgcttattccagtccagggttgagggtggccacagcccatcccagcagctctgcaagctgcaaggtaggaatcgaccttgaacaggacaccattccattgcagggtgcac

SEQ ID NO: 1663 - DNA, 148 bp, Homo sapiens
tgaagctttatacctttcagatgacactaaaggaacaattttcctagacaaacttgggtataatttggggtaatctcttgcatgggcaggcaccctgttaccttcatttgcatttacacaattccttttaattctggtattaatgtaa

SEQ ID NO: 1664 - DNA, 480 bp, Homo sapiens
tgaagctttatacctttcagatgacactaaaggaacaattttcctagacaaactgggtataatttgggtaatctctgcatggcaggcacctgtaccttcatttgcatttacacaattcctttttaatctggtaattatgtaaatagcagacaagatttttgacatctcactttcttattctgctttggaaaatgactagacattacattgcaggcaatttgctattttaacatgcacaaaagatggattcatttaagcaaaaatagagtgaataactgcatttctgctctccaaaatgcaccatgtatttttgttcaattgtataagtccacaggatttatataactggaggagtctgttcaaaactccagctcgagagtacttctagagcggccgcgggcccatcgattttccacccgggtggggtacaggtaagtgtacccaattcgccctatagtgagtcgtattacaattcactgg

SEQ ID NO: 1665 - DNA, 162 bp, Homo sapiens
cggcacgagcaaacacattgtgaatattagattgctgaattaaggatcatagtcgggcatacttatctatatccatacctctatatccttaaattaatgtgaggactgttcttaatggggaggcctcctttgcaaccattattaattgtaatttaggattga

SEQ ID NO: 1666 - DNA, 201 bp, Homo sapiens
gggtgagctctgcccggctgcagggatggcggggaggggtaagctcatcgcagtgatcggagacgaggacaaggtgactggtttcctgctgggcggcataggggagcttaacaagaaccgccatcccaatttcctggtggtggagaaggatacaaccatcaatgagatcgaagacaattcccggcaatttctaaaccggga

SEQ ID NO: 1667 - DNA, 241 bp, Homo sapiens
cgcgatacagttaggatggctgtagtacctctgctgttgttggggggtttgtggagcgctgtgggagcgtccagcctgggtgtcgttacttgcggctccgtggtgaagctactcaatacgcgccacaacgtcccgactgcactcacagacgtcgctatgggtcaagtagttggcagcagttagttacaagtgtacctctgtggatgacagcaacagttacttgaggataccggggaagagt

SEQ ID NO: 1668 - DNA, 200 bp, Homo sapiens
ctgtgccgaattcggcacgaggggaagacaatcattgaatacaaaacaaataagccaatcacgcctgcccttccttggatattgcacctttggacaatggtggtcctgaccaggatttctttgtggacattggcccagtctggttcaaataatgacctcaattctaattaaaaggaaagaatttgaaaaacctttctctt

SEQ ID NO: 1669 - DNA, 199 bp, Homo sapiens
cgacgttcgggcaccccccgaatggacaatctttccttctgtcaacggcaggggcaggcctagtttgactctgacagtcctcccactaaggaattcctggtgacttggaagggggaagtgactcaaggccctcaacctctagcaaggtaagggtgctaacctctgggtgggcaatgccaagttctcaagtgggcccagc

SEQ ID NO: 1670 - DNA, 215 bp, Homo sapiens
ttttggagttagaaaaggtccacgaactgtgcgataacttctgccaccgatacattagctgtttgaaggggaaaatgcccatcgacctcgtcattgatgaaagagacggcagctccaagtcagatcatgaggaactttcaggctcctccacaaatctcgctgaccatgtaagtctgctagcctttagcaatctctttaaggccacttggcacaag

SEQ ID NO: 1671 - DNA, 182 bp, Homo sapiens
ctcgtgccgaattcggcacgaggttatgttgcccttggacagatctttgagaatctcatacatctgtgaaaaagataatgtgaattaaacagtaaaaaaaaaaggtatgttgatggcagtaagagtaatcatgtcttaaaacgtgaaggttttttttcctttagttttgctcttgatagctg

SEQ ID NO: 1672 - DNA, 268 bp, Homo sapiens
gaacagggtgccaccggcctgcctggtgtcagggccctcgggtagagcaccgacagatcagcacattaagcaggtttgcatgagagtcatacaagaacattttgctgagatggctgccagtcttaagcgtccagactcaggtgccactgggctccctggaagccttggccctcctggtcccccgggccctcctggagaaaatggtttccaggccaattgggaatgcgtggccttccgggaattaaggggcccctggtgctctgggttt

SEQ ID NO: 1673 - DNA, 150 bp, Homo sapiens
ctagagtccatatcaacaatagggtttacgacctcgatgttggatcaggacattccgatggtgcagccgctattaaaggttcgtttgttcaacggttaaagtcctacgggatctgaggtcagaccggagtaattcaggtcgggttctatc

SEQ ID NO: 1674 - DNA, 188 bp, Homo sapiens
cagccagcctcgaaatgcagaacgacgccggcgagttcgtggacctgtacgtgccgcggaaatgctccgctagcaatcgcatcatcggtgccaaggaccacgcatccatccagatgaacgttgccgaggttgacaaggtcacaggcaggtttaatgtgccagtttaaaacttatgctatctctcgggg

SEQ ID NO: 1675 - DNA, 158 bp, Homo sapiens
ggtcagagagctgggtgggaagatgcactcatcttcccttatttgatctaacatttcttgtagtaatggcttctcattctcttcctctgtttggctaacatgcctttggaatgttgagcactaaggtgaggtgcttttcacttttcatcccatttttt

SEQ ID NO: 1676 - DNA, 619 bp, Homo sapiens
ggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactgggtgagaatctgaccagggagtttttgtacctcacattccaatgatgcagggattgagcctctctgttggactctttctcggctgcttttaagttctaagtgtgatggcttgggcaagggtatttgctgatgattgtatttgctttgagtgttgggctgtccttcccttaaccctggtcttgggctttgagttactcagttaaacccaattttgatctgaagcgactgaaagcaaggtcctgggcaag

SEQ ID NO: 1677 - DNA, 150 bp, Homo sapiens
cgacagtagcgctgtcgcggagagaggtcgcgtggctaagagcctaagtggtggttccgagataaggcgctatcctaatcccgtttgggttcctacacacacaaggctctcgggcccttgttgtcctaaccttttacacatcacatacac

SEQ ID NO: 1678 - DNA, 385 bp, Homo sapiens
gccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaaaaaaaaaaa

SEQ ID NO: 1679 - DNA, 232 bp, Homo sapiens
gacgatttattggacatgatataggtcgtggatgtatgggggaatctaagagagctgccatcgctttgatgctgggagttctaacaaaacaagttggatgcggccattcaaggggaagccaaaatctcaagaaattccagcaggttacctggaggcggatcatctaattctctgtggagtgattacacacatatatattacaagggataatttagacccatacaagtttata

SEQ ID NO: 1680 - DNA, 300 bp, Homo sapiens
gctggggaaggtgaacagtgtggcccgccatgttcttctccgcggcgctccgggccccgggcgggctgggcctcaccgcccactggggaggacatgtaaggaatttgcataaagacagctatgcaaaatggagctgggggagctttatttgtgcacagagatactcctgagaataaccctgatactccatttgatttcacaccagaaaactataaggggatagaggcaattgtaaaaaactatccagaaggcataaagcagcagctgttcttccagtcctggatttagccaaaggcagat

SEQ ID NO: 1681 - DNA, 317 bp, Homo sapiens
cgaacgggagagcacgccatgaaggcctcgggcacgctacgagagtacaaggtagttgggtcgctgccttcccacccccaaatgccacacggcgcccctctaccgcatgcgaatctttgcgcctaatcatgtcgtcgcaagtcccgcttctggtactttgtatctcagtaaagaagatgaagaagtcttcaggggagatttgctacttttggcaggttttttagaagtcccccttccggtgaagacttcgggatcttgctcgtattactccgagcggcaccacaacagttaccgggataccggacctacacgcagcg

SEQ ID NO: 1682 - DNA, 180 bp, Homo sapiens
ctatccacctttgggtcgctttgctgttcgtgatatgagtacagacagtttgcggtggggtgtcatcaaagcagtggacaagaaggctgtttggagcttggcaaggtcaccaagtctgcccagaaagttcagaaggctgaatggatattatgcctaattacctgccaccccactcttatc

SEQ ID NO: 1683 - DNA, 285 bp, Homo sapiens
  misc_feature 37: n = A,T,C or G
ctcgtccattttgggcggaaaaagggctatggcaagnatgctgctggcattgcaatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaattaagccgtggmccagctggtcaagttcaacagagccttgctgcaccattctatggctcagacacct

SEQ ID NO: 1684 - DNA, 310 bp, Homo sapiens
catgtgtgtgtgtacactgggatatgattcagccataaagaggaatgagctccaacccatgctaccatgtggatgaaccttgaaaatatgacggtgagtgaattaagccagacacacaaggttgtgtggtgtgtaattccatttataccaaatatccaaaatgtggctacagcagaatgtcgatagatctatagagacagaagcagatggaggttccgcagagcttgggggaagggaaggaattaggagtaattacttagtgggtaggaggttcctttgggggtaatgagacattctggactagataagg

SEQ ID NO: 1685 - DNA, 416 bp, Homo sapiens
catgtgtgtgtgtacactgggatatgattcagccataaagaggaatgagctccaacccatgctaccatgtggatgaaccttgaaaatatgacgctgagtgaatgaagccagacacacaaggttgtgtggtgtgtaattccatttataccaaatatccaaaatgtggctacagccagaatgtcgatagatctatagagacagaaagcagatggaggttcgccagaggctgggggaagggaaggaatgaggagtaattacttagtgggtaggaggtttcctttgggggtgatgagaacattctggaactagatagaggtgactgcaccactgtgattgtcccagatgccccaatggaaaagtgtatttagtctatcttgccacatagaaataaattttccaaaaaaaaaaaaaaaaaa

SEQ ID NO: 1686 - DNA, 310 bp, Homo sapiens
cactagtggatccaaagaattcggcacgagctgccgccaaggtgctcggtccttccgaggaagctaaggctgcgttggggtgaggccctcacttcatccggcgactagcaccgcgtcccggcagcgcagcccttacaatcgcccgcgccatggcctctgtctccgagctcgcctgcatctactcggccctcattctgcacgacgatgaggtgacagtcacggggggtaagatcaatgccctcattaaagcagccggtgtaaattttgagcctttttggcctggcttgtttcaaagccctggccaacgtca

SEQ ID NO: 1687 - DNA, 310 bp, Homo sapiens
aaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaaggctcttgttgctaaagtggtgtaatctgttacacagatgaatagctagatgtggaagggatatgtaaccaggaacccttgggtattgtttctaaggaaatatgggacagccatggtaggcaacttaggtctgtactgcattgt

SEQ ID NO: 1688 - DNA, 106 bp, Homo sapiens
cagatgctaaaagacatcaagaaggagaaagtgctgctgcggaggaagtcggagctgccccaggacgggtacaccatcaaggcacttgaggcgcacaagcgggcgg

SEQ ID NO: 1689 - DNA, 210 bp, Homo sapiens
ctcgtccaatttcggcaggggggccgagtggagactcgtgttctcaaacccggtatggtggtcacctttgctccagtcatacgttacaacggagtaaaatctgtcgaaatgcaccatgaagctttgagtgaagctcttcctggggccaatgtgggcttcaatgtcaagaatgtgtctctcaaggatgttcgtcgtggcaacgttgctggt

SEQ ID NO: 1690 - DNA, 247 bp, Homo sapiens
gttgactgtaacatggagacatctacagaagagaaggaaacttaccccgagatacagtggaggtatgtgaatctccttttccaagtcaaccttcggtaaataaacatgtaacagtgcatccatattttaaatttatcacaacctttttcataactgatttccccatttactcctctttttactaaaggatgtgcatttgatcattccaatggtaaactctttagggatagtgacttgctgtcttgtg

SEQ ID NO: 1691 - DNA, 217 bp, Homo sapiens
cccacagctgggtcagcctggaaaatccatctattagggactttttggcagccagattggcagcattagcccattaggtctcatcccgagttccaagtctttggctgcaaatgagcctcagttcgccttactggagagcacccccagattcctgggcacagttcatttccagcctttctagatctgatcttttaggggggaagacagcttaaaatgt

SEQ ID NO: 1692 - DNA, 262 bp, Homo sapiens
cgtagatgatgtctgtaacgtagttttgtttgaaatatgagaatatgcggcttaaactttgatctgtaaggagcggggccgtggcgttttggagcacgctgtagacaccgttcctcatgctgccgggtgggttttgcagaggctcccttagtgatttcatgtttaccaggcagcatccattttcagattttcctggcattgatttatattttgagcatccaggaaactcctcgtttcctcgtttagccccaccagatcaggt

SEQ ID NO: 1693 - DNA, 200 bp, Homo sapiens
cggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccccttggccgcggagggccggaagccgcgcct

SEQ ID NO: 1694 - DNA, 226 bp, Homo sapiens
tggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctctagtactgtgttatata

SEQ ID NO: 1695 - DNA, 104 bp, Homo sapiens
gtcctctagctcttatctctgtctcttactcttttctctttctctttttctctgtcatgagactgtgtgtgacagggccacctgtctttttttttttcttaaat

SEQ ID NO: 1696 - DNA, 253 bp, Homo sapiens
cggcacgagggaaaatcaaatgaggcagtaaagtaagagcaacctgggcagtgggtgcagaagctcaactgatgcaaatcaggcagttaaaagttgtgcaaaaggtaaaataatgcaccagaagcaagatacaagttgtcttaagaatcccattactgcccaggtgccgtgactcacacctgtaatcccagcactttgggaggctgaggctggtggatcacatgaaggccaggtgttcaaaaccagcctggga

SEQ ID NO: 1697 - DNA, 206 bp, Homo sapiens
ccttgttggccatccagctgaccttcctgcgcctgatgtccaccgagggctccaagaacatcacctaccactgcaggaacagcgtggcctacatggaccagcagactggcaacctcaaggaggccctgcttcctccagggctccaacgagatcgagatccgcgccgaggcaacagcgcttcacctacagcgtcactgtcgatggct

SEQ ID NO: 1698 - DNA, 143 bp, Homo sapiens
gcccacgatgcctggagttactgtaaaagacgtgaaccagcaggagttcgtcagagctcttggcagccttcctcaaaaagtccgggaagctgaaagtcccccattggtgggataccgtccaaagctggccaagcacaaagagt

SEQ ID NO: 1699 - DNA, 131 bp, Homo sapiens
ccggaggtgcaggtcctggtgcttgatggtcgaggccatctcctgggccgcctgccgatccggtgggctaaacaaggtacttcttggcccggaaggtgggtggtccgaccgcttgtaaaggcatcaaccat

SEQ ID NO: 1700 - DNA, 118 bp, Homo sapiens
gtgaacctgaagccagcagccccgcatcatgtcaaagctcggccgggccccccggggcctcaggaggcccgaggtcggccggtgtgatccgggcgatcgtgcggcaaggcctggccat

SEQ ID NO: 1701 - DNA, 109 bp, Homo sapiens
cctcgccaattttggggcgagaaaaattaaaatgaatgtcacaaggcctgagttcagtcctctgtaaccttcagagaaattttgggagcctgtattttttccctcctgt

SEQ ID NO: 1702 - DNA, 640 bp, Homo sapiens
ctcgtgccgaattcggcacgagaataaatgaatgtcagaaggcctgagttcagtcctttgtaacttcagagaaattgtggaggctgtattttttcctctgataaaaggagaaggttatctagagctctgttatcattgtgaacattgcaaatgtggctattcctggaaaagagagaatgaagagtgtggtaagcaaagagaccgcttcccaacttaaaaagggcaaagaatttgtgagaaaatccagggaaatgatcatggaaatattaagtagccgttgctactcatttgttttcctttcctcaaacattccaggcaatgtgtccaaaaaacatacttaatccaaaccacagcataaagcaagaaagcagagaaaacctgagaagggtgggatgggaaagtctggctaacctggtagagaatgccaataccacattccctgttggtgggaggtgaggaaatagagctcaagcctttgcttctcctttaaaatattgggcaattctgagatctagcccttggctttatagctcaatcaaatctggccagttgggaaaggggagacagcctatagcctggacaaagggcttccctggcaagcctcccttcaacaaatttccggcaagctccctggggactc

SEQ ID NO: 1703 - DNA, 123 bp, Homo sapiens
tagctgtaatttattatacattttgaaatagctagaggatttggaatgttcccaccataaatgataaatgtttgatacatgataaatatcccaattactctaatttggattattacacataat

SEQ ID NO: 1704 - DNA, 260 bp, Homo sapiens
tagctgtaatttattatacattttgaaatagctagaagatttgggaatgttcccaacataaatgataaatgtttgatacatgataaatatcccaatactcttatttgattattacacattatttacatgtatcaaaatatcacatgtaccccaaaaatatgtacaattatgtatcaatttttaaaaataaaaaactaagtttttttaaaaagacaaacaatattcagaaatacttttctacagaaactaaaaaaaaaaaa

SEQ ID NO: 1705 - DNA, 205 bp, Homo sapiens
gaattttaccataaaaacagtataattcttaggttcttatgtcagcctacaaaagtctgtctattctaccctgtctataaaatgtagtattattttacctaattgccatttagagcattttttcaaggatgacctttaatactgaaattctgagatatgacttttagttcagagtttatgaattgggcattggagggtgtatatg

SEQ ID NO: 1706 - DNA, 615 bp, Homo sapiens
gaattttaccataaaaacagtataattcttaggttcttatgtcagcctacaaaagtctgtctattctaccctgtctataaaatgtagtattattttacctaattgccatttagaacattttttcaaggatgaactttaatactgaaattctgagatatgacttttagttcagagtttatgaattgggcattggtagggtgtatatgtgtatgttggtgaaaatcagtttgccagtatctgccatgtgatagtgataataaagtcatgaaacctgttacaagttatttgagaaacttttaggtttaagatcttgacttgaatatatttagggctatggcttgtgagattcagacctcagagaaaagcttcatttttccccatgtctcttagcacagcagacctggcaaatttattttgctctctaacagtcgagcccgggcctattccaaagtgtctgggtaatttatcctgggctatcccaatctcttcaattctggatgtgctgctacttattagtagcaggggtagcaggggtcagccctacttaataaactccagcctacttaataaattagtagcaggtaggcaggggtcagccctacttaataaactcaa

SEQ ID NO: 1707 - DNA, 131 bp, Homo sapiens
ggatccattcagctcatgccctcaatgtttatattgtgttatctgttgggtctgggacatttagtttagtttttttgaagaattacaaatcagaaggcaaagcaagcattttaaacacaactaataactgt

SEQ ID NO: 1708 - DNA, 247 bp, Homo sapiens
ggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgacccccactattggcaagttatgtgcccattctaaacaccgccaat

SEQ ID NO: 1709 - DNA, 184 bp, Homo sapiens
agctcaagtagcttgataatcttcggttttctattttctaatcaactgcccttagttatgatgtctacagtacatgcagtgcaatattaggctaagtatagtaatttaggagggtgaatctatcatccctaatgatgtaaccattaccccatttaggtaaatgaatatacacaatatagacagt

SEQ ID NO: 1710 - DNA, 346 bp, Homo sapiens
agctcaagtagcttgataatcttcggttttctattttctaatcaactgcccttagttatgatgtctacagtacatgcagtgcaatattagactaagtatagtaatttaggagggtgaatctatcatccctaatgatgtaaccattaccccatttaggtaaatgaatatacaaaatatagacagtgttctgttaatatgtatgtatattacatttactttttacccacaatataaaacaattcactttgggaggctgatggaggaggatcacttgtgctcaggagttcgaagccagcctgggcaacatgatgaaactttgtctctgtaaataaaaaaaaaaaaaaaa

SEQ ID NO: 1711 - DNA, 134 bp, Homo sapiens
attctgcctaggcaggagagatggcgcactgccacttaacttttttttggtacacagttttcagagtgggagattcacccattctttccttcccctagtcacctagctttgagggtgccttaggctgaatggct

SEQ ID NO: 1712 - DNA, 136 bp, Homo sapiens
ccagcagagttaccaccacaggtttaaacaaattctgtccactagagatcttttcccagtccagcagtgcaatagtttcattccagccccactcgctgggctctgtctgacccaatgaatgcgctgcctcaggact

SEQ ID NO: 1713 - DNA, 597 bp, Homo sapiens
gccagcaggaagttaccaaccacagggttttaaaaacacagattcctggtccacctcagagattctgattccacaggtccaggacgtagcacatacgtttccatttccaagcccccagctgcagctgaggctgctggtctgagaccacacttggaatagcgctggccttcaaggactagaacacattcttgccgcactccatgtcgaatcttcttctcactgtttcagtctaatattatgcccttgaatttcaccaagggctagtgtgggataggccatgtttgcagtgcctgattgttttagagaggtcagagaggtcatctcagagacttcactcattatggtgctcagtatgcgtcgtggaaaattactctcagatctgaggatgcagacgtattcagtcccttcttaggaattggtgaacatcttagtagatggtgaaagttctggaagtcatcatctttctcccattacttgcagaactggggatttttcctaattgctacagcgtttcctagacagaattctcaacatagttttttcaagttcctaatataatttcctccttttgctgcttgattttgtacttttcgtatg

SEQ ID NO: 1714 - DNA, 271 bp, Homo sapiens
ggtggctggactctgaacaactcccttcagtaaaggggccagtcttcactggcagtggctggtacttggctctcagcctcggaggtggcagctctcctagcagctggggttcactcccacttcatcctcggctgaaagaggtgctgtgcttttgaaatgcagccaatgaatacccagtctgattaccagatttgggcagaccagcagtgctcgccagagtggtctggcctcctatgggggatccaggttggtgtacatgtccatttcatgt

SEQ ID NO: 1715 - DNA, 149 bp, Homo sapiens
gaatttttaaaaaatttttaagaattgtttgtcacgtcatttttagaaatgttctacctctaatatggtaatgtccagttttaaaaaatattggacatcttcatcttaaacatttctatttagctgattggttctcacatatactccta

SEQ ID NO: 1716 - DNA, 124 bp, Homo sapiens
  misc_feature 97: n = A,T,C or G
gcatttagtgctgtaaatttccctcttaacacagctttagctgtttccccagagattctggtacattgtgtctgttctcattagttccaacaacttntttatttctgacttaatttcattattc

SEQ ID NO: 1717 - DNA, 203 bp, Homo sapiens
gaaacacgtctggctaggagaaactatcaatgctggcagccagtttgaatataatgtagaaggagtgacttccaaggaaatggctacccaacttgccttcatgcgcctcctggccaactatgcctctcagaacatcacctaccactgcaggacagcattgcatacatggatgaggggactggcaacctgaaaagggctgtcat

SEQ ID NO: 1718 - DNA, 132 bp, Homo sapiens
gccacgcgacgtgttgtgtctgagatcccggtgctgaagactaacgccggaccccgagatcgtgagttgtggggtgcagcgacttaaggaggaatatcagtcccttatccggtatgtggagaacacaagaat

SEQ ID NO: 1719 - DNA, 120 bp, Homo sapiens
gtctggaggacttgacgtcaagaagacctgtgcatggagaatctgataccgagcagctccaggatgatgacatagagaccaccaaggtggaaatgctgagactttctcttggcacgaaat

SEQ ID NO: 1720 - DNA, 216 bp, Homo sapiens
gagctgtcccaaagagggaaagcggtgaggtttgaggaggggcagaagcaggcccggcaaaggttgtaccttcataaggtggtatggggggtttggggtcaggccctgaacatcgtcctacttgagaatctgtcaggggaaaaagtcaaggggagcaggaggaagagccaagaaggccagagagaaaaagagttggagtcttaggggccaaggtga

SEQ ID NO: 1721 - DNA, 128 bp, Homo sapiens
gtcaactatcctcagctgtattcgtactcaattgtcagtatggcacagattactgtattaaaatattctcctttcgtcttcatatttaccttctgaggtaatcggctaaccttaatgtgttactacaa

SEQ ID NO: 1722 - DNA, 128 bp, Homo sapiens
ggaacctccaactggtctggcaactacttcaacggagacggcgggcacctcgctgctggtaacgaagaatgggaggggcggcctgcggaccagctggaggcaattttcctaagggacttggactccct

SEQ ID NO: 1723 - DNA, 159 bp, Homo sapiens
ccttcgccatgacccgcggtaaccagcgtgagtcgccccgccagaaggaatatgaaaaaggcagagcgrcctcggttaaggggaaagcgccgagaatgacgggctttctgctgccgcccgcaagcaggagggcctcggagatcatgcagcaagagcaga

SEQ ID NO: 1724 - DNA, 100 bp, Homo sapiens
ctttgaagccccatttttggggtaggggacagtgatgacttaatgtcatggccatctcttggggccagttttctttcatcccctccgagattgggggaga

SEQ ID NO: 1725 - DNA, 104 bp, Homo sapiens
aatatctgttctgcaactgttgaacaaataattggctacaatgaccctaattaaaggtaaaattttggccatgtatgtcacggtttatggtgtaagtgtctctg

SEQ ID NO: 1726 - DNA, 212 bp, Homo sapiens
gaatatgagaacttaagccttgactttaaattgccagttaatcatccattggtatccatgggagattgggtccacgacccccctgtccaattccaaaatccacagatactcaaggcccttacataaaatggggtaggattttcatataacctacacatatcttctcatatactttaaatcatctctagggttacttaggacaatataaatgt

SEQ ID NO: 1727 - DNA, 237 bp, Homo sapiens
cttccttgggagatgccataaagcacctggatgatctcaagggcaccttttgcccagcttgagttgaacttccacttgttgacaagcttgcattgttggattcttgagaacttcaaagcttcttgggaaatgttcttgtgaccgttttggcaatccatttcggcaaagaattcacccctgaggtgcaggcttcctggcagaagatggtgacttcagttgccagttccctttcctcca

SEQ ID NO: 1728 - DNA, 234 bp, Homo sapiens
aaaaaattttaaaaattacaaaaaaagaaaaaattaactccaggtataaggtgttagagtttgttagatgagctatgaagacttgacattacatggagtatagtaaagataaaaagttagaggttggttcaccttctatttactcaggccagattctctaacagaatatttttgaacttgattcatctaggagtgctcagagttttttgaggagcaaatcccaaaacttcacat

SEQ ID NO: 1729 - DNA, 611 bp, Homo sapiens
aaaaaattttaaaaattacaaaaaaagaaaaaattaactccaggtataaggtgttagagtttgttagatgagctatgaagacttgacattacatggagtatagtaaagataaaaagttagaggttggttcaccttctatttactcaggccagattctctaacagaatatttttgaacttgattcatctaggagtgctcagagtttttgaggagcaaatcccaaaactgcacatgcaggtgaatgggtcttaacagatttggaagtgccccttgccttaatttcttctgacttgacacaaagtctgtaattccagcactttgggagactgaggctggaggatctcttgaacccaggagtttgagaccagcctgggcaacatggtgagacactgtctcaacaaaaagtttaaaaaattaaccagatgtggcagtggctcaccctgtaatcccagcactttgggaggcggggcgggcacatcacctgagttcgggagacagagacagctggcaacatggtaaaacccgtcatactaatatacaaaaatagttgggcgtggtggtgcatgcctgtaattctagctactcaggaggctgaggcaggagaatcgctt

SEQ ID NO: 1730 - DNA, 165 bp, Homo sapiens
aaacatatgtccaaggactctaaattgagactcttccacatgtacaatctcatcatcctgaagcctataatgaagagaaaagatctagaaactgagttgtggagctgactctaatcaaatgtgatgattggaattagaccatttggcctttgaactttcatagga

SEQ ID NO: 1731 - DNA, 102 bp, Homo sapiens
ccaacctggggggcagtggtgtggagaagcacaggcctgagatttcatctgctctccttcctgggagccaagagcaggccaagcagaagcgggctggtgtct

SEQ ID NO: 1732 - DNA, 211 bp, Homo sapiens
tggaagtgacatcgtctttaaaccctggcgtggcaatccctgacggaccgccgtgatgcccaggggaggcagggcgactggaaggccaactacttccttaaggtcatccaactattggatgattatccgaaatgtttcattgttggagcagacaatgttggctccaagcagatgcagcagatccgcatgtcccttcgcggggaggctgttg

SEQ ID NO: 1733 - DNA, 107 bp, Homo sapiens
cattatccaaaatcagcttcaacaaatggtttctggagacaaataatttgttttcattatcattgtataatcaggttaatgatttatttcctgactaaatgtgcaat

SEQ ID NO: 1734 - DNA, 119 bp, Homo sapiens
cttccgaggaagctaaggctgcgttggggtgaggccctcacttcatcccgcgactagcaccgcgtccggcagcgccagccctacacttggccgcggcatggcctcttttcttccaggct

SEQ ID NO: 1735 - DNA, 254 bp, Homo sapiens
gacagctggtgcgcctgcccgggaacatcctcctggactcaatcatggcttgtggtctggtcgccagcaacctgaatctcaaacctggagagtgccttcgagtgcgaggcgaggtggctcctgacggtaagagcttcgtgctgaacctgggcaaagacagcaacaacctgtgcctgcacttcaaccctcgcttcaacgcccacggggcgccaacaccatcgtgtgcaacagcaaggacggcgggcctcggggca

SEQ ID NO: 1736 - DNA, 156 bp, Homo sapiens
tcaaaaagtcgggaagctgaaagtcccgaatggtggataccgtcaagctggccaagcacaaagagcttgctccctacgatgagaacttgttctacacgcgagctgcttccacagcgcggcacctgtacctcccgggtggcgctggggttggctcca

SEQ ID NO: 1737 - DNA, 405 bp, Homo sapiens
acatcagcaagaaccccaaggacaagaggcatgtctggttcggcgagacattgacccatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctcctcctccagggctccaacgagatcgagatccgcgccgagggcaacagcgcttcacctacagcgtcactgtcgatggctcacgagtcacaccggagcctggggcaagacagtgatttaatacaaaaccaccaagacctccgccttccatcatcgatgtggccccttggacgttggtgcc

SEQ ID NO: 1738 - DNA, 410 bp, Homo sapiens
gagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttacccaagatggggatattctttgtaaaaatgaaattaaagttttttaatggaaaaaaaagggtacttctggagcgccgggcccatcgatttccacccggtcgggtccaggtaagttaccaattcgcctatagt

SEQ ID NO: 1739 - DNA, 199 bp, Homo sapiens
cggcacgagggacaagttgaaggcattccctctgagaactggaacaagacaaggatgcccactctcaccactcctcttcaacatagtactgacagtcctagtcagagcatcagacaagagacagacataaagggcatccaaatcggtaaagaggaagtcagactgttgctgtttgctgatgacatgattgtatacctag

SEQ ID NO: 1740 - DNA, 345 bp, Homo sapiens
gaattcggcacgagccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctcctcctcttctatcagacctgaccccacacaaacctgtcccctcggttgtgttgaagtcccctcgacagtgggcaggggtggcagaggacacgagcagccagtccccgtacccctgtcgtgtgtgtagcccgt

SEQ ID NO: 1741 - DNA, 350 bp, Homo sapiens
ccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaattggctacaaccccgacacagtagcatttgtgccaatttctggttggatggtgacaacatgctggagccaagtgctaacatgccttggttcaagggatggaaagtcacccgtaggatggcatgcagtggaccacgctgcttgaggctctggactgcatcctaccaccaactggtccactgcaagcccttgcg

SEQ ID NO: 1742 - DNA, 390 bp, Homo sapiens
aggcgccgctccggcttgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctcccctgaaggccccgaggcgaagggtaccgaaagcacagtaatcactggtgtcgatattgtcatggaccatcacctgcaggaaccaggtttcacaaaggaggcctacaggagtacatcaaggttacatgaatcatcaaggggaac

SEQ ID NO: 1743 - DNA, 290 bp, Homo sapiens
cgtccaatttccggccaggggggccaaactcagtgttgaagacctttcagtcaccttgcgccactccgtaatcgcctgtttcaagaaaactctgttctcagttcactccccctcaattctctgagtaggaacaatgaagttgacctgctctttctttctgaactgcaagtgctacatgatatttcaggcttgctgtctcgtcataggcatctagccaaggatcattctcctgatttatattcactggagctggcaggtttggatgaaattgggaagcgttatggggaaga

SEQ ID NO: 1744 - DNA, 285 bp, Homo sapiens
catcctagagtcaaggaaaaagagaagatttttacttgctcaaagtcaagcaggtaatgtcagaatttaatctcaaatctatatctttatagaatttcagttccttggttatataataccaagtcacaatacaggtaatttcccaccattgaaccttcctgttggtgtgagatgccaaatctgtgaaacccagacacaggtggccaggtgggtgtcgaactcctgacctcaagtgatccgcctgcctcagcctcccaaagtgctgggattcacaggtgtgagtca

SEQ ID NO: 1745 - DNA, 310 bp, Homo sapiens
tggccacagagctggagcccctgtgcactccggtggtcacctgtactcccagctgcactgcttacacgtcttccttcgtcttcacctaccccgaggctgactccttccccagctgtgcagctgcccaccgcaaggcagcagcagcaatgagccttcctctgacttgttcagctcacccacgctgctggccctgtgagggggcagggaaggggaggcagccggcacccacaagtgccactgcccgagctggtgcattacagagaggagaaacacatctttcctagagggttcctgtagacctagggaggac

SEQ ID NO: 1746 - DNA, 214 bp, Homo sapiens
tgatgccagctcagctatggacacatccgagccagccaaggaggaggatgattacgacgtgatgcaggaccccgagttccttcagagtgtcctagagaacctcccaggttgtggatcccaacaatgaagccattcgaaatgctatgggctcccttgcctcccaggccaccaaggacggcaagaaggacaagaaggaggaagacaagaagtgaga

SEQ ID NO: 1747 - DNA, 175 bp, Homo sapiens
aggcaccacggaggaggagctcctgcgcaagtgaatgagcagcgggacatcctggctctgatggaagtcaagatgaaagagatgaaaggcagcattcgccacctgcgtctcactgagggcaagctgcgcgaagaacttcgttagaaggatcggctgcttgccatgggtgtcatcc

SEQ ID NO: 1748 - DNA, 194 bp, Homo sapiens
tgtgcacgcatagcaatataagatttactatgcacgtgatacattttatggagtgcctcaagccaagatagtgaatttatatgaagggtgtgaaatgtatttctttactactatagtagtttagttataacttttgcatctataattgagctttctcatctgtcaaatgctatggtttccttaaaatgttacat

SEQ ID NO: 1749 - DNA, 193 bp, Homo sapiens
tcatcctgagctgaacgggaagctcactggcatggccttccgtgtccccactgccaacgtgtcagtggtggacctgacctgccgtctagaaaaacctgccaaatatgatgacatcaagaaggtggtgagcaggcgtcggagggcccctcaagggcatccttggctacacatttgcacccaggtggtttccttt

SEQ ID NO: 1750 - DNA, 300 bp, Homo sapiens
catgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcactaacggcaggctgtccataatggtgttaccagctaagtttgctcgagccttcagtccgttgcagaggagcgagctggacgccactctggcgctctcagagtctcactctaactgg

SEQ ID NO: 1751 - DNA, 257 bp, Homo sapiens
gatgattgttggctgcatgtatgtcttctttagaaaagtgtctgttcatgtcctttgcccattttttaatgattttttttcgtgtaaatttgtttaagtccctcacagatggtggatattagatctctgtcagatgtatcgttagtaaaaatttcctcttattctgtaagtctgtctgtctactctcttgatagtttatctcgctgtgcagacgctcttgagtgtaaatagagcccacttgtcatatatcgctctgs

SEQ ID NO: 1752 - DNA, 192 bp, Homo sapiens
gtctttctcctaaactggtctttgtgctctctttgttttttcttatttccctcttgtctctcattttttcttcccattcccctcccatttcagcccttaacttttctctttcccatcttccactcagtattccaatggcaaaccctgatggatgtaacaaccgccgatggagacaatcggacctttccggac

SEQ ID NO: 1753 - DNA, 173 bp, Homo sapiens
tacccccagaagggtcaatgttgggagtggttgtggctctgagctgctctacagagcttcagtgtgagaggatcgagccattgaaagctcattaccagtaggacataatttttggctctccctattcacaaccagtgcaccagttttaccacagttggctcaggttgacaagt

SEQ ID NO: 1754 - DNA, 214 bp, Homo sapiens
taaccctttaccctataattgctatccttaaagatttcaaataaactcggagggaacttcagggagaccaacttatttagagcgaattggacatggataaaaaccccagttggagaaagttcaaaggtgattagattaataattttatagagggtgagtgaccttttataaattactgtaagaatgaacttgtaaataaggatgggataattta

SEQ ID NO: 1755 - DNA, 193 bp, Homo sapiens
tccctgtccctcgggcagatctgttgtgtctctcttcccaccttggcagcctcagctctgtgcccctcaccctgcttcctctcgccccttctcttccaccccttccttctgagccgggcccttgggattggggagccctcttgttccttatgagggtcaacttaagggggcttgagcatatcatcacatttcc

SEQ ID NO: 1756 - DNA, 200 bp, Homo sapiens
tccagatggatccctctgtgcttctgaggcaaggatggccaggcatgttatgggatctcaacgaggcaaacacctttacacgtagatggtgggacatcaatcaacgccctgtgcttcagccctaccgctactggctgtgtgctgcacaggccccagcataagatctgggatttgagggaagatcattgtggatactgagc

SEQ ID NO: 1757 - DNA, 200 bp, Homo sapiens
ataccttctccccacagcctctgctgatgacagagctgcctacacctagacacgtcctggcagggggcctcgggcactccactaccaacccagctccacccagcagtttcctggggagaaggaagctgaccctctccccagccttatatgccttgccacaccctacagctcctcttggagaagctgtttgctgagacccc

SEQ ID NO: 1758 - DNA, 387 bp, Homo sapiens
  misc_feature 350: n = A,T,C or G
ctggccgggacctgactgactacctcatgaagatcctcaccgagcgcggctacagcttcaccaccacggccgagcgggaaatcgtgcgtacattaaggagaagctgtctacgtcgccctggacttcgagcaagagatggccacggctgcttccagctcctccctggagaagagctacgagctgcctgacgcccaggtcatcaccattggcaatagcggtccgctgccctaggactctacagccttccttcctggcatggagtctgtgcatcacgaaactaccttcactcatatgagtgtgacgtgacatcgcaagactctacgcacacagtctgtttgcgcacacatgtnacctgcattcgacagatgcagaggagatactgcctga

SEQ ID NO: 1759 - DNA, 350 bp, Homo sapiens
gcctggccaccgggccacggcccacagacccagcacgtatctccatgcgccaagtggagcccccagccaagaagccagccacaccagcagaggatgacgaggattatgacattgacctttttggcagtacaattaggaggaggacaaggaggcggcacaacttcgggaggagcggctacggcagtacgcggagaagaaggccaagaagccttcacttgtggccaagtctccatccttcttggatgtaagccttgggattatagacggacatggccactggaggctttttcgtttatcagctggacggctgtctggggtctccagctgctcccgtgctacggtatcgagca

SEQ ID NO: 1760 - DNA, 165 bp, Homo sapiens
atcgaccagaacccgtgatggtattatagacacggaggaccttcggacaccttcgcagccattggccgcctcaattgtgaaggattgaggagttgggatgccatgatgaaggaagccagcggtcccatcaacttcaccgcttccttgaccaggttcgggggagac

SEQ ID NO: 1761 - DNA, 90 bp, Homo sapiens
aggttaggggagaggagcatgtccatagacctccgacggaagctgttaagcttccttgccatagctttcaataagccaagaaattactgt

SEQ ID NO: 1762 - DNA, 626 bp, Homo sapiens
agcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctcgcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggatccagcactacgccctgccctctactgactggaggcaggctctgcctactttagaagttaaaccaacccgataggccttcgagcaaaagcaaagatccaccgagagagagagaagaaaaaaaaaaaaa

SEQ ID NO: 1763 - DNA, 125 bp, Homo sapiens
tctctttccctgtagaaacctcttccgccatgagagccaagtggaggagagcgaatcccagctgagcgcaaaagaggaagatgaggcagaggtccagtaaaccctagctttttgcaccgtggagg

SEQ ID NO: 1764 - DNA, 115 bp, Homo sapiens
cggcggcggcctgaaccggggcctgcgcggaagagcactcctgctgagcgcctgccaaaggccaagagggaggcgccgccaatggagaggccggaggtggtgaggacgcacctcc

SEQ ID NO: 1765 - DNA, 145 bp, Homo sapiens
atggccaggccttgggctaacgtctggcttgcatggtcttccaagggaatcagccccatcaacaaagttcaaatcggggcaagagcttcacttgtccccctatatggttcttagggaccaagcttagggcttgcaatttctgtag

SEQ ID NO: 1766 - DNA, 150 bp, Homo sapiens
gggtccacatcctttccagcatttttgtttcctgactttttaatgggcggcattctaacttgtgcacacagtattttttttaaagctaaatctttttttctcgacttcaagggctgtgaaaaagctgtaaatgccccctgtagggggggt

SEQ ID NO: 1767 - DNA, 230 bp, Homo sapiens
tttgaagtgaacagatcttgtccggaacaccctgcggactgacctgcgggcttgcttgctgactcctctcaaagggacagagcgcccctgctccaggggaggaggctcaccggaccctggggcagagctgagcttggaaaccagcggaacagggaccccttctgatctgacttcagagtaatggttctccttcctcctgagggacccaaattgatgagagcaagtttgag

SEQ ID NO: 1768 - DNA, 350 bp, Homo sapiens
gaaacaccctgttgatcccttcccaggctcggcactgtctgctcactggagccggactcccaggttgtaattctaatgttgcctcatgagaacagaatggcagaagtttagtcctgacagattccccatagggagtaatgaggacagcatgaaacttggataggttttaccttagtcctataaggtggattttactaaggtttttaaatgatactgtcatcctcttggggtttatcagccaggttagaggagcccagtgtcctcacctctctcagatcatggcagagaaggagctgcctccagcccctctctgctgagtctcatttgagcagttccatgttagacataca

SEQ ID NO: 1769 - DNA, 130 bp, Homo sapiens
aacttttgctcttggatttaagtcaaggtactgtatagaagttgtgtaaaatcagtatgaaagttcaatgttgctgttcttgctcagtggattttaaagaattgagtagttcctatgtgatttttttttt

SEQ ID NO: 1770 - DNA, 310 bp, Homo sapiens
ggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaggatcaggcaaaaatgatcatgccgaaaaagtgcggaaaagctagaagctctctcggtgaaggaggagaccacggaggatgctgaggagaagcaataaatcgtcttattttattttctcatctctctttcctctcctctttttaaaaaattttaccctgcccctctttttc

SEQ ID NO: 1771 - DNA, 210 bp, Homo sapiens
tccaactacccgggactcagtattagccttcgctcactggcttctctgcacaagaggcggcttcggagtagccctcggtgaagccccagaccacagctatgagtcccttcgtgtgacgtctgcgcagagaacatgttctgcatgtgcagctcaaccggcccaacaagaggagtgtcatgacacaggtcttcttgagagagatggtagagt

SEQ ID NO: 1772 - DNA, 115 bp, Homo sapiens
ttttgcacagtcttccagcagttcggcagtatctgttttcactctatgaatgccgttactctgttttcttccaatcattagcggttgtgggacacggaaatgaaaaaggactcgc

SEQ ID NO: 1773 - DNA, 200 bp, Homo sapiens
gccttaacacggccccatttgatcagttccctgccaactcttgtatcctcatttcactaagctttgttacactcactagactgttaacaacggagaaaaactgttggtactgaatatgccatatacaacttgctatttattctgttcccgtttagagaggcattgctacccttaactatctgaactctttctgtgctctg

SEQ ID NO: 1774 - DNA, 612 bp, Homo sapiens
aaaagccttaacacggccccatttgatcagttccctgccaactcttgtatcctcatttcactaagctttgttacactcactagactgttaacaacggagaaaaacctgtgggtactgaatatgccatatacaacttgctatttattctgttccctgtttagaaggccatggctacccttaactatctgaactcttcctgtcctgtaagactgagctcactggcaatatcctataggctgctttccctaagcctccccatctttcttcctccctctttctacttctctcctacctccttttccctctctcccctactcacctgctttccttttgcccctcccacatcctcttcccccttcttgtcatttttccatgtcaagaaatttccagatatataggaatatgatggagaatgctgacaggcagttctttgagtagtcaaattaagatgtaatggttgaattgtataatggcaatcacataaactacatatataaagcttctagcttagtaaactctaaatgtgtttttttaaactaaagaatgagggggcaggcgtggtggctcatgcctgtaatcccaacatttaggaggctgaggcatgaggatcgc

SEQ ID NO: 1775 - DNA, 150 bp, Homo sapiens
ctcgtgccgaattcggcacgagagacctgaagcagttcagttctttaatgtgaccacactccagaagggagctgtatgactttgctaaggaaaatataatggatgatgatgagggagaagttgtggatatgtggatgaccccttggaact

SEQ ID NO: 1776 - DNA, 215 bp, Homo sapiens
gaggagctgtgccggcagatccaggaggaggaggacgagaagcagcggctgcagaatgaggtgaggcagctgacagagaagctggcccgcgtcaacgagaacctgcacgcaagattgcctctcgcaacgagttcgacccgaccatcgcggagacggaggcgcctacctcaagatactcagagagctcccagactttgctcagcgttctcaagagg

SEQ ID NO: 1777 - DNA, 170 bp, Homo sapiens
gctcaggctcagctgtcaagatagaaggacatggaaacccattcagcacctcaacatctccagctacatctggagattctggctcctactctacggtattgtgggggtattaatggaatttggtacatcctaagctcaggggaccatcaaaacagagacaacagttctga

SEQ ID NO: 1778 - DNA, 366 bp, Homo sapiens
aattcggcacgagcgattggcgacggtcgcagcaaatccagctgctgctgcggcggctgtggcggcggcagcagcggtgactgaggatagagagccacagcacgaggagctgcaggcctggacagccagtcgcgccagtagaaacggcgagagtgggcagaacgtccactgcgggccggcgaaagtggttccttgtggagagcactggtataggcagtggaggcatacgtcagggaggggacaggactcagcaccttctggctgcatcacaatgcacactcttcaggatgagataactggcgctcaggaggtactgtggaggcgaggatatgtctgctccagcagctgctgcatacctggtcagct

SEQ ID NO: 1779 - DNA, 120 bp, Homo sapiens
gaaaagcgaatgaagaagggaggcggcaggcagcccttcaggttggcccagggcttcaatctggcgcatgcaagtacgtcccgaacaattcagctggaggattcttccctcaaggcccaa

SEQ ID NO: 1780 - DNA, 309 bp, Homo sapiens
gaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaaaaaaaaaaaaaaaaaa

SEQ ID NO: 1781 - DNA, 120 bp, Homo sapiens
acaattgagacaccatcctgagttccaagagatccagggtagtcgtcttgccacttaggaggatacttaattgtgacaaggttaattggttccagcacaaccaacatggcacaatgtttt

SEQ ID NO: 1782 - DNA, 244 bp, Homo sapiens
acaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaaaa

SEQ ID NO: 1783 - DNA, 125 bp, Homo sapiens
aacaacagctagcaaccttcagaaaaataaaaccgctagctccacgacaaaggagaaggagacaaaactacctttactttcccgtgttccaaggtcctggttccctcttagtaccattaaaatgc

SEQ ID NO: 1784 - DNA, 621 bp, Homo sapiens
aaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttatgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaacattaaagtcactgggaagaaataatggctttgacttcaatcagactcctgcagctacaggaaagctcctgctctttccaaggggcttagatctcagtcatcagactatacagg

SEQ ID NO: 1785 - DNA, 165 bp, Homo sapiens
gcaaaaccagcgtggcggcccgcgctctcttccaggacatcaagaagccagctgaaggatgagtgggtaaaaccccagacgccatgaaagctgccatggccctggagaaaaagcctgaaccaggcccttttgggtcttcatgccctaggttctgcccaacggacc

SEQ ID NO: 1786 - DNA, 100 bp, Homo sapiens
ttcgtaggtagggttcgtaggtagggttagtagcacgtctgtactgcttcacctgtgcttcctgttcccaaatcaaagggcctaaggtggtccctccttt

SEQ ID NO: 1787 - DNA, 150 bp, Homo sapiens
ccgagcaggaggcgccatcatgggagtagacatccgccataacaaggaccgaaaggttcggcgcaaggagcccaaggagccaggattatttaccctaggcgtgttggtcaaagttaataaaggtttcttgccgaaggacccaacttcaca

SEQ ID NO: 1788 - DNA, 280 bp, Homo sapiens
cagactcatctcacacataataaataaatmaataaataaataaataaataaataaataacaatgacacatagaattactatgtcaattagcaagtccacttctggtttaacccacaaaaattgacagcagggacttcaacagatatttgtaaattcatgcgtatagcaacattattcatgatagccaaaaggtggaagcattcattgacagaggatggataccacatgtgtacagatatacagtggcacattacttagccttcaacaggacattctgtgg

SEQ ID NO: 1789 - DNA, 320 bp, Homo sapiens
aaccctgcggagggacttcaatcacatcaatgtagactcagccttcttggaaagaaaaaaaagaggctcccgggttgacaaatggtggggtaacaagaaaggaacttggctaccgttcggactatttgttagtcatagtacagaacatgatcaagggtgttacactggggcttccgttacacagatgagggtctgtgtatgctcacttcccatcaacgttgttatccaggagagtgggtctcttgttgaaatccgaaattcttgggtgaaacatacatccgcagggttcggatgagaccacggtgttgcttgttcagtat

SEQ ID NO: 1790 - DNA, 310 bp, Homo sapiens
ctggggcagctgcttgagaacagagactgctaccccatcctgcccatgcaggcaggctcttgccagccccgttctgacccgtgtccccccaggctctgcctgggcagaagactcaccttggaggagtgggccctcggagtgctgtccctcccagaagcccccagggtggggatttctcaggctgtcagtgcaggcccaggtctcaggagaaggggaggccctggctctccgggatcagtcctaggacacaggctcagcctcaggttgatgggggatgatgtgctcccgggctgcctcctgcacggggctc

SEQ ID NO: 1791 - DNA, 126 bp, Homo sapiens
atttagttcccattttccacggtgattgactcaatttaagtgtattgtggctatatgtaatttacaggctgctttgcgttgcaggtgggaaaatttcccaggcttgtgtgaggctgaacttgggta

SEQ ID NO: 1792 - DNA, 130 bp, Homo sapiens
ccggcaaaacgcagcagtagcagaggcagcttctgagagcctgggcaggcagcagctggctgaccaagtccactggaagagaaggctttgtgccaaccgggagaaggaagccggggacaggatggagagc

SEQ ID NO: 1793 - DNA, 250 bp, Homo sapiens
gggatatcatcaccgatcccacagaaatacaaactaccatcagagaacactataaacacctctacacaaataaactagaaaatctagaagaaattgataaattcctggacacatacaccctctcatgtataaccagaagagttgaatctctgaatagacccataacaggctctgaaattgaggcaataattaatagctctaaccacccaaaaaaagtgcccaggcccatagggttcacagacccaattct

SEQ ID NO: 1794 - DNA, 128 bp, Homo sapiens
tcgtgccgaattcggcacgaggctcccccaaaaatttgaatttttttttcaacactcttacacctgttatggaaaatgtcaacctctgtaagaaaaccaaaataaaaattgaaaaataaaaaccataa

SEQ ID NO: 1795 - DNA, 238 bp, Homo sapiens
aggtcgacactagtggatccaaagaattcggcacgagaacggttatagtcagacaatgaatgccttttctttggggatgtctcattttacttcatgccattttatctttttatccaattttaagggcttaattaactattaacatgacaattggggaattgagtctctttaccatatttcagcccagatatacttttgttccctggagggtcttttaactgtatttttaaaattaaat

SEQ ID NO: 1796 - DNA, 600 bp, Homo sapiens
aacgggttatagtcagaaaatgaatgctttttctttggggatgtttcattttacttcatgccattttatctttttatccaattttaaggctaataactattaacatgacaaatggggaatgagtctctgtaccatatttcagcccagatataatttttgtcccttgagggttctctaaatgtatttttaaaaataaaatgtattttaaagctgatttttatggtatagtgttctatgaaatcctttgaattacacgtttactgaataaatattgtagtacaaaatccatggtatataactctataaatttatttgaatgagtaatgttcactgaacagctaccatagtaaaaaaaaattaaccatgttgtatttgcattttttcctaccagtttgaattaaagataaaatatgtttatacatttaaacataagtatttatatctatggttagaatcttatacatatttggtatttttaattttaaatgctatataacctactttcagataaacaatgttgaacaggaagacccttaattaaatgggttgcttacttcacttttataagaaatttaaattgtggtatacaattagctatga

SEQ ID NO: 1797 - DNA, 257 bp, Homo sapiens
tgccgattgtggccatccagctgaccttcctgcgcctgatgtccaccgaggcctcccagaacatcacctaccactgcaagaacagcgtggcctacatggaccagcagactggcaacctcaagagggccctcctcctccagggctccaacgagatcgagatccgcgccgagggcaacagccgcttcacctacagcgtcactctcgatcggctgcacgagtcacaccgcagcctggggcaggacagtgattgatacaca

SEQ ID NO: 1798 - DNA, 392 bp, Homo sapiens
gtctgccaggacctcagggtccacctggacctcaaggaccaagtggtctgtccattcaaggaatgcccggaatgccaggggaaaaaggagagaaaggagatactggccttccaggtccacagggtatcccaggaggcgttggttcaccaggacgtgatggctcaccaggccacaggggccttccgggaaaggatggatcctcgggacctccaggaccaccagggccaataggcattcctggcacccctggagtcccagggatcacaggaggcatgggaccgcaaggcgccctgggaccacctggtgtcctggagcaaagggggacgaggagagcggggtacctccagtctcaggccatggtgagatcagtggcgcgtcaagtatcctacaag

SEQ ID NO: 1799 - DNA, 297 bp, Homo sapiens
tctcctcactcccttctacctgccactcacacagccaggtgcctttggagggtcccaagctggggcccagcccaccctcctgtcttcccagggtagcccgcctgccagtcctagctgcacagggcagctgggcccaaccctgtctttagagggccctggtgttttctagcacttgccttcacggtgggccttgcttgggacggggggcccagtcaggctttttcccagtctatccagagaggccccttcccatgggagacgagggcctcgggcccagccccacagctcttctgatct

SEQ ID NO: 1800 - DNA, 208 bp, Homo sapiens
ttttacttactgtaaagagtcattttcataaagatcaattcattgatttgttttttgtaaagctatcattcaatatatattataaattcgatataagtttcaaggggaagctcttattgtaagggggctttagagccaaactgtttaagctggaatccaacccaacaaaggaatcctttcaaggacgggggcaatgcaataagcttaa

SEQ ID NO: 1801 - DNA, 235 bp, Homo sapiens
aattgaattcatgtttaataattacaggcaccgtgcccccccttccccctgcccaggcaacagcaggggtggtacaggggctggggcatatgcccccagcagcgaggacggcagtcccgagagttattttcagaaaataaaaaaagggaccccaggggcaggcgttggtgcccctctcgtgccgaattcggcacgagttggaattggtgacgggtytaatgatgatgatgacaat

SEQ ID NO: 1802 - DNA, 346 bp, Homo sapiens
ctcgtgccgaattcggcacgagggacataggagggcccgagcaggaattcggtggtggacatagggccggtctgcttcttgtaaaagcctgaacccagaaacaacacaatccgttgcaaacccaaaggacccaggtactttccaatctcagtcactctgggactctgcactgaatggctgacctgacctgatgtccattcatcccaccctctcacagttgggacttttctcccctctctttctaggaaacctgactgggcagactccaaataaaatctgggggtctatttattatgtctcctgctagacctcggggtcaggcagagcgggaaactactggtgttgt

SEQ ID NO: 1803 - DNA, 211 bp, Homo sapiens
aaatttggagctccacagaaggatgttaagcatctggctattcttggtgcaggcctgatgggagcaggcatcgcccaagtctccgtggataaggggctaaagactatacttaaagatgccaccctcactgcgctagaccgaggacagcaacaaggtttcaaaggatttgattgacaaagttaaggaggaagctttacatcatttgaagggt

SEQ ID NO: 1804 - DNA, 236 bp, Homo sapiens
gtgatttctctactggcgaaacctgtatccgggcccaacctgaaaacatcccagccaagaactggttataggagctccaaggacaagaaacacgtctggctaggagaaactatcaatgctggcagccagtttgaatataatgtagaaggagtgacttccaaggaaatggctaccaacttgccttaatgcgcctgctggccaactatgcctctcagaacatcacctcccactgcaag

SEQ ID NO: 1805 - DNA, 174 bp, Homo sapiens
cagaaatacccacaactgtaaacagtaggtccatgcagtgcgcattggacacacagcacctgtggaaagtaggaacccaaggccaataaacttggttcttttgactacatgatactatttatttcatggatgttatgctgtatccaaatggttattgagtgaatcaggagcacc

SEQ ID NO: 1806 - DNA, 184 bp, Homo sapiens
ctcgtccgaatttcggcagaggggtgaaagaagctgagctgaaccacattacgatggatgatggaaccataagactatcaagaatcaaagtggtaatgggccgaagtttattcaagcatccggcaatggacttatcgtagttggggaaaagggtgttccgaataatatcctggaagttattagg

SEQ ID NO: 1807 - DNA, 160 bp, Homo sapiens
gtgagaagcttcatttagtgtttaaaaatgtggggagataaatcagacttaacatgtatgtaagatcaattcacttaaaagtatggtccaaatagcaaaaataggaccaggtgaaccatgtagtcattttttaaaaccatgtacttggtcttttgtgtgt

SEQ ID NO: 1808 - DNA, 167 bp, Homo sapiens
cggaggcgttcagctgcttcaagatgaagctgaacatctccttcccagccactggctgccagaaactcattgaagtggacgatgaacgcaaacttcgtactttctatgagaagcgtatggccacagaagttgctgctgacggtctgggttaagaatggaggggttat

SEQ ID NO: 1809 - DNA, 163 bp, Homo sapiens
ggccggcgcctgaaaggtgagttgaggccctcggcagctgcagccggggtgtctggtacccccccggcgtggtgcttagcccaggactttcagacgcggccgctggccgggaggttttggtgggagagacgggatcgctgatttcggtcttggcgccccttct

SEQ ID NO: 1810 - DNA, 207 bp, Homo sapiens
gcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgc

SEQ ID NO: 1811 - DNA, 344 bp, Homo sapiens
cggcacgagggaacgtctgaggttatcaataagctcctagtccagacggccatgggtcatttcacagaggaggacaaggctactatcacaagcctgtggggcaaggtgaatgtggaagatgctggaggagaaacccttggaaggctcctgggttgtctacccatggacccagaggttctttgcagctttggcaacctgttctctgcctttgccatcatgggcaaccccaagttaggcacattgcaaggaggtgcttgctttcttgggggatgccttaagcacctggtgtttttaggggccttttcccagtttggtcacttacttttgacgtttgcttgggttcc

SEQ ID NO: 1812 - DNA, 283 bp, Homo sapiens
cggcacgaggatttgagaagctgttacaagtattaggcagagttatttttcctgttttacatttttttttttttttttggggaaaaaattgggtagggtgttctaattacctgttttaccttcattggttattattgcaggttaaaggttttaaaccaaccacttgcatggtttgcttttgatggattccctttgggaaaatttgcacttttcgggggccacttggggaaattgcgcatttcactcttccctctcttttcccccttccttttggcgagaccgt

SEQ ID NO: 1813 - DNA, 252 bp, Homo sapiens
ggcaggttggaggagctgcagctaccaggtccaggcccagccagcagggccttgccaaggtccggaagccaggccggtgccaagagtcccagcaaagggtgcaggcctttgttgtccacggcaggagggccagccagggtagtgtaaagagaacccagggcgctacactgtatcacattggcgtgggagcgcccagtccccttacacgggatcccttggacgcccagaggggaagtttttgtaactttcatc

SEQ ID NO: 1814 - DNA, 464 bp, Homo sapiens
ggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaaaaaaaaaaaaaaaaaaa

SEQ ID NO: 1815 - DNA, 209 bp, Homo sapiens
agaatcttagttcacctttaaatttgccaacagacccctctaaatccctgtgtaattttaactgtttagcccaaagagagaccagctctttggaccactagggaaaaaccctttgatggagagaggtaaaaaattttaccaccctctggtaggcctaaagacagccaccattgagagaaacgcttccagttcaacaacgatacactaag

SEQ ID NO: 1816 - DNA, 184 bp, Homo sapiens
gtggctaggtcggttcctctcctttccagtcggagacctctgccgcaaacattgctccgccaggaccatcggtcaggccaagaggcattccggccttgatctcccctctttgtattttattggagactgtgaggctaacgtgagccaccattgtagtctcttgtcggctctggcattggttcaa

SEQ ID NO: 1817 - DNA, 185 bp, Homo sapiens
gccacctggtacttgtccaccctgcctcctctgttctgaaattccatccccctcagcttaggggaatgcacctttttccctttccttcttaattttgccatgtttttactgatcattcggtatgttaacccttcttagcccttagccttggagaggagagcttttacagcctacagtcagagttt

SEQ ID NO: 1818 - DNA, 226 bp, Homo sapiens
ctcaaaacagcctctgacttcatcaccaggatggactaccccaagcagactcaggtctcggtccttcctgaaggcggtgagaccccactgttcaagcagttcttcaagaactggcgggacccaaaccagacaagatggccttggctttgtctatactttcacagccaatatcgccacactgagacggtctcccttcggacgccagcaactctaaaaacatcccatc

SEQ ID NO: 1819 - DNA, 199 bp, Homo sapiens
cggcacgagcaaagatatagttagataggaggaataagtttccgtgttacattgcacagcagggttgtctatagttaacaatatagtgtatctttcaaaatagctaaaagaaaagattttgaatgttctccccacaaaggaacaaatatttgaatgtgatggaatatatctaatttccctaattttggatccatggcac

SEQ ID NO: 1820 - DNA, 222 bp, Homo sapiens
aaaagctggaagatggccctaaattcttgaagtctggtgatgctgccattgttgatatggttcctggcaagcccatgtgtgttgagagcttctcagactatccacctttgggtcgctttgctgttcgtgaatatgagacagcaggttgcggttggtgtcatcacagcagtgggacaagaaggctgcctggagcttggcagggtcacacagtcttctcagaag

SEQ ID NO: 1821 - DNA, 187 bp, Homo sapiens
gtggattgtgtgtctgagaatgatggctgtggagggggctacatgaccaatgccttccaatatgtgcagaagaaccggggtattgactctgaagatgcctacccatatgtgggacaggaagagagttgttatgtacaacccaacaggcaaggccgcctaaatgcaggaggtcacagagagttccccg

SEQ ID NO: 1822 - DNA, 118 bp, Homo sapiens
ccgcgcggtgaggttgtctagtccacgctcggagccatgccgtccaagggcccgctgcagtctgtgcaggtcttcggacgcaagaagacagccgacagtgttgggcgcactgcaaacg

SEQ ID NO: 1823 - DNA, 142 bp, Homo sapiens
gtcctctgccagcctacaggaggaaaagcaaggcttacagaaggatgttccttcaggaggaagcagcactaaaagcactctgagtcaagatgagttggaaaccatcttctggttgccggattcgggccgggccggttcccgt

SEQ ID NO: 1824 - DNA, 130 bp, Homo sapiens
cttgttcaacctcagctcagaatatgtgtacagcaagtgtttttgctgtaccacaaaatttgaggttaggcaaattcacaaatacgggatccatgaattaacgaggatcaactgtacttgactatatttg

SEQ ID NO: 1825 - DNA, 202 bp, Homo sapiens
gaaagctcagctggtggtgattgcacacgacgtggatcccatcgagctggttgtcttcttgcctgccctgtgtcgtaaaattgggggtcccttactgcattatcaagggaaaggcaagactgggacgtctagtccacaggaggaccttgcaccactttcgcctttcacacaggttaactctggaagacacaggcgctttggc

SEQ ID NO: 1826 - DNA, 106 bp, Homo sapiens
attattttgttcttgtgggcagaagtgggaatgatggaatatcctcacggaaaaggcagttaagttgggagtactgcttacaaaacaagggtcaccagttcattat

SEQ ID NO: 1827 - DNA, 117 bp, Homo sapiens
ctcgtgccgaattcggcacgagtatctagaataggagaatacataaagaaagaaagtagatgaggtcttcccaggagctgcggggacgggagaataaggggtgacttccaagggagt

SEQ ID NO: 1828 - DNA, 120 bp, Homo sapiens
agaactggttctacacgcgagctgcttccacagcgcggcacctgtacctccggggtggcgctggggttggctccatgaccaagatctatgggggacgtcagagaaacggcgtcatgccca

SEQ ID NO: 1829 - DNA, 126 bp, Homo sapiens
tctcagtagagtactggctccttttataatttgttaccagctttacttttgtgataaaatattgatgttgtattttacactcttaagtcttaaccacagtcaggattatcttaatggtgattatta

SEQ ID NO: 1830 - DNA, 134 bp, Homo sapiens
cgcacatccgcgccaagaggaagcgggaggagctgagcaacgtactggcccccatgaggaaagcttgcttgccaagaaaggactgaggcccctcccctgccctcttccttgaaataaagaccagctttgacaga

SEQ ID NO: 1831 - DNA, 140 bp, Homo sapiens
atgttgagcaaagcttaggccaacatgaattgtttgtgaagtgtggttgatggtgctttgtttttttctgactacttctatggaaggccagtgaagaagcaaaggaagacaagaaaattgacgctcaatcttcttcccat

SEQ ID NO: 1832 - DNA, 224 bp, Homo sapiens
ctggcacagtggttcacacctgtaatcccagcactttgggaggcctaggcaggctggtcttgaactcctgggctcaagtgatcctcccacctcagtctcccaaagtgctggaattacaggtgtgagccactgcgcacggccagtcttttattttaattggtgacttaaaaatcagctggtgtgttgttacagagaacagtgctaattctaattttgtgtgacac

SEQ ID NO: 1833 - DNA, 235 bp, Homo sapiens
tgcggcacgagcacaggtgtcgtgaaaactacccctaaaagccaaaatgggaaaggaaaagactcatatcaacaatgtcgtcatttgacacgtagattcgggcaagttcaccactactggccatctgatctataaatgcggtggcatcggcaaaagaccattgaaaaatttgagaaggaggctgctgagattggaaaggctccttcaagaatgtccttggtctttgataaactaa

SEQ ID NO: 1834 - DNA, 230 bp, Homo sapiens
ctgacttgctgtgtgaccctgggcaagtcacttaactataaggtgcctcagttttccttctgttaaaatggggataataatactgacctacctcaaagggcagttttgaggcatgacttattctttttaggaagcatttttggattcctcagcacagaggattcttaagagccttgagtattttttatatataggaatgtgcaccatgtgactcttatacggcgtgtgtg

SEQ ID NO: 1835 - DNA, 360 bp, Homo sapiens
ctcgtgccgaattcggcacgaggagggagagcagatgcagctccaggggctcgacttatagccagttacagctccccggctctctggatggcagagcgtcgtttccgggccctcaggctggggagctcagttcccattgcttgtgctcagggctgagtcttaaagaagggtttgccggccctaacgctgcagcgcgtgcgcggtgagaggccctttttgagcctgtatactcctgtggcctgggacagaacagtaaatactctgtgcacggaggaaagacatgcccaagaggaagggatgtactgcaccatcggctgcctgtgagcagcttagcaaggagcccttgctcctggaaaggcg

SEQ ID NO: 1836 - DNA, 210 bp, Homo sapiens
aaggaagaggtcagggttgacgagagctccaggaaggatgaaagtgcctctggaaggcaggaggaaagtactgtaatactttatcctagggtgggaccaagagtcttggaaagctctgccctataaagtccctttcccaatttcttccaggtcccaggtgttggtgtgataaggagagtttgcccaatctctggagctcaggggtctcta

SEQ ID NO: 1837 - DNA, 170 bp, Homo sapiens
aaaagatccaatttattttgtggtaattttgctagacaaagctctctagggttgagtcaaggtacaggtacatgggaaggaaggccaatgcatgtagacttcataagatacttattacagttcacttataggttctctccagtcaagatgcaatgttgccaatcaagagt

SEQ ID NO: 1838 - DNA, 200 bp, Homo sapiens
gacacattttttaggaaatgtttttaataaaagaaaattacaaaaaaaattttaaagacccctaaccctttgtgtgctctccattctgctccttccccatcgttgcccccatttctgaggtgcactgggaggctccccttctattttgggcttgatgactttctttttgtagctctggctttgatgtttcttcactgtca

SEQ ID NO: 1839 - DNA, 170 bp, Homo sapiens
ttgagaagaaacttaatcagaatagcaggtcagaggctcctaactggcaactcaagattctggcttctactgaaggaccataaagaaaagatgaaaaaaaaaactttcaaagaaggtgaaataataaaactattatataaagggtgcttacattttggaaacaacatatt

SEQ ID NO: 1840 - DNA, 375 bp, Homo sapiens
cagtctcttccccacaacaatattcatgtgcctagaccaagaagttattatctcgaactgacactgagccacaacccaaacaacccagctcttcctaaggttcaaactagactacttctccataatattcatccctgtagcattgttcgttacatggtccatcatagaattctcactgtgatatataaactcagagccccaacattaatcagttcttcaaatatctactcatcttctcattaccatactaatcttagtgaccgctaacaacctatttccacctgttcatcggctgagagggcgtaggagttatatctcttgctcatcagttgatgatacgcccggcagtgccaccacagcagccatttaggcatt

SEQ ID NO: 1841 - DNA, 260 bp, Homo sapiens
agtcatcaacgggatacagttccatattgccttaaacctccttgttttagacacactaacatttataccaaattgcagattattctgcagagagggaattgcatgtttgtgttgtatatttagtatgaactcttttcagaatataatatttctcaggtatcacaagtaggttgggaacatattgcaagactatgaacacagagttgctgctcttatattttcactccagagtgtgaattcacagccccatattatatatc

SEQ ID NO: 1842 - DNA, 290 bp, Homo sapiens
tcctgtggctccttttggggcttgtgcttggcagttcctgtgctgtcctgtctcccagatcctgagaccctggctgagaacttggcccagcctgctgcttaaaggcaccatggggacctgggttgccctgagacccaagccattgttagcagctagccagccacaccaaccacggcagggggaggaaagggaaggacttggagagacacagagaccagagccagccatagggacaagagagttcagatttaggcctcttctcatggtcccccaccccagatgccgctagt

SEQ ID NO: 1843 - DNA, 105 bp, Homo sapiens
ctcgtgccgaattcggcacgagggcaaatacaaggaagaaaccattgagaagatgcaggaataaagtaatcttatatacaagcttctattaatacttgaacaaaa

SEQ ID NO: 1844 - DNA, 360 bp, Homo sapiens
gccgttctggtaaaaagctggaagatggccctaaattcttgaagtctggtgatgctgccattgttgatatggttcctggcaagcccatgtgtgttgagagcttctcagactatccacctttggtcgctttgctgttcgtgatatgagacagacagttgcggtgggtgtcatcaaagcagtgacaagaaggctgcttgagcttgcaaggtcaccaagtctgcccagaaagctcagaaggctatatgaatattatccctaatatctcccaccccactcttaatcagcgggtggaggagcgctctcagagctctttgtttcaatttgccatattaagtgtagtagtgaaagactcgttaatga

SEQ ID NO: 1845 - DNA, 330 bp, Homo sapiens
acacacttctgctttcacttaagtgtctggcccgcaatactgtaggaacaagcatgatcttgttactgtgatattttaaatatccacagtactcactttttccaaatgatcctagtaattgcctagaatatatctttctcttacctgttatttatcaattttcccagtattttatacggaraaaattgtattgaaacacttagtatgcagttgataagaggaatttgggataattatcagtgggagaatattttttatactgtatgtgccacagctttactactgtggagagacaactgttttaataaaagagttacattccacaaaaaa

SEQ ID NO: 1846 - DNA, 200 bp, Homo sapiens
attttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaagaggaataaaataaaaa

SEQ ID NO: 1847 - DNA, 235 bp, Homo sapiens
gaaaaactggaaactctaaaaatcagaggacctctcctcctccaaaggaacacagctcctcaccagcaatggaaaaaagctggatggagaatgactttgacgagttgagagaaggaaggcttcagacggttcaaactactccgagccaccaggaggaaggtcggaccattgcaaagaaggttaaaacctttgaaaaaaaattagacggatggatatactagagatacccatgtag

SEQ ID NO: 1848 - DNA, 224 bp, Homo sapiens
gtggaaattttttgttatccttgctggtggcccgtgaaagacaccttactatttaatgtgaaatataggtaggaaagagtgtagagtccgctatgagcccgaagatatttggcctccagttatattgcttgacaactggtagacaagggtttcctattgcctggaaatcttccagtcggaggtaattggcccacagatacagctcggtctctctgtccctctcg

SEQ ID NO: 1849 - DNA, 166 bp, Homo sapiens
cggcacgaggccacattgagatgatccttacggaaaaggaacagattgttcctaaaccagaagaggaggttgcccagaaggaaaaagatattccagaagaaacttaaggaacaaaaacttattggacggggagttaatttaggcattaaaattaattgtatttaaa

SEQ ID NO: 1850 - DNA, 323 bp, Homo sapiens
cccttgcaaggtgacaggccgctgcggctctgtgctggtacggctcatccctgcacccaggggcactggcatcgtctccgcacctgtgcctaagaagctgctcatgatggctgggatcgatgacttctacaacctaggcccggggcagaactgccaccctggggcaacttcgccagggccacctttgatgccattttctaagacctacagctacctgacccccgacctctggagggagactgtattcaccaagtctccctatcaggagttcactgaccacctcgtcaagacccacaccagagtctccgtgcagcggactcagg

SEQ ID NO: 1851 - DNA, 192 bp, Homo sapiens
agttaacttatttacaatatttaagttctctgcttctgcatttggttggtttcctgaagcgcagcccctgttaataacaaggttgcttttcattggtttcttttgtcaagagaaaattgattaagggcttaatttgaggatttaccagaagcagattaacctcagaaatcctgtctggctggcagatttcar

SEQ ID NO: 1852 - DNA, 257 bp, Homo sapiens
ccgcgacgagtaggagggccgctgcggtgagccttgaagcctagggcgcgggcccgggtggagccgccgcagggtgcagatcttggtggtagtagcaaatatttcaacytaggattcaagatttcagtatgtgttttaaaccataattttttcccatatccctggactcttgagaaaattggtacagaaatggaaatttgccttgttgcaccatacacttgcaaaagatgagtttaaaaaattacatacaaacagct

SEQ ID NO: 1853 - DNA, 230 bp, Homo sapiens
ctcgtgccgaattcggcacgagtattggtttccttcttcaccttgaacttttgttgaactgtatgtactttaccccaaaactgttagtattttgagggcttctatttgaaagcaaaggaataattttgattactctggcattcataaattttattgatgagattattaattttaaaggtttgaggtaacatctctggttgtaccacagagagagataaatatggtttctt

SEQ ID NO: 1854 - DNA, 199 bp, Homo sapiens
cggaggtggcagccatctccttctcggcatcatggccgccctcagaccccttgtgaagcccaagatcgtcaaaaagagaaccaagaagttcaatcggcaaccatcaagaaccatattgtcaaaatttagccgttacttggsggaaaccaagaaggcaattaacaccagggtttcgtagaggattcaagggccagatctt

SEQ ID NO: 1855 - DNA, 205 bp, Homo sapiens
ctcgtgccgaattcggcacgagatatagtaccgcaagtgaaagatgaaaaattataaccaagcataatatagcaaggactaaccccgataccttctgcataatgaatttactaggaattactttgcaagggggagccaaagcttaggaccccgaaaaccagccggagctaccttaagaccaggctaaaggagcacacccgtctat

SEQ ID NO: 1856 - DNA, 179 bp, Homo sapiens
ctcaccagaagcagacgctggcaccgtgctgcttgtacagcctgcagagccgtgagccaagtaaacctctttaattacccagcctcagggccagacccgagggtttctgagccgtgactttggcctaaggcctttaattgctttgggcttgcaaagggaggtcaagaacacctcccgtk

SEQ ID NO: 1857 - DNA, 216 bp, Homo sapiens
atgctctggtggctggaattgaccgctacccccgcaaagtgacagctgccatgggcaagaagaagatcgccaagagatcaaagataaaatcttttggtgaaagttgtataactacaattacctaattgccacaagggacttttgttggtaatcccttgggacaaaactgttgttcattagggttgtttttaagaggttccctgctcttacaccgca

SEQ ID NO: 1858 - DNA, 128 bp, Homo sapiens
ttcttgttcaggactgtcatagccacagtttgcaaaaagtgcagctattgattattgcaattgtaggtgtcaattaggatggtacattccctgagggccttttaatctgttgtagctttgtctttttc

SEQ ID NO: 1859 - DNA, 213 bp, Homo sapiens
gctcagcctagtgaactgcaacctcaaaggagcaaggccttgacacagttgctgggggaagtggccagagtagagatgctgggactgagggttgagcagcaaacttggtgaaactacatctccaatgtgctttctaatctcctgccagctcttttcaagcaggggatcctggggagatgtagttttcagatacctggttgggtttgggagtag

SEQ ID NO: 1860 - DNA, 245 bp, Homo sapiens
aagatggcccagtttgatgctaaaaagtttgcagagacccaacctaaaaaggacacaccacggaaagagaggggttcacgggaagagaagcagaagccccaggctgagccggaaggaggagaaaaaggcggcttcccctgctcctgaggaggagattggattgaatgtaagcaggcgctggctgctgagcccaaggccaaggaccccttcgttcaccttcccaagagtacctttgtgttggatga

SEQ ID NO: 1861 - DNA, 185 bp, Homo sapiens
taaataatgttttaccttaccaaagtatcttgttctgatttcatttttaccaaatgatattctgatctccacattcatattttggtattctcagggcgttggtagctacttggcgccaaagagttgctcttaaaatgtgtttagaattaaagcgcagggctctagggcaaaatgctccggggaca

SEQ ID NO: 1862 - DNA, 615 bp, Homo sapiens
taaatagatgttttaccttaccaaagtatcttgttctgatttcatttttaccaaatgatattctgatctccacattcatattttggtattctcagggcgttggtagctactggcgccaaagagttgctctaaaatgtgtgtagaatgaaagcgcagggctctagggacacatgctccgggaacacacagagatttgctgggaatatccatgggccccagggcacatttgcatatccagtgggatctgtcatttaggaaagattaaaaattttagttatcccttaatgttggaacagatagaccaacttcagtggtctgagagagtatggagctcactcccaaaggaatccttactatgtgtcccagatgacatacacagcattgactggcacccacgctcagagcagtcttctccaaaagataaaggacacatccaaattgaagtccttcgatctttgagaataattaaataactaactaagggaaaatgttttgataaaatgcttgccacagtacctccctaaatatctataaagacagaagattcctgattataaaacacttctgacaaaagtgatagtaaatattctcatgtatttctgaaaaaaaaaaaaa

SEQ ID NO: 1863 - DNA, 195 bp, Homo sapiens
ccactccaccctactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcattatgaattaactaggaattaactttgcaag

SEQ ID NO: 1864 - DNA, 200 bp, Homo sapiens
gcctggagttactgtaaaagacgtgaaccagcaggagttcgtcagagctctggcagcctttctcaaaaagtccgggaagctgaaagtccccggaattggttggataccgtcaagcttggccaagcacaaagagcttgcttcctacggatgagaacttggtcttacaagggaactgcttccacaagcggcaccgttacctc

SEQ ID NO: 1865 - DNA, 143 bp, Homo sapiens
ctcgtgcgaatttcggcacgagggaaaatttcctaagatcctggaggatttcctacccccgtcctcttcgagaccccagtcgttattgttggaggaagagccaccttccaagatggacacgagccacaagttgcactgtgaac

SEQ ID NO: 1866 - DNA, 240 bp, Homo sapiens
gccgagcgatgggcatctctcgggacaactggcacaagcgccgcaaaaccgggggcaagagaaagccctaccacaagaagcggaagtatgagtttgggcgcccagctgccaacaccaagatttggccccggcgcattcacacagttcgtgttcggggaggtacaaggaataccgttgccttaggtttggcggtgggatttcttccttgggcttagagtgtttggatctgtgtaaacaagg

SEQ ID NO: 1867 - DNA, 155 bp, Homo sapiens
gtgaccatggtacctggcaaaggacccagcttcccagagccattaagagaagagcaggacctagaacgcctacgggatccagaagttggtagcctccttgagcttaggctattgtgttccaaagccattcaacctttaaccccacaaccgacttg

SEQ ID NO: 1868 - DNA, 190 bp, Homo sapiens
agagtgtaaatttgccaaatttacccacgcaacagacatgattttacctaatacatgtgaattattgaagattaaactgattgaaatagtttgggaatataaaacttaagaatactttgcgccgggcacggggccttaacaccttgtaatcccagcacttttgggaggccgagcacaggtggatcagagg

SEQ ID NO: 1869 - DNA, 260 bp, Homo sapiens
ccagaacatcatccctgcctctactggcgctgccaaggctgtgggcaaggtcatccctgagctgaacgggaagctcacttggcatggccttccgtgtcccactgcaacgtgtcaatggtggacctgacctgccgtttaggaaaacctgccaaatatgatgacatcaggaggtggtgagcaggcgtcggaggcccctcagggcatcctgggctacactgagcaccaggtgtctctctgactacacagcacaccactctcca

SEQ ID NO: 1870 - DNA, 150 bp, Homo sapiens
aaagaaggaaaccctgggccacttgggccaattggacctccaggtgtacgaggcagtgtaggagaagcaggacctgaggccctcctggtgaagccttggcccaccttggcccttccggtcccccttggccaccttcacagcttgctcttg

SEQ ID NO: 1871 - DNA, 150 bp, Homo sapiens
ctacacaaaatagccagacatcatgcacctggtcccacatgttgagatatgtagtgatttatgatcataataaattagtgtttcccaaaacctacttctgttggaccttgaggtcaaataacttttggaaccttgccacttgtatcctct

SEQ ID NO: 1872 - DNA, 429 bp, Homo sapiens
gctacacaaaatagccagacatcatgcacctggtcccacaatgttgagatatgtagtgatttatgatcataataaattagtgtttcccaaaacttactctgtggaaccttgagtcaaataactttgggaactttgccaactgtatcttcttaattattgtgaaagttgtcagaatcaaaatggagtcatgaatgttaagaaaaccctgacaaatggagccaacaaaaaccataaagaaggggttctgacacttgtgtgctcgataatgaaaaagactatacaaaaaccacaacctggcacacaacccattgcaactgtacaaaaaatatatacaagaatatctgcccagcaactgcctgtccaaacttgtactgggtgtcacccttgtcattgatctttgtaaccaaagataagtatttcaaaaacaaa

SEQ ID NO: 1873 - DNA, 110 bp, Homo sapiens
atcttaaagaaacagctttcaagtgcctctctcgcagttttcaggagcgcaagataagatttgggataaggataagtctctaggtttttaacaaccgcaactctcacaaa

SEQ ID NO: 1874 - DNA, 100 bp, Homo sapiens
cgactagctcacagtcaagcgactactatactcattgatccataacttgaccacggacaagttacctagggatacaacgcaatcctattctagagtcata

SEQ ID NO: 1875 - DNA, 110 bp, Homo sapiens
cggcacgagagtacttctagagcggccgcgggccatcgattttccacccgggtggggtaccagggtaagtgtacccaatttcgccctatagtgagtcgtattacatttca

SEQ ID NO: 1876 - DNA, 225 bp, Homo sapiens
cagtttattattgttggatacaaagttcttcattgataagagtcctataaataagataaatacgaagataaagctttattctttagtgttaaaatacagtatatctaataactagcctcattagtagagcagtatattaaccaatgttttatgtaaaaaggtgtttatcttcagcaccaaatacatgatacatgtatcagtcactattaataaacagagctttca

SEQ ID NO: 1877 - DNA, 214 bp, Homo sapiens
cacagaatccatcaaccgggacagcaaagagcccttctcttcagttgagatccaggctgctctgagcaagatgcaggatgacaatcaggtcatggtgtctgagggcatcatcttcctcatcttgaggaggcctcgtcttctgaacttgggtgttcccgagagagtttgttcctgtgttcccaccttttccctgacccaaggtctttggcctcta

SEQ ID NO: 1878 - DNA, 167 bp, Homo sapiens
gatatttatagctgatcaatctatatgtgtcacagaactatgctgcctaaagtgatcttggctccttaatgggtccttttggccctttggataggttaacagctgaactaatcctaatctctcctgtggttttccttgccttaaccaacaatggtggtccttttgga

SEQ ID NO: 1879 - DNA, 170 bp, Homo sapiens
gatgcattctcttttggacatattgagttggctatctctaaaagatattcatgtgcagatgtctggcagacttattagaaatgctgggtttggacctcaagggaaaaggtaccaaaaatttggactaggtaattggatggactatttggaggttaattcctatgcttcag

SEQ ID NO: 1880 - DNA, 613 bp, Homo sapiens
gatgcattctcttttggacatattgagttggctatctctaaaagatattcatgtgcagatgtctggcagactattagaaatgctggtttggaactcaaggaaaaagttacaaaaaattggactaggttaatggatggactattttgaagttaaatcctatgcttcagtataaatgaagacatattttttttttctataaccactatgaagttcccctccccctccaaattatagtattgtctttggagtgtttgatccacattggcagggactgggatatggagaaaggagtgaaaaaaggagtttgagactacaggaaaagtcattagcaattgcacttagaattgaaaatcatgacagaaagaccggtgcagtggctcatgcctataatcccagaactttgggagcctaaggcaggtgatcgcttgagcccaggagttcaagaccagcctaggcaacatggcaaaatcttgtctttactaaaaatacaaaaaattagccaggcatggttgtgcatgcctgtagtcccagctacttaggaggctgaggtaggagaatcactgggcctgggaagtcaagcctgcagtgagctttgaatgtgcactggactcca

SEQ ID NO: 1881 - DNA, 123 bp, Homo sapiens
tcttgaacagacagaaggatgtaaaggatggataatacagcaggtgctagccaatggtctgggacaacaagctccgtgaaagactgggagcgacttgaaggaaggattcggggcccataggag

SEQ ID NO: 1882 - DNA, 175 bp, Homo sapiens
caatccctgacgcaccgccgtgatgcccagggaagacagggcgacctggaagtccaactactttccttaagatcatccaactattggatgattatccgaaatggtttcaattgttgggagcaggacaatgttgggcttcaaggaaggttgaaggaggttccgaattgtcccttcg

SEQ ID NO: 1883 - DNA, 210 bp, Homo sapiens
taagtagagactaagtggtttcatcctacctgaaaattgccttcttgaaataaatgttttgatacccactggcctatcttcctctgggaaaacaaggagtttttcaatttagaagtcccagtttggttgggattccaagttaaggccggtttcaacctgaacttgaattacggcccccttggaaccaaggctttgtccaggagccaaccg

SEQ ID NO: 1884 - DNA, 250 bp, Homo sapiens
ggagtagattgctgcctctagcagagactgaactggggaatttgaacattcctttacattgttggagaaatgaagccaaagttattcagatggttttcccaggctaaaggaaagtcacctgcaagagatccgcacttatctgagcagctgacaaggtggggtctcccttaccacagagaagagccactctctcgcgctctgggtgaccacctctgctctgggctcttaaaggttccacattgctgaggcc

SEQ ID NO: 1885 - DNA, 170 bp, Homo sapiens
ccttggctccctgctgccctcaggataaagtctggaccctcagcatggcttgtgagactcatggtgtccttgtccctgctcacctctctgggctyatcacttgccttcttgcattctggtgccagcctctgtatccagagatgcagttgctcttcattgccactctgatt

SEQ ID NO: 1886 - DNA, 115 bp, Homo sapiens
agaagcaacaatttcatttatacacttacatgctattttttaaagcacttttccctccaatcttcatttgtattataaataaatatgtatgttcacaaccctcttaaaaaaaaaa

SEQ ID NO: 1887 - DNA, 140 bp, Homo sapiens
ctagtcttgaagtccctcatttaaacagaggtcaagcaataggcgcctgcagtgtcaagcctgaaaccaagcaattaccgtcatgtttcagccaagcccagagccctaggattacaaccacctatggccggaacctccta

SEQ ID NO: 1888 - DNA, 125 bp, Homo sapiens
cgtgataggacactgaagacatccgattcttacacacatttatagtgacactacagttttatatttacaattaggctctgtatccttaagggctctatgctttaccagtaattcacaggggattt

SEQ ID NO: 1889 - DNA, 482 bp, Homo sapiens
cgtgaattaggcaccactgaaagcacatcccgaatttctttaacaacaacattttatagtgaacactacaagtttttatatttaaaaattaagactctgtatccttaaggtgctctatgctttaccagtaattcacagggtatttcaaatggtagaatcattttagcttctgtgcttcctttttctaaataatgcaacttgtaagagttgacattgtaataagctttataatagtatatatatatattttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaaaaaaaaaaaaaaa

SEQ ID NO: 1890 - DNA, 170 bp, Homo sapiens
cggcacgaggtcagccaaagaaacatttcactgttggtgaaccaataccataagcactgttattatctaagcacttttatcaagatatatacattttgtacaagctctcaattttgttcaattattatcaaaattttaaaaaacaagtttggattttgtattgggataga

SEQ ID NO: 1891 - DNA, 281 bp, Homo sapiens
agttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatccaccgccctacgacaagaaaaagcggatggtggttcctcctgccctcaaggtcgtscgtcttaagcctacaagaaagtttgcctatctggggcgcctgctcacgaggt

SEQ ID NO: 1892 - DNA, 124 bp, Homo sapiens
cgagtccagagacagtgccccagtggagtggagcccaagctgtcagtcgagagtaacgttgagttagagttggtacaacgtgtagttacagtatccgtgttgatgtccgtcgtccgtccagcgt

SEQ ID NO: 1893 - DNA, 619 bp, Homo sapiens
cgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggacagatctatgacatattccaaaagctcacagcacacccaggtagttttgctgtcagcca

SEQ ID NO: 1894 - DNA, 109 bp, Homo sapiens
tgggtgtttccaagcattcatcatgtgcaatgccatccattcgccagacggtatttcaagtcatgcacaaagctcattccatgtcatcatattgttagcgagctgccag

SEQ ID NO: 1895 - DNA, 609 bp, Homo sapiens
tggggatgtgtatgcccaggcccttccttccttggtggcaatggagcctagccattagggccagcgggagtctgtgacccaggtactggcacccaaagtgactttgccctgcttcctgccatcttgttaaagaaaaggtagccaggattccctaggaaataagctgtggagaaaccactcagcaactgcagacaggggtctgtggccagttcagggtctgagggccagtgaaggtgggtgcaggcaggctgaaaggacaccagcacagccctcggggtgggggcttgtcactggtgtctggtctccctgcttttcccatgtggcctgggctccatgatacgttctccaggcctgggcctggaaaacaggtctttcctgttctctgggacctgctagaaagcttcagtcagtttggtccctgggagagaaaacgctcttcccatgacggctctgtggaggccaggaatggggtagtgggttgactgggagtactccttcctgccgccctggtcaagggactagtgtgagtcggagtgcatttttggaatggggcaagggtgtttttcatgaccatttatttgagtggtttgattggtatgcatacccctt

SEQ ID NO: 1896 - DNA, 201 bp, Homo sapiens
ctcgccatttcggcagggtaatccccagccaacaacgtccctggacactgccctgcccttggggctggcctgcctagtatcatagactaggtctgggtgggggttggcacgtttgtgagctcacatcttcctaactacctgtctttgtctgcttatcaaattcagacagcttcagacacaggaggaggggagggcaggggg

SEQ ID NO: 1897 - DNA, 212 bp, Homo sapiens
cggcacgagcaaaaacggaagggtggcgagaagaaaaagggccgttctgccatcaacgaagggttaacccgagaatacaccatcaacattcacaagcgcatccatggagtgggcttcaagaagcatgcacctcgggcactcacagagattcggaaatttaccatgatggacgatgggaactccagatgtacgcattgacaccaggctcaaca

SEQ ID NO: 1898 - DNA, 255 bp, Homo sapiens
ctcgtccattttcggccacgggccttaacaggtcaaaatagcagatcttcgtgaaaaccctttaccggcaagaccatcacccttgaggtggagcccagtgacaccatccgaaaatgtgaaggccaggatccaggataagggaggcattcccccgaccagcagaggctcatctttgcaggcaagcagctggaagatggccgtactctttctgactacaacatccagaaggagtcgaccctccacctggtcctccgt

SEQ ID NO: 1899 - DNA, 310 bp, Homo sapiens
cggcgtcttggcgattcggcccgacgagctccgctttcgctacagcatggtggcctactggagacaggctggactcagctacatccgatactcccagatctgtgcaaaagcagtaagagatgcactgaggacagaattcaaagcaaatgctgagaagacttctggcagcaacgtaaaaattgtgaaagtaaagaaggaataatctaccctgactaaagcttgaaatgctacatttccaaggtgaagatgttttgggcacatgttatggcagattgaaaaggatctcattccatgggaaaaaaaaaatcct

SEQ ID NO: 1900 - DNA, 260 bp, Homo sapiens
ccagtatagcctatataatatccatttcccattctctggctaactccatctcactcttggaggtaatgctatttcataccaacatgaaaggtgaggattaagggagatagatatagacatacaataaaatctcctggtaacaatgtccttcaacccacttaaaataacataattagaggagtgactaatattgcactgctgaaataggctgtgaaaaaaaattgaatataatagacataatgggtgaaagaggcccactt

SEQ ID NO: 1901 - DNA, 220 bp, Homo sapiens
cggctgctgttggttgggggccgtcccgctcctaaggcaggaagatggtggccgcaaagaggacgaaaaagtcgctggagtcgatcaactctaggctccaactcgttatgaaaggtgggaggtacgtcctggggtacaagcagactctaggatgatcagcacaggtcaaagcgaaattggtcattctggctaacactgcccacctttggggagatttgaa

SEQ ID NO: 1902 - DNA, 255 bp, Homo sapiens
ccctgaggtgcctctctgctcctgtcttttgtttggatgccggcgctgctgcctgtaggctcccgcctttttgttgctaccccgagtcttgctgaccatggcctctggaagccctccgaccagcccttcgccggcctcggattccggctctggctacgtctcgggctcggtctctgcagcctttggttacttgccccaacgagaggtcgccaaggagatcgccaggccagttgttgcagagcgctagcagcctgc

SEQ ID NO: 1903 - DNA, 195 bp, Homo sapiens
ccttcattaggggtaaaggttttacttttcacttatcttgttttttatgggaagattcagaattttgagtttagggggaaatatgacagataagagcaggaactcccatatggggcttacgtttaaagatacatggtatgaatttttttaaaggacatacattatattgtactactgagggctaaatacactgtt

SEQ ID NO: 1904 - DNA, 245 bp, Homo sapiens
tgagctttcctgtctttccttttttctgagagattcaaagcctccacgactctgtttcccccgtcccttctgaatttaatttgcactaagtcatttgcactggttggagttgtggagacggccttgagtctcggtgcgagtgtgcgtgagtgtgagccacctcggcaagtgcctccgcagggcccggccgccctccatctggccgggtgactggcgccggctgtgtcccaggccttaccctgcct

SEQ ID NO: 1905 - DNA, 110 bp, Homo sapiens
ttaagtaactgtattgaacttttacgtatactttcggaacacgcatgaacggcagtttcgaataccagaaacatctacttcggtagcttcgtgccattatccagtcgatc

SEQ ID NO: 1906 - DNA, 205 bp, Homo sapiens
tgaagatcacctcagccagttctcagacacttaggggacatgttctctgcaggaccactctgagggactcttctgcatattgctgacctgagaggatggcctaagagctgacttgggcaatcctcccaacaggaaggggagaaattgcctccactgagggaacaggtcaatgaaggtggagataatctgcaaggggcgcgagacc

SEQ ID NO: 1907 - DNA, 174 bp, Homo sapiens
cctcgacatcttatgtagatgatccacaacttcaaaatttagtctgggcctagtgcagtggctcacacctataatcccaacactttgggaggccaggagttttgagaccagcctgggaacatctgcctctacaaaaaaatacaaaaattagctgggcatagtggtgcatgccts

SEQ ID NO: 1908 - DNA, 135 bp, Homo sapiens
tgtggcctctccaagcgtcctgcacgtgtccgccgtagctttaccattttagtgagggaagccagccctggggtgggagggggtgtgtctgggtgtgcctattgagagcgtgtaatggcgtttgggagctcgtgt

SEQ ID NO: 1909 - DNA, 264 bp, Homo sapiens
gttcggacatttttcatgacatcaagaaatttaagctaacaaacatatctgtataaacattacttaatatacaatattatcttagtatctgtgttttctggaacaacaacttcctgtggaatgccaaatataatgtgaaataccaaatataaagcattgcgtctttacatacttcagcctttaccacatacaaacaattcttatttttacacagagtcctttctgagaaattttacttcacaccaaacttagagtcctcagtag

SEQ ID NO: 1910 - DNA, 138 bp, Homo sapiens
cggcacgagcacaacagtaacagaactttgcaattttctggggttttgtttttttaccctttttcccccctttttttttaaatggagtgtgctggatgtctctataattttattcagatgactgcagaacctggaaaa

SEQ ID NO: 1911 - DNA, 296 bp, Homo sapiens
gcggcgcgaagggagcctctgggtgaggaccaacttgggctccgcgctgctgctgctgaccatggccttggccggaggttcggggacgcttcggctgaagcatttgactcggtctttggtgatacggcgtcttgccacccggcctgtcaattgactacccttgcacacctacctaaggagagggttgtacgcatgtcagagaggttgcaggctgttttcaatttgtcagtttttggatgagggaattgacttaaatcggactaaattggaatgtgatcttcatgtccagagcattt

SEQ ID NO: 1912 - DNA, 237 bp, Homo sapiens
atttaatatttagtgcaaattttatgataagggaataggggagatattggaggtaaagtagaaattaattaatttaccatgttactaatacatcttgttggttttgaagtaagcattttacctgtaatcattgaccttctacaaatgtttcaaggggaaatagctaaagactgtcaggttcactgatactaaaaacatatatcaagaattttaatggcagtccgatgggtcctaagc

SEQ ID NO: 1913 - DNA, 670 bp, Homo sapiens
atttaatatttagtgcaaattttatgataagggaataggggagatattggaagtaaagtagaaattaattaatttaccatgttactaatacatcttgttggttttgaagtaagcattttacctgtaatcattgaccttctacaaatgtttcaagggaaaatagctaaagactgtgaggttcactgatactaaaaacatatatcaagaattttaatggcagtcctgatggtgcctaagcacaccattacatcataggtcctgtgatccaatactgattttaggaaatatggtcatagcataactttcatatcaactgaaaagaatagaaacaatatgagagaaggggagttaaaagacccagaacacaaagtccaagagctgggatgaagatagcaataaaaatacgggaatatatatatatatataatatatgtattttatatatatataaaaatgtatgtattatatatatattttatatatataaaatatatgtattatatatatattttatatatataaatatatgtatatatatatatgtattttatatatgtattttatatatataaaatatatgttgtatatatgtattatatatatataaaatatatgtatatatgtacatatggtatttttatatatatatgccaagtggttaaaataattt

SEQ ID NO: 1914 - DNA, 279 bp, Homo sapiens
caagaagcagaagcccggaaattaagaagaagattctggcttagagacgcaagccgctcaacatcgatcaccttggtgaagacaaactgagggacaaggccaaggagctcttggagaccctccaccacctggagattgacaagttcgagtttggggagaagctgaaacgccagaaatatgacatcaccacgctcaggagccgcattgaccaggcccagaaggacaaccaggagggttgggaccccgccaagggcaaattcggcgggccttggagtagaa

SEQ ID NO: 1915 - DNA, 238 bp, Homo sapiens
accacatggagaggcctgagtcaacatggagaggagaaggacttgacttaattcagccttccagctgttccctaccaagggtgccaaggcattagaattaagctgtctttgaacctttgaagggccagcttagccaccagatgccaaacactgagcaggctttgtttctccacccacaaaccaagaggcgtgtcttaaccggggggggttgggagtgggagaaaagggagaattaaga

SEQ ID NO: 1916 - DNA, 297 bp, Homo sapiens
accacatggagaggccctgagtcaacatggagaggaagaaggacttgactgaatccagccttccagctgtccctaccaaggtgccaggcatgagaatgaagctgtcttgaactctgaagaccagcttagccaccagatgccaaacactgagcaggctttgttctccacccacaaaccagaggctgtctcagcaggaaggagttggagttggagaaaaaggagaattaagaatctatctggcgatgtggattaaataaacaacaaattggcaaaaaaaaaaaaaaaaaaaaaaacccc

SEQ ID NO: 1917 - DNA, 127 bp, Homo sapiens
tgaactgacttagataagaaagtggcaactatctaacttagacattggcagaattgccttttttttgagaattggcttaggcaaggaactattctattttaacacactaaaatttcgagcgcacact

SEQ ID NO: 1918 - DNA, 680 bp, Homo sapiens
gtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaatttaggactgggctggtttgctgctcattctctcgaggcataggcagccacacttgaattttgccaagtatgcagataattccaacttgtagtcaggatcatcaggtaatagcattataaggggagctgtacagactgtatactttctacagtttgttgaaatagaaacatttatatggatacatacatctgcaaaggttagggagaaaacggtagccctggcagagaagagctagttagtgtattcagggatagggcaagggaagctgtcatttctctactaagtctcaattggtggaaaagccacaaatgtccctagtacagtataagggaaaaaagggctgaaccgtggtgggctcacaacctgtagtccccagggactttttcggaagggattgctttgagccccaagg

SEQ ID NO: 1919 - DNA, 331 bp, Homo sapiens
ggaaaccagctatatgtctttgggggcggagagagaggtgcccagcccgtgcaggacacgaagctgcatgtgtttgacgcaaacactctgacctggtcacagccagagacacttggagatcctccatctccccggcatggtcatgtgatggtggcagcagggacaaagctcttcatccacggaggcttggcgggggacagattctatgatgacctccactgcattgatatagtgacatgaaatggcagagctaaatcccactggggctgctccagcaggctgtgctgccactcagctgtggccatgggaaacatgtgtacatctttggtgg

SEQ ID NO: 1920 - DNA, 312 bp, Homo sapiens
cgccttttcagtggttcttgggatgctccgcagccaattaagccgactgagttcctttcctcatggggacccagtgtgcgatggctgcacacagcagctttccttggtagtgtacgcagcctgttggttgtattggttgctctaagggaccttggagacaggcctttcaggtggatgttcatgtttctgaccttgcactaccccaatgtaggctccaaacaggcatgcgaggtgcctttggaaagccccaggcactgtggccagggttcacattggccaagttatcatgtccatccgcaccagctgcagaca

SEQ ID NO: 1921 - DNA, 301 bp, Homo sapiens
aacgaagactgttatactacttccttcctaatcagtagtatacttctatgtctttttcttctcttattgccctatctagaacttccagtataaaattgaaaaagagtggtgaggggaaatatcttgctttgttcctgaccttagagggatgctttcctcaaagtttcttagaattaagggtaatgggaattgtggttccttgtagaggtctttaccaaattgaggctattccctctattccctcgtctattgagttttgttttgtttttttggatgaatcagtgtggattttgaaaaatgt

SEQ ID NO: 1922 - DNA, 311 bp, Homo sapiens
cctcactgtccccatgtcccacccacgtcctacggcactcaggaagcacttggtgaggacgagccctcacccttcttgtcttccttcccagcagcgcccgcagcggccattttacacgtcgaggctggcacctggcgcgctcgggggccactgtagcgtctgcctgctccctggactcgcaggcctcgcctgtggcccctttcccagggccagcctgggtcacgagatgctgtcactcagccagatcagtattgacccaccaggggaggtggggtttggtgagagacgccagcctcagactttttcccact

SEQ ID NO: 1923 - DNA, 340 bp, Homo sapiens
gcgaggacgtggtgggtcctctggtgcgaaattccggatttccttgggtcttccggtaggggctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgagatattgcaggagtcatagtgacataaaggcgagatgaaaggttctgccatt

SEQ ID NO: 1924 - DNA, 308 bp, Homo sapiens
gttgagttcgggtcgagctgtgcgcccttttttcctctcgctctctcggttatcataaccttgtattccctctggaaggaaatggaaattcctttggatcatcttctaggtaaacagtttaattagctgcgtgaggtgacaaacttgctcggatgaagtcatgggagctgaccgaattggcctgaatccaagaggggagtgttcagggcgcgcgtgtcctcggaggcctgaggtaacgctggctccttcccgggagtcctaacgccggctttggatctcagacagctctctagcaggcgttggcacct

SEQ ID NO: 1925 - DNA, 376 bp, Homo sapiens
cggcacgagcggcacgagctcgccaaaattttcggcaggaggcccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagatctagctgccttcacaaagacccagaaggaccctggtgtcttgaccgcatgatgaagaactggacaccacagtgatggtcagctagatttctcagatttcttaatctgattggtggcctagctatggcttgcatgactcttcctcaggctgtccttccagagcg

SEQ ID NO: 1926 - DNA, 377 bp, Homo sapiens
cagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggactaggaggaggaatattccatcttggcagaaccacagcattggtttttttctacttgtgtgtctgggggaatgacgacagatctgtttgactttgttataaaatagggctccccacctccccatttctgtgtctttattgtagattct

SEQ ID NO: 1927 - DNA, 336 bp, Homo sapiens
ggaattttttcttgtgtgttatatttttaaaaacctcaaaccagagcatactgataaatccaagttgttatacatagattatttttactaaagaggattaatctttcgtaattattgaagatcattgttttagactgggttatgtaatatgactcccaacacacattttcaaagctgatactctagttgctattatctcttggaacaaataagaagtaaaaggtaggagtaaaattccttttatttcaatgtttaatgtagcatggctgataatatggcaaccacatttctgtggaatgtgctactctctgggggaggctaatggtccatctgatc

SEQ ID NO: 1928 - DNA, 684 bp, Homo sapiens
gaattttttcttgtgtgttatatttttaaaaacctcaaaccagagcatactgataaatccaagttgttatacatagattatttttactaaagaagattaatctttcgtaattattgaagatcattgttttagactgggttatgtaatatgactcccaacacacattttcaaagctgatactctagttgctattatctcttggaacaaataagaagtaaaaagtaggagtaaaattccttttatttcaatgtttaatgtagcatggctgataatatggcaaacacatttctgtagaaatgtgctactctcttggggtaggctaatggtgcatctgatctgataaagtagaaagatagcctcttgcactttgacctgtagattctggctgcatagagcctggatgtcatattgttgcacacacatgtgctctcacctactcaccagattaatagtgaacatcagtgaaatttttggcagaattcagagagttatgagtttgaataacaattttccaatcaaatatgaggttatgcctatggagtttctctgaaaattgaaaatgccttttacgtttactaatgcataataattaagatggcaatttggactcagacagctgtgagtttgaatacctgtctgatgctacacattgtttccagctcagctacaatagcctccctaaag

SEQ ID NO: 1929 - DNA, 312 bp, Homo sapiens
ctcgtccttggggattaaatgcataacatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaacccaaagttatttgttttgcatggctaagccattctgttatctctgtaaatactgtgatttcttttttattttctcttgggattttgttaaagaaattctaaaatttttaaacacctgctctccacaataaatcacaaac

SEQ ID NO: 1930 - DNA, 300 bp, Homo sapiens
cgaggctgcggtgtctgctgctattctccgagcttcgcaatgccgcctaaggacgacaagaagaagaaggacgctggaaagtcggccaagaaagacaaagacccagtcaacaaatacctggggcaaggccaaaaagaaggagtggtacaaaggcaaagttcgggacaagctcaataacttagtcttgtttgacaaagctacctatgataaactctgtaaggaaggtgccaactataaacttataaccccagctgtggtctctaagaaactgagattcgaggctcctggcaggcagccttc

SEQ ID NO: 1931 - DNA, 109 bp, Homo sapiens
gttaagtcagctcgggcaggatcgctgtgtgcgcacgtctgatacgccgctgtttaaacttcgtttcctctggccccataagtgatctatgcaagtaacccacaagcat

SEQ ID NO: 1932 - DNA, 616 bp, Homo sapiens
gttcagtgaggtcgggcaggttcgctgtggctggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggctcccctcagggtgccatgactcccggaatccctatctttagtccaatgatgccttatggcactggactgacccacagcctattcagaacaccaatagtctgtctattttggaagagcaacaaaggcagcagcagcaacaacaacagcagcagcagcagcagcagcagcagcaacagcaacagcagcagcagcagcagcagcagcagcagcagcagcagcagcagcagcaacaggcagttggcagctgcagccgttcagcagtcaacgttccagcaggcaacacagggaacctcaggcaggcacacagtcttccaatcacaga

SEQ ID NO: 1933 - DNA, 113 bp, Homo sapiens
gttttttttttttttttttaaaattaacttttttataagatttttacaagacacccatttttaacacatacagaattggtttcaaaggtttttgttttacaccacagccacca

SEQ ID NO: 1934 - DNA, 105 bp, Homo sapiens
gcagctctccagcgcagccatgttcagttcgcagccccaagatcgttaagcccaatgcgagaagcgcacgcgcttcgcactccgccatctcccagcctcttctgg

SEQ ID NO: 1935 - DNA, 256 bp, Homo sapiens
ttggaattgaagtctggcttaaatcttcagaaagttatatatctattttattttattttttttgagacagagtctcgctgtgtcacccaggctggagtacagtgccacaatcttggctcactgcaacctctgagtccaggttcaggcgatactcatgcctcagcctcctgagtagctgggactacaggcgtgcaccaccacacctcgctaattttttgtatttttagtagagacggggtttcgccattgttgccca

SEQ ID NO: 1936 - DNA, 108 bp, Homo sapiens
cctcccgcaataaagcctgccgtccaagattaaaaacaactcgaacctcgacaattaaccagccccattaatcctaccaatcaaccccaccaggcaataattacccct

SEQ ID NO: 1937 - DNA, 145 bp, Homo sapiens
cctccgcataagcctgcgtcagattaaaacactgaactgacaattaacagcccaatatctacaatcaaccaacaagtcattattaccctcactgtcaacccaacacaggcatgctcataaggaaaggttaaaaaaaaaaaaaaaa

SEQ ID NO: 1938 - DNA, 206 bp, Homo sapiens
caaggaagggaggggcaaacgatgctgggccttctaaattatattaccgagtttatccttcattttaagagcaatgggtaactattgtgtggttttaaacagagcaacaacataatcagacctgttctttagagagatcacgctgggatgctatttagaagttggggaggggtgagactggatttagaaagacccctcacagaaat

SEQ ID NO: 1939 - DNA, 207 bp, Homo sapiens
gggctaatgcctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaaaaaaaaaaaaaaaaaactcgggggtcttttggggcggccggg

SEQ ID NO: 1940 - DNA, 300 bp, Homo sapiens
attacattcatcttctcatttaatcctcacaacaatctgaagaaggtaggtattacaattcccacttcatagaaacagaaactgaggttcagagaggttaagtcatttgcccaaatggctgagcaaagcctaccatgtacctaacctttattttctttcccgaacataccaggctgtctcctcataacttccagcatgcacttaaaactccacatgaatacaaggttcatgggacttggtattcatagaaagggaggcagaaagctggtcttttcctgataggcttgtaatttaatatca

SEQ ID NO: 1941 - DNA, 362 bp, Homo sapiens
tcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttcccccaacccggaaacagacaagcaacccaaactgaccccctcaaaagccaaaaaatgggagacaatttcacatggactttggaaatatttttttcctttgcattcatctctcaaacttagtttttatctttgaccaccgacatgaccaaaaccaaagtgcattcaccttcca

SEQ ID NO: 1942 - DNA, 296 bp, Homo sapiens
ccaccgtagataagtggaggacttcatcaacaacattaacagtgtcttggagtcctcgtatattgagataaagagaggagtcacggaagatgatgggagacccatttatgcgttggtgaatcttgctacaacttcaatttccaaaatggctacggattttgcagagattgacctggatttgtttagaaaggctctggacctgattattgactcagaaaccggctttgcgtcttccacaaaccatattgaaccctggttgatcaacctaaagggcagaggatgaggagaggaggcgc

SEQ ID NO: 1943 - DNA, 280 bp, Homo sapiens
taaacacatccgctattactcgcatcaggagtatcaatcacctgagctcaccatagtctaatagaaaacacccgaatccaaataattcaagcactgcttattacaattttactgggcctctattttaccctcctccaagcctcagagtacttcgagtctccttcaaccttttccgacggcatctacggctcaacattttttgtagccacaggcttccacggacttcacgcattattggctcaccttcctaactatctggtccatccgccacctaatattt

SEQ ID NO: 1944 - DNA, 114 bp, Homo sapiens
agacacagttgtctaaggctgcctgtcaccactgtggcctctccaagcgtcctgaacgtgtccgccgtagctttaccatttaagtgagggaagccagccagggggtgggaaggg

SEQ ID NO: 1945 - DNA, 234 bp, Homo sapiens
ggagaaaactgcatcataactttacagaattgaatctagagtcttcccgaaaagcccagaaacttctcttcaagtatctggcttgtccaatctggtctaaggtggcttcttcttccccagccatgagtcagtttgtgcccatgaataatccacgccctgttatttccatgcctgctttactgtattttaagggcattatactgtacatttgataataaaataatattctccaaa

SEQ ID NO: 1946 - DNA, 186 bp, Homo sapiens
ctggccaacttttccctggaaagagccatattcatgaggctagtccacgcactgggagccggattgctgccaattctctttcctgcttcccacttctatgacctcggcttggttatttccatttcctggcttggttatttggactcatagcttcctttaagagtagttaccacacataaaggttta

SEQ ID NO: 1947 - DNA, 319 bp, Homo sapiens
ctcgtgccgcacttttgccctgggaaaagagccatattccatggaggctaagaccacgcactggggagccggaatggctgcaattctgctctccttgcttcccagctctatgaccttgggctggttatttcccatttcctcgcctagttatgtggactgataggctccctataaagagtagttaacacacataaaaggattagaaaaaagcctcggacagcatagtgtctaatacatgttgactattcattaagttaactatgtgcatgaagccattctcccaggaacttaagctttaaaaaaaaaaaaaaaaaaaaaa

SEQ ID NO: 1948 - DNA, 166 bp, Homo sapiens
caacggtgtgttcaccccgacttccaggagtttgtcaataaatgcctcatcaagacccagcggcgggccgggacctgaaagatgctcacaaacccacacctccatcaagcggcccgaggtggaagaagtggatttcccgcctggttgtgtaaacccatcggctgcc

SEQ ID NO: 1949 - DNA, 340 bp, Homo sapiens
cttgtccaaacctgagtgacagcattaagcagaccagtattttcaagattctaagctgtagcaagtcccacttcttcaaaaggttagacaaggcattctcacttagaaaggaggatccccagggcccaaggcacacacactgcctttatccaccacgaagcttacaagcccacagaattaaacccctatgttggacgttgctcattgttgcaaatttgatttttggaagaattttcccacgccaatcttcattaggtgtttcaccacttttttacaaggtttttgtagtccctagttttaggtaggatgtttatactcactggtggtcggatgaggagct

SEQ ID NO: 1950 - DNA, 653 bp, Homo sapiens
cttgtccaaaaactgagtgacagcattaagcagaacagtattttcaagattctaagctgtagcaagtccactgcttcaaaaggtagacaaggcattcttactcagaaaggaggatacccaggggccaaggaacacaaactgcctttatcaccacgaagctgacaagaccacagaattcaaaccctgatgtgggacgttgttcattgttgtcaaatatggaatgttggaaagaaatgtttccaggccatatctccatgtagtgtgtgacaccatctgtttaaacaagttttttcgttaggtgacctagtgttttaggttagggatgtgttatgatctcaactggctggcttgggcatgaagcaagtctcctgagccagagatctgtgctttccttgggcactttatacccaagatattctgccctttgtccctccctgaaatctccataactcccttctcttcctgagccagacgaggggcccttccattgggaagctctctcaatctggactgttccaagagtatgccaatagatggcccactttcaaagcataaactaggtacttaaacagtatgatcaattaaattactaactcatatgaaaggtcacacatgtagcctcaaaactaaaagacttgaaaaaaaaaaaaaac

SEQ ID NO: 1951 - DNA, 360 bp, Homo sapiens
gccacccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatattcaggtggatttggctgtaacttcttcgttgacaaaatggtccagatacttcacgcatctatgtggccctggatatggtttttcctggagtt

SEQ ID NO: 1952 - DNA, 102 bp, Homo sapiens
ggctctagggacttgcaggctgtttcagccaggaaggccaaatcaagagtgagatgtaggaagtcgtaaattagaaaaagtggagttgtgaatcggttgttc

SEQ ID NO: 1953 - DNA, 160 bp, Homo sapiens
gccaggtgtcttcatggggcttcagaccactcccaccttctcccttcctttgccggggacgccgaactctctcaatggtatcaacaaggctcctgtggccctctggctcctggtcaagttccagtattggggagccccaccagaagaatggagaggagga

SEQ ID NO: 1954 - DNA, 130 bp, Homo sapiens
gtggccacaaggcattcgtggcgataagggagagcccgtgaaaaggggcccagaggtcttcctggcttaaagggacacaatggattcaaggtctgcctcgtatcgctggtcaccatggtgatcaagctcg

SEQ ID NO: 1955 - DNA, 108 bp, Homo sapiens
ttcggcagtccagatcaaaaattgcggtagttggtgtgtcctcggtttctcggctgctgggtcggtcccgcccacagcttgggcggcctatgtcgagttgcgcccatg

SEQ ID NO: 1956 - DNA, 126 bp, Homo sapiens
ggcttactttcccatcaacgttgttatccaggagaatggctctcttgttgaaatccgtaaatttcttggcgtgaaaaaattacactctccagctcttccgccagtgagcaccacggctcttgcgct

SEQ ID NO: 1957 - DNA, 104 bp, Homo sapiens
cggcacgaggcctatcaagctctggttattctttctgccacacacatgccctgactaactatgctgtgccactgtcgccacccctgtacattgccttgtgacgt

SEQ ID NO: 1958 - DNA, 103 bp, Homo sapiens
ggatttttgggtaccgcacgctactgctactgactcaccgctgttcagttcatagcagacgaacaaacgtaggtcaacgaacgcaacacacgaaacaacaaat

SEQ ID NO: 1959 - DNA, 505 bp, Homo sapiens
ggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcacaattgcagatgcttaagtcaactatttaataaattgatgaccaagttgttaaaaaaaaaaaaaaaaaaac

SEQ ID NO: 1960 - DNA, 108 bp, Homo sapiens
gctggggctgccacctcgctattcccgcataagcatctgcccccaacccctttgaccttcatctgatggacatttttatacagaaacacattaaagatttccctctca

SEQ ID NO: 1961 - DNA, 240 bp, Homo sapiens
caaacttttacccttaaaatctctgactctggaaaaactagagaaaatgcatcaagcagcacagaatacaattcgccaacaagaaatggcagaaaaggatcaacggcaaataacccactgaatgataactgagcactttagggacaacctgccttatctactatttacaataactagaaaatatgcttctgtgtctgaaagtagtatgtgttatcaataaaattgatagtattcatagga

SEQ ID NO: 1962 - DNA, 251 bp, Homo sapiens
taccacatttgcaaaatgaaatataaaaatcatatgagcatctcaacagaggcagaaaaagcatttaacaaaattcaacattttttcataataaaagctgtcaacaagttgggtatagatgtatacctcaacataataaaggtcatatataacaagcccacctctaacatttactcaatagtggggagctgaattctttttctctaagatcaggaacaacacaagggtgccccctctcaccccttcttttc

SEQ ID NO: 1963 - DNA, 266 bp, Homo sapiens
ctcagtcctagctctggcttgagctatcccattctctgagttttggctcatttttaggactcagctggaaggtcattaacttttgcttcttcaccttgatagattaactttgtgattaatttggcttatgatagtgtttcctgtggttccatcagggctttctggcaggcaaacatggatgagcagaccaaggactttgttttaattccgtttagcccgacttttattgattccccacaaacaaccaccttcccacttcttaaagk

SEQ ID NO: 1964 - DNA, 576 bp, Homo sapiens
ctcagtcctagctctggcttgagctatcccattctctgagttttggctcatttttagaactcagctggaaggtcattaacttttgcttcttcaccttgatagattaactttgtgattaatttggcttatgatagtgtttcctgtggttcccatcagggactttctggcaggcaaacatggatgagcagaccaaggactttgttttaattccgtttagcccgacttttattgattccccacaaacaccaccttcccacttcttaaagtctgctacagattccattatgcagaacctgctgtccctggccactgcaggtgtgttgctgcctgatcctccccctctccactggaaccttcctgtcctggtgctcaccccttcagggtcacatccttcctgcctttcaaggtgaaaactatattaaagcagtagccagaggcaatctccagggtcttctctcccactccagggttacagcatcttaacactgacttcctgaagtctctttcccttttttatgaaaaccagaagaatgattttcataaaatcagagggataaataagacaaacaacaacaa

SEQ ID NO: 1965 - DNA, 303 bp, Homo sapiens
ttcctgtgcagtagctcccgttgcggcggcacccgtggcagccctggcggacgaggagcaatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgggggggggccagccacccacacacagcggggtgttcccgat

SEQ ID NO: 1966 - DNA, 302 bp, Homo sapiens
attaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatgggaatagctttagtgaattaaatttagtcgagcatagaggacaaagtaaaagtagtgttttcccggaag

SEQ ID NO: 1967 - DNA, 108 bp, Homo sapiens
caccgacgcatacacctagcaacatgccatgagagagctagtataggaacggtcgtagatagatagaccaggtaatgtaaagagaccacagagagcaggcgacccgag

SEQ ID NO: 1968 - DNA, 728 bp, Homo sapiens
actccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattagaaagcgttcaagctcaacaaccactacctaaaaaatcccaaacatataactggaactcctcaacacccaatttgggccaatctatcaaccctatagaaggaactaaatgttaggtataagttaccatggaaaaacaatttctcctccgcaataaagcctggcgtcagatttaaaacactggaactggacaatttaacaagcccaattatctacaatcaaacca

SEQ ID NO: 1969 - DNA, 114 bp, Homo sapiens
ctcaacttcttctgaaacaaggcccttcacacatttcatgggtgagattgagcagaacagggcttcccaagttgccagaaagattcttggtagaagcattgcagagcttttcca

SEQ ID NO: 1970 - DNA, 156 bp, Homo sapiens
ctcgtgcaattcggcagttgggaccactttggttagcttttttgcgtgtggcagtttcaagttattagtttttaaagttcagtactttataatggaacaacttgaccaaaaatttgtcacagaattttgagacccattaaaaaggttaaatgagga

SEQ ID NO: 1971 - DNA, 206 bp, Homo sapiens
acggcatcctgtgctgtgggggctacgaggaaagatctaattatcatggacctgcgacagtttcttatgtgcctgtccctgtgcacagcctttggcttgaggaaacccacagaaaagagggacgtgtacatcatgaggcctcagctcagtgacaaggttcacaatgatgctcagaggttggattatgaccatgatgccttcttcgg

SEQ ID NO: 1972 - DNA, 245 bp, Homo sapiens
ctcgatttcttcttggtgagtccatgggaacagccccactgcaaacaacccattcctgctctcctcttttcctctaaacctcaacctcctcctacctggcagtccacaggcctacagcttctcctcagttggaaagacatcagcttggaaaaccacttggaaagccaacgttatcctagaaaagctttttaaatgacccagcaggacaagtctccggatggccttgcaacccggtgcttccctct

SEQ ID NO: 1973 - DNA, 185 bp, Homo sapiens
tcggccacctaaacatccagccagactgttggactcaggcagaacacgttgctggagaacttcaatgctgcagccagtttaatatatgtagaggggtgacttccaggaatggctacccacttgccttcatgcgcctgctggccaactatgcctctcagaacatcacctaccactgcaaggacagc

SEQ ID NO: 1974 - DNA, 353 bp, Homo sapiens
cggcacatcaggtagccagatggtgcatacagtacatccagggctgtggagaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatatagggttcgtgttcgccgtggtggccgaaaacgcccagttcctaagggtgcaacttacggcaaggcctgtccataatggtgttaaccagcctaaaggtttgctcgaggccttcagtcccttccaggggagcgcgctggacgccactttggggt

SEQ ID NO: 1975 - DNA, 239 bp, Homo sapiens
tctgtaagatggatggccagtgcaagcgtgacttgaagtgttgcatgggcatgtgtgggaaatcctgcgtttcccctgtgaaagcttgattcctgccatatggaggaggctctggagtcctcctctgtgtggtccaggtcctttccaccctagagacttggctccaccactcatatcctcctttggggaaaggcttggcacacagcagggttttcaaggggttccaccttgatcaatga

SEQ ID NO: 1976 - DNA, 129 bp, Homo sapiens
tatttacttagagagagctcgagccagaacagaggtagattttgcacagaaagagaatttggttcgggcagccaagattactagaagcttgacttcaaatttcaaaactaagcgtttcttagcctaggc

SEQ ID NO: 1977 - DNA, 282 bp, Homo sapiens
tgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaaa

SEQ ID NO: 1978 - DNA, 268 bp, Homo sapiens
cgctwgtttcakgaagaagtgaatwttstttcagatattgagcctagagctactgatgttacctgaatcaagatgttcttttcacawttttttaaagggctagtatgttccagagtrggcaagtagtcattcaagccaaatgaaagagttaactggtccttgaggagtgttagcaaaagtcaaattttgaccctggccatttgttctacagagtgattatggggttaaagaatacataatacagggtttggggttgggctcttttttt

SEQ ID NO: 1979 - DNA, 335 bp, Homo sapiens
tttggtcgatggaccttgcactcaagtgaggagacaggccatgctttcaagtgcatgcagctcactgatttcattctcaaggtttccgcacagtgcccaccagaagtatgtcccacaagcctggcagaaggcagacatcaatacaaaattggcagccacacggttgggccaagaagatttaagccagagaaaggaaagccaagatgacagattttgatcgttttaaagttatttaaggcaaagaaattgagggacagataatcaaggatgagtcagagctcaaaggcagctctctgaaagctctcccaaaaagcaccycgtctaagggactctgc

SEQ ID NO: 1980 - DNA, 111 bp, Homo sapiens
caaccaagaccagtacttccatctcagtcactctaggactctgcactgaatggctgacctgacctgatgtccattcatcccaccctctcacagttcggacttttcctcccc

SEQ ID NO: 1981 - DNA, 233 bp, Homo sapiens
taacactgaagttctagcttaagtgttgaaacttttgttggaaaaaaaatcacttttgaaactcagacttcagtgtatacccaataatttaaaattatgtgaaatgttttaaatttgtgaactcgtaattactgttttaatgattcaggttctccagagtggtaaattgtataaaattgctattgcagctttatattcaatatgatgtgccyctaaaccaaggggttttcccc

SEQ ID NO: 1982 - DNA, 118 bp, Homo sapiens
aaggcaagatccagataggaggcatcctccttatcagcagagttgatcttgctgggaaacagctggagatggacgaccctgtcttactacaacatccagatagagtcactctgcactt

SEQ ID NO: 1983 - DNA, 165 bp, Homo sapiens
atcaactggcttgataagaatcagactgctgagaaggaagaagtggaacagcaacagaaagagctggtagaaagtttgcaacctcatcatcaccaagctgtaccagagtgcaggaggcagtgtcagtgaggattgcctcggggagtttctcgtggtcgagctcct

SEQ ID NO: 1984 - DNA, 133 bp, Homo sapiens
tcttggaccatactcaacaaaggaaaacaatggtcaatagataaaacgtcctagcaaaaaaccaccctcaccagtggagtactcgtgaaacaaacgggaataccggggtaaaaacaaccaggagggcggccag

SEQ ID NO: 1985 - DNA, 500 bp, Homo sapiens
cagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacaagacacggtagaagacccgcccattttggaatgtgaccgtctgtccttcaggagaaggacaccaagggtgggggtgaaggagacactactggccccaacccctgacaggccccaaccccatggcttccatccttttgcaatcaacaacca

SEQ ID NO: 1986 - DNA, 152 bp, Homo sapiens
aggaggccaagatagcaacttccttcggtcgtcccgaatccggattcatccgacaacaagccggcctccaccatgccgccgaagttcgaccccaaccgagatcaaagtcgtataccttaggtgcaccgccaggccggtcgggtgccacttct

SEQ ID NO: 1987 - DNA, 305 bp, Homo sapiens
ttgtgggaaggagcatggggaacaaatgctaaagggtatgtgatttctttttgtggtgatgagaatgttctaaaattaggtagtggtgatggttatacaactctgtactagaaaccacggaccttatccttttaggataaattttatggcgtgggcattatatctgaataaagctgctactaaaataaaaaggaaaaatacacctaatagtagcataaattacctagttaagtcattttcagaatggagtttatgtagtaaaagtacgtcgcattctggcttctgtattggcgcatactgtagag

SEQ ID NO: 1988 - DNA, 235 bp, Homo sapiens
aaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagacatgttagaagaagcaaagaaaaatttgcaagaggaaatttgacgccttagaatccagagtggattcaattcagcgagttttagcagatttcaaag

SEQ ID NO: 1989 - DNA, 235 bp, Homo sapiens
tgggtgagagaggacatccctgtcttgtgccagttttcaaagggaatgcttccagttttttgcccattcagtatgatattggctgtggggttgtcatagatacctcttattattttgagatacggcccatcaataccaaatttattgagagtttttagcatgaagcgttgttgaattttgtacaaggccttttctgcatctattgagataatcatgtggttttgtcttgggtccc

SEQ ID NO: 1990 - DNA, 300 bp, Homo sapiens
ggaaagggaccctcccatcattcatggggggctgctacctgacccttgggcctgagaaggctttgggggggtggggtttgtccacagagctgctggagcagacccaagagccagtcttgaccgggatgaggcccacagacaggttgtcatcagcttgtcccattcaggccaccgagctcaccacagacacagtggagccgcgctcttctccagttacacgtggacaaatgcgggctcatcagcccccccagagagggtaaggccgaacccagttctcctcctcttaggtattttcagcaa

SEQ ID NO: 1991 - DNA, 107 bp, Homo sapiens
agatgaactaagaggaatatataagataaaggatagagataggagaggaaaaaaattaataagcgtattagatgctaagcctaaacgagactggaagaagttactta

SEQ ID NO: 1992 - DNA, 500 bp, Homo sapiens
agactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaa

SEQ ID NO: 1993 - DNA, 179 bp, Homo sapiens
gtcgccccaagtggcccagagtcgtgacagtccggagggctggtgtggccggtgggcgctgcctcttcatctgatggagccaggaggtccgccagtgggggaaaggcttcttccgaggcttctgcactcgcctggggagaggcccagtcactacaggaccctgagatgtccagaccctt

SEQ ID NO: 1994 - DNA, 129 bp, Homo sapiens
gtttctttttcctaaaacggttttatttaactcaatgtgtcaaagtttttttttaataatcccaagagggatgaagccgtgtccacagggatatatacatcattatggttcccatctttcatacatgaa

SEQ ID NO: 1995 - DNA, 167 bp, Homo sapiens
cctggacgaccacacgcagaccctctttcaggcgaacctcttcccggccgctctggtgcacttgggagccgaggagccggcaggtgtctacctggagcctggccttctggagcatgccatctccccatctgcggccgatgttcttgtggccaggtacatgtcccagg

SEQ ID NO: 1996 - DNA, 133 bp, Homo sapiens
gtcaactataagattttggatcgggagaaccgaagatatctatcatcatcaactcttctgctccaccccacactatactgaatgaacttaggccagaacaaggtagaacagctaaagcttatcatgagcaaac

SEQ ID NO: 1997 - DNA, 103 bp, Homo sapiens
gggaactgtgtaagaaacgtgtcagacttctgccatcagccagctaaggctttgtgatgtactttgaaagaatattgatgcttcacagatatggaaatagggt

SEQ ID NO: 1998 - DNA, 215 bp, Homo sapiens
ttctcccagggcctggatgactatggagcgcggtccatgagcagtggcagcggcacgtggttgttcacagtgtgaggacgctgaccccgggcagccgctgctctgaagagcttccgcgccttccccctggtctcgtccgttttcctcctcagctctcgctggtttgttcttgggatgttttccttttccccctagccatgccttttggttggtac

SEQ ID NO: 1999 - DNA, 140 bp, Homo sapiens
gttaggatgttgctttctttttccattagttaaacatttttttctctttggaggaagggaatgaaacatttatggcctcaagatactatacatttaaagcaccccaatgtctctctttttttttttttactccccttgct

SEQ ID NO: 2000 - DNA, 110 bp, Homo sapiens
ggcaccctctggatggaccagctctgcaccggctgcatgaagaccccttccttggtgacatggcccacatacgctgagggcacctttattgtctggggacaggacctcag

SEQ ID NO: 2001 - DNA, 230 bp, Homo sapiens
  misc_feature 35: n = A,T,C or G
tcgtccaattcggcaggggttctattttatatgtnatcatccttttaatcttaaaaaaaaatctcatgagatagtacttatgaataccattttacagatgagaaaactaagacaaagaaggggcttaataacttgcacagggtcacacaacccagtaggtattgattatgatgctcagtaaatgatgcaaggatgataacgatttgagacaattagaaaggtacccattc

SEQ ID NO: 2002 - DNA, 449 bp, Homo sapiens
ctcgtgccgaattcggcacgaggttctattttatatgtaatcatccttttaatcttaaaaaaaaatctcatgagataggtattatgaataccattttacagatgagaaaactaagacaaagaaggggcttaataacttgcacagggtcacacaaccaagtagatattgattatgaatgctcagtaaatgatgcaaggatgataacgattggagacaattagaaagtgtacctattcagagtatttgattgtggaaggttggaagtgaataacatatctgagaaaataagcatcactccccgacaatgtcaggtaaatgaggtcttgactttgactccacagaaatttatctagcagccaaattggctgttaattgaaaatggatctgggaagagggcgtcaaaggcatagagaataacaatttatcacataaaaaaaaaaaaaaaaaaa

SEQ ID NO: 2003 - DNA, 221 bp, Homo sapiens
cggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctttggggatcttgcactttggttcccgcattaagacaaaagctggccgg

SEQ ID NO: 2004 - DNA, 186 bp, Homo sapiens
aagaggaccacacatctttttggtcacagagttcatgtcacaccagtgctagaagtttcatgattttatttcccagcagttctgatgacaagacttaatgttaccttttctttctgacagattttaaaaattgatattataaagcacaacttctataggttcttcctgagacccctcataggaggg

SEQ ID NO: 2005 - DNA, 180 bp, Homo sapiens
  misc_feature 44: n = A,T,C or G
cacgagctgtgacgggcaccagcggcctgattccagggaagagntcctggagggtgttggctgtttttgttagctcagtttttttctgggctccaccattccttactccaggtagacaagatagatgtcacacacaacaattttaaaggatttttgcttagggcatttggtttaatgatt

SEQ ID NO: 2006 - DNA, 200 bp, Homo sapiens
tttcctacctgaggcttcacttgcctcactgtgtttcttacctcagcgttcctagtagcacagtttggaaagggatgaggtagaaaagctaccctttttggcattctttgctgtaatcctgtgtgggtgtttcaaagagggccgtctgcctttttggagggaggggggtcccaaccaatttggatgcttctttggctaat

SEQ ID NO: 2007 - DNA, 380 bp, Homo sapiens
gtttcctacctgaggcttcacttgcctcactgtgtttcttacctcagcgttcctagtagcacagtttggaaagggatgaggtagaaaaagctaccctttttggcattctttgctgtaatcctgtgtgggtgtttcaaagagggccgtctgccttttggagggaggggggtcccagccatgtgggatgcttctttggctattttgcctctgggagttggagcccagagaggagagcttgaggggaccaaagcctcccgcgctgcgtccgctctgccaaactcctgccaaattccaagatctgaggaaagtttattcatcttgctttctcaggggagccctgatttctcttatcccaggtcctagcatcctcatctgggggc

SEQ ID NO: 2008 - DNA, 170 bp, Homo sapiens
gattctgagaatgaacctctcatggatgtgatgagaattcagaccatgttatggagaaatggattcgtgagagatgagcgactcaggcattaactcttgaaaccatattgaattggctgatggcaagtcaggaagatccttttctacagcagttacagaaaacttcagct

SEQ ID NO: 2009 - DNA, 104 bp, Homo sapiens
ggggggacgggtcagaccgcgaaggtgaaaatgacgagggtcagaccgtgagctaccggctagcagatcgagcaacgaggtgaagtgttgcaagagcaagtggt

SEQ ID NO: 2010 - DNA, 470 bp, Homo sapiens
ctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataaggaatgttaaacagctttggaaatacatgcatcctatgaatcatagccttatttagcaagatcaatgttaaagtgttgttatatggcaagtatttaacacattcacagtgtttgtttgatttcaactgtgaattgtcttaca

SEQ ID NO: 2011 - DNA, 155 bp, Homo sapiens
ttttaatctaagcattttcccccgtttctcatattttaaccatatgttcgtgtagataactaaacagtatgatctggttggcattttctttcctgatgatgggagcgtcattcttttgtcttcattggtacttgtgtgaatataacatacatctg

SEQ ID NO: 2012 - DNA, 201 bp, Homo sapiens
aggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcactctaactt

SEQ ID NO: 2013 - DNA, 315 bp, Homo sapiens
actcctgacctcaggtcatccgcctgcctcggcctcccaaagtcctgggattacaggcataagccaccgtgcccagccttgttcttgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttgggccctaacctcaattgtttgcatgctattaagaggacagatggacatttgtgatgtgtcagacaatttgaatctg

SEQ ID NO: 2014 - DNA, 270 bp, Homo sapiens
gtaaccagggattttcccattatgttcccttttataccatttaggtgtgagttccttagcttctgcctataggaacataagtaatgaaaggtcatctaggtgtgtgtttggaattttttccttttgttttttggaaaatggaaagaacaaggcaaggaaggaaaattaatggggagctgaagggaggaaatgttacagtaatccactgagatgtagtttagtcaaacataggtatatgacgctgttaatctggggggatccgtgggattt

SEQ ID NO: 2015 - DNA, 240 bp, Homo sapiens
cggcggccgttgcgattgattgcgctggttgcctgcggcgtccacttccttggccggccttgctacaatggctgattgttgtgcagccggcgccatgtctttaagccagatcttcgtggagctgcagggctttttggctgccgagcaggacatccgagaggaaatcagaaaagttgtacagagtttagcacaaacagctcgagagattttaactctctgcaaggtgtccatcaggctgct

SEQ ID NO: 2016 - DNA, 100 bp, Homo sapiens
gaagctagctcgttgggtagcctacttcatcggcgactgaccgcgtcggcagcgcagcctcactgccgcgccatggcctctgtccgagctgcctcatcta

SEQ ID NO: 2017 - DNA, 440 bp, Homo sapiens
ggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggccttggtctttttgactaaacctc

SEQ ID NO: 2018 - DNA, 342 bp, Homo sapiens
agcagccccacctcagagactgcacaagagaaagactcctggccccatgttcccttcctccagccctatgtggggtctgcaggtcacaccctgagatctcggccacctcccccaggcccctgttggaccagtgctgctccggaatctccatctctgtcctctcagagggggagctttggtgatttctgaacctattcttgtttaatggagcatttttagtgttactactagattcacacttgagagcatgtctaaaaggcttttacaagaggctcagaccacaccgaaagatcttccttggaggcagttcaaagaggcagattaacaacacgacggtaccaa

SEQ ID NO: 2019 - DNA, 192 bp, Homo sapiens
cacgagcatatttcacctccgctaccataatcatcggtatccccaccggcgtcaaagtatttagctgactcggcacactccacggaagcaatatgaaatgatctgctggcagtgctctgagccctaggattgcatctttcttttgaaccgtggggccctgaactggcattgtattagcaaactcatcactgg

SEQ ID NO: 2020 - DNA, 299 bp, Homo sapiens
gacactagtggatccaaagaattcggcacgaggttcaagaagctcagaggtcaccaagcaggatgaaagcaagatgaacacatgaaaacccactcgggtgcataccggtcagaactcctgcaaaccgagcacagaggaggttttggaggtggccagaagaagatgcatcaggtacaaaaagaaagatgtyagccgcaaggttctcgtcagaaagcctagaacaaacagggtttttcttcggtgctgtaattaagaagtcaccaggagtaaaaggaaacataaccttgtcaagagaggcg

SEQ ID NO: 2021 - DNA, 288 bp, Homo sapiens
gttcaagaagctcagaggtcaccaagcaggatgaaagcaagatgaacacatgaaaacccactcgggtgcataccggtcagaactcctgcaaaccgagcacagaggaagtgttggaggtggccagaagaagatgcatcaggtacaaaaagaaagatgtcagccgcaaggttctcgtcagaaagcctagaacaaacagggtttttcttcggtgctgtaattaagaagtcaacaggaagtaaaaggaaaacataaaccttgtcaagagaaggcgaaaaaaaaaaaaaaaaa

SEQ ID NO: 2022 - DNA, 295 bp, Homo sapiens
gtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgcaaggacattaagaaatggaaggtcactatgttcatgctgggcacatcattgcacacagcgccatttccgctggcacccaggtcccatgtggttttgggagattaatttctttatgcctggagagggatactccctcatagggggtttacg

SEQ ID NO: 2023 - DNA, 250 bp, Homo sapiens
gtcctgctagagaaactgcagatggaagctgagcagttaccaactgctaatgtgccaagtataccaagcacagcatgtgtcctgtagaggggcattattttaaacaatgttctactatcatctaccaaaataattgtggtaaaggtgtagtattttattttttccttttatgtcagcaatattttaaaatattgatctgtttatcttatatttttagggataaatgtggtatttgcctcagaattgtggg

SEQ ID NO: 2024 - DNA, 280 bp, Homo sapiens
cagaagcggcgtcaacggcaccctcggaggagccgccccagcacagcccactgagaagagcttccaggacgaacccaggacgctaagcccaggagcctgcaggctgacgtgcatccacccagacggtgtcctcttcttgtcgctttttgtaatataaggaatcccattaaggagggaaaaaataaatcccacatttgtgtatgcacccactcacccttccaaatcagcaaaccgcatctaatttgtccgccgatgccaagcaaggaaactttttataccc

SEQ ID NO: 2025 - DNA, 102 bp, Homo sapiens
cagcaaaaaggaaagttaactaaaaaaaaggccgcgtgacctattcacctccacttcccgtctgcagaatgctgaaacgtgcgtcaccttgcgagtagagag

SEQ ID NO: 2026 - DNA, 105 bp, Homo sapiens
ccattttttgaacctctgcgccatgagagccaagtggaggaagaagccgattcgctaggctgaagcgcaaaaggtaggctaggatgaggcagaggttcaagttaa

SEQ ID NO: 2027 - DNA, 175 bp, Homo sapiens
ggcggcaggcgccatgtccggccgcgaaggtggcaagaagaagccactgaaacatgcccaagaagcaggccaaggagatggacgaggaagataaggctttcaagcagaaacaaaaagaggagcagaagaaactcgaggagctaaaagcgaaggcccgcggggaaggggccctcgc

SEQ ID NO: 2028 - DNA, 180 bp, Homo sapiens
tatgcatatacgaaaagccacgaagtatctgaaagatgtcactttacagaaacagtgtgtaccattccgacgttacaatggtggagttggcaggtgtgcgcaggccaagcaatgggggctggacacaaggtcggtggcccaaaaagagtgctgaatttttgctgcacatrcttaaaaacg

SEQ ID NO: 2029 - DNA, 180 bp, Homo sapiens
tcgcatcaggagtatcaatcacctgagctcaccatagtctaatagaaaacaaccgaaaaccaaaataattcaagcactgcttattacaattttactgggtctctattttaccctcctacaagcctcagagtacttcgagtctcccttcaccatttccgacggcatctacggctcaacata

SEQ ID NO: 2030 - DNA, 175 bp, Homo sapiens
tcgtgccgaatcctcacagccgtgactccttatattgctactgctgggttgggaccttggcttgtcaagactaagtagtcagcccgcaccaccccaaaaacaaaaccaagcaaagaccacatacagattccatttataggaaatgtcccaaataggcaaatctatatagacagaa

SEQ ID NO: 2031 - DNA, 117 bp, Homo sapiens
gagtggctatatccaggagcagtgttcggacgattcaagtacataattagcatagactaaacgggagatgaggtagcgagcataatatgtattattattcagatgggaaaagttagt

SEQ ID NO: 2032 - DNA, 430 bp, Homo sapiens
tggctatatgtaggcacagagctgggccatccaagtccgactttgccaaagcctcacggtagatgggggcaggccttattagttctgctttgtagatgggaaagtgagtctgggagctgggaagggactggccagaactgcccaggtgaccgcagtgcctggaggcgagccaggtgctgccggggtctgcatgcctgccccggggagccacgtcctcacacctgcccccttggcctgcaccccaggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtaccttggtgctcggtgacatcatctt

SEQ ID NO: 2033 - DNA, 176 bp, Homo sapiens
agggctacaggccccatgcaagtttgaaatccaatagggcagtcattaaaggagatccaaaatcatctcctttgactccatgtctcacgtccatgtcacgctgatgcaagagggggggtctcacagctttgagacagctctgccctgtcgctttgcagtttacaggcccccctccc

SEQ ID NO: 2034 - DNA, 111 bp, Homo sapiens
tgtcacactagcatagagaatgtgttgaaatttaactttgtaagcttgtatgtggttgttgatcttttttttccttacagacacccataataaaatatcatattaaaattc

SEQ ID NO: 2035 - DNA, 176 bp, Homo sapiens
gcctaatgaaggttgagaaccgtaggagaggctctcatgctgtaaataatgttgcaggctaataaccttttcatcacttccttttgtgcgcttcctgccttaagtgacaagtagcaacatggcttgggttccctgtgcagcatcagcttatgctgccacaagtcaagtttgcaccc

SEQ ID NO: 2036 - DNA, 197 bp, Homo sapiens
tttttctaaaggtgctatttaacatgggaggagagcgtgtgcggctccagcccagcccgctgctcactttccaccctctcttcacctgcctctggcttctcaggcctctgtctctccgaacctctcttctctaaaaacccttctcacaggctgaaggcccattctcccggctcccttcatgtctgttctgcgttcct

SEQ ID NO: 2037 - DNA, 184 bp, Homo sapiens
aaaaaggatagtctcttttcttactctggcaaaccttgttgagttgattccacaaagatacagtattacttaggctatctgaattattgatagaaaagggtcctgttaggttcctatataaaggcattttggagatgaccttggtgcccttgaaccttgaaaatagggattctgggggttagga

SEQ ID NO: 2038 - DNA, 187 bp, Homo sapiens
ccactgtggaagtccctcagaggccttggggcatgacccagttgaagatgcaggtttgaccagggaagcagcgctaggttggagggtttgaggaggaagttaaggattgaggggttcatcattcctcccctgccttaaagggaggctaaaggcattgcccttctgtccccttcccttccttcaacca

SEQ ID NO: 2039 - DNA, 110 bp, Homo sapiens
ccggaggggctctgccgttctgtagtggcgctgcttgggcccgtgcgattgtaagctgcttggtttgccggctggaagaccgccagagagggttccggcaatttttcgtc

SEQ ID NO: 2040 - DNA, 163 bp, Homo sapiens
ttttggtccagggtaaaaggattgagagttcctttccacacttgttggccttcgggttgttgggattaacttgttggtggggcctcactctaggtcaatccacttggtcaaggttggtccaaggttcttggcctagagacaagggccaaggcttgaagcaggc

SEQ ID NO: 2041 - DNA, 580 bp, Homo sapiens
aaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcaagtttcttccccacaaaatttggaatcaaagcttttatgacgtttgccaattgcagaacttcttcagctaaggttaatttgacgctatgataaaactgagagatgtcaaaaagcctcctagaaattttaatcttgaaaagacttttcagggtatctcattttttaggtgggggtggcaggtgtatttcctttttaacaaataaaaaggcatttaagtaaaactaaaatgaaaaaggtaggccttctgacattgtgtacttggtg

SEQ ID NO: 2042 - DNA, 137 bp, Homo sapiens
ccgagctgacgcaaacatgcagatctttgtgaagaccctcaatggcaaaaccatcaaccttgaggtcgagcccagttgcaaccattaggatgtcaaagccaaaattcaaggcaaggagggtattccaacttacccgc

SEQ ID NO: 2043 - DNA, 201 bp, Homo sapiens
atgagtctctttctccaggaaacattttctgatttctgctctcccatttgactgcttatttatgccttcttagcatttatcaaatcatattgaaaacaagtttcaaggattgtctgcctcagtagccaatacattgttagagagttctcaatttctctcacatgatagctcaataaatgtgttcctaaatgggtgaactca

SEQ ID NO: 2044 - DNA, 470 bp, Homo sapiens
atgagtctctttctccaggaaacattttctgatttctgctctcccatttgactgcttatttatgccttcttagcatttatcaaatcatattgaaaacatgttcaaggattgtctgcctcagtagccaatacattgttagaggttctcattttctatcacatgatagctcaataaatgtttcctaaatggttgaactcaactggttttcattatggatctgttagcttctaatatgggtaggcaaagggacagaaagaaaataaggctgctgctgttataattagtgttgactcatattagaccttgataggtgtatcttaaaaccttaaaaacagattaaattgggctattaaagtatctatgtctgtggtgggggcaggggtagtagtagtgttagaggagatgagatagtgattgatggctgatgggagaaatgtggtaggaagcacaagatcacactaaaattatcc

SEQ ID NO: 2045 - DNA, 204 bp, Homo sapiens
caggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtgtgtgtgccaggcagacttcgagggggttcgtcttttaagacctaaagttctta

SEQ ID NO: 2046 - DNA, 110 bp, Homo sapiens
cagatttctatttttttttcttataagttcgttgtgtctagagattgttaatattgtaatttaatgtagacttactttgaataaaattagtttaattggccttaaaaaaa

SEQ ID NO: 2047 - DNA, 190 bp, Homo sapiens
gacagctcttcagcccagtagcagttggagcaggccgtgtcctgccctcccagcaataaccacctcctggaggccagctgagatgccttgctacttggcaccagggacttcctgacacacagtcaatttaattctcaaggggcctgtggctgagaaaaggtgccagcccaacacactctaagctgccccc

SEQ ID NO: 2048 - DNA, 180 bp, Homo sapiens
gaaaggatgtattcctaaacacatataacctactaagactaaatcataaaggaaaaggaaatctgggccggcaatggtggctcatgcctttaaatcccaggactttgggaaggccaagccacgcagagatgacctaaggtaagagtgttcaaaacccagcctggcccaatatggatagaa

SEQ ID NO: 2049 - DNA, 200 bp, Homo sapiens
aaatatttgaatgtgccaggctctgaggtgggtgctggaaatgctgccagcagcaccacccatcctctcctcgagggaaatttcagtgcaaccaaatatttgaaaccacacagtaagcccaggttgccctgaccacacaagggagggcactggtattggttcattctcatactcctataaggagctatctgacactggga

SEQ ID NO: 2050 - DNA, 510 bp, Homo sapiens
aaatatttgaatgtgccaggctctgaggtgggtgctggaaatgctgccagcagcaccacccatcctctccctcgaggaaatttcagtgcaacaaatatttgaaaaccacagtaagcccaggatgccctgaccacacaaaggaaggcacttgtattagttcattctcatacttctataaagagctatctgaaactgggaaatttataaagaaaagaggtttaattggctcacagttcctcagactgtgcaggaagcatggctaggaggcctcaggaaatttacgatcatggcagaaggtgaaggggaagcaggcatgtcctacatggctggagcaggaagaagagagccaagagggaggggccacacatttttaaacaaccagatctcatgagaactcacacactatcacaagaatagcaaaggggaagtccacccccatgatccagtcacctccaaccaggccccttctccaacaatggggattacagttccacattgagattttgagca

SEQ ID NO: 2051 - DNA, 115 bp, Homo sapiens
ccggcgagttcgtggacctgtacgtgccgcggaatgctccgctagcaatcgcatcatcggtgccaaggaccacggcatccatccagtgaaccgtggccgaggtagttcagatgat

SEQ ID NO: 2052 - DNA, 190 bp, Homo sapiens
tccaaccccccagcactgaggaagaacggggctcttctcatttcacccctccctttcttcccctgcccccaggacttggccacttcttggttggggcagttgggtcccaagatttggctcacacttagagaattgtaaggacctcaaaccaaaaatttctatttaaattaaattttgtgcttcaaaaaaa

SEQ ID NO: 2053 - DNA, 150 bp, Homo sapiens
aaagtttctcagctgctaagaatttccccactgtttacttctttcacttatgttgtattgcattaaggttaccaaattttaagggtttattttgtatcaattacccaaaccattaaattggctcttaattcaatgtgtgtccttggaggg

SEQ ID NO: 2054 - DNA, 115 bp, Homo sapiens
aataaatgagttggtcttagcacaatgtttctttttttgaaataggttctttgaaggtttaatgttggcctaaatcttatattccctacggtaatatattaattactcttctcga

SEQ ID NO: 2055 - DNA, 270 bp, Homo sapiens
aataaatgagtggtctgagcacatgtttctttttttgaaatagtttctttgaagttttattgtggacttaaatctaatatccctgacgtaatatttattgactttctaggcatcattcattcattcaacaaatgtttctgagtgcttgtcagattctaccactaaggttgctgtactgaacatgacttataaggtgcctgtgctcagcaagcttaccttctagtgaggactaaacagaaaccagacaagtgaacagggtttaaatttatg

SEQ ID NO: 2056 - DNA, 231 bp, Homo sapiens
caataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatttcgggtagatgacaaggtgaatttccattttattctgtttaacaaccgtggatggcacctctattaacttgatga

SEQ ID NO: 2057 - DNA, 185 bp, Homo sapiens
ctcgggggtgggctccggcacccacatcctggagtcaggactttcctcagtgacttgtgtgtagggggggtttcagggctgaaccccaacttccctccacctttcttccaacttaactgttggaaccacctgtgaaaggttgggattatggtggtctccttggcttagggctcctgctctccaag

SEQ ID NO: 2058 - DNA, 151 bp, Homo sapiens
ttcctttgtcctttttcaggagaattagatttctataggattttctttaggagatttatttttttggacttcaaagcaagcttggtattttcatacaaaattcttctaattgctgtgtgcaggttccgatgtaattagatgttacagttta

SEQ ID NO: 2059 - DNA, 146 bp, Homo sapiens
agatggcggactgccgcgtgctccgtagctggtcaagaggggtcatccgactacggccgtgaaggatccgaggtgaaggcctgacaaggacccggtgttggtcaacggatgggtgttaaggcacttccaatgaacccccttcctgt

SEQ ID NO: 2060 - DNA, 610 bp, Homo sapiens
cggcacgagagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgcctgcccaacatcatga

SEQ ID NO: 2061 - DNA, 230 bp, Homo sapiens
caaaactatttaatgaatgttagttctgtttagcaaccattagttgctgacaatagatttaggttttgaggccaaatcttttgtcatctagacaagattcctaagtcaggctcttccggtcacataaaataatatttgctgacaaacaccaaaacacaatttactttttgacatcaggaatcatattcagtgttctggaggcctatgcttacatgtctacccaattacct

SEQ ID NO: 2062 - DNA, 480 bp, Homo sapiens
caaaactatttaatgaatgttagttctgtttagcaaccattagttgctgacaatagatttaggttttgaggccaaatcttttgtcatctagacatgattcctaagtcaggctcttccggtcacataaaataatatttttgaaaaaaaccaaaacacaatttactttttaacatcaagaatcatattcagtgttctggaggcctatgcttacatgcctacccaaattacctaacaaaaccatggggacccactaggtgcctttgaattagcttagttaggttacatctgggaagaaaatcattaaaagctgttctattgatatgcagattttaataattagcaaaagtctgttactttaaatagtgaaaaatttttgggtggagttgtatgttttaagattgagacagtggtaatattattgaaataatttgaagaatatgaacattagttttcttcaggaaatgaatgctcatatttctc

SEQ ID NO: 2063 - DNA, 300 bp, Homo sapiens
gctctgcagcactcttatctacataaggatgaaggtaatcccgagtgagcaatggagtgctgccatggaaggaaggaaagctgccaattcccttctggacactgagagggcaatctttgcctttatctctgaggctatggagggtcctcctccatctttctacagagattactttgctgccttaatgacattcccctcccacctctccttttgaggcttctccttctccttcccatttctctacactaagggggatgttccctcttgtcccttccctacccttatatttggggccttttt

SEQ ID NO: 2064 - DNA, 285 bp, Homo sapiens
cgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagttgttatggtgggcaaactaagccgattttccggaaaaaggctaaactacaaagaagattgtgctaaggcttgagtgcgttgagcccaactgcagatctaagagaattctggctattaaagatgcaagcattttg

SEQ ID NO: 2065 - DNA, 245 bp, Homo sapiens
ctggcacatatggtcaccttggagggcagacctaggagcccctctgaccacttgaattccgtctccacaccccttctgccaagggaagccccttcaggaaggaccccccaaagctgaggggcttgaatttagccttttcaacagagaaggctccacttgagagcagcctctaccttaccccctggaccacagagagccactcttaccctcagccccctcgctcttcagctaaactcaaaggtttg

SEQ ID NO: 2066 - DNA, 186 bp, Homo sapiens
cacctccaaactgtgccctcaaaggttgtgtataagtacctctagaacaatccccttttttccatcaagctgtagcctgcagagaatggaaacgtgggaaaggaatggtatgtggggaaatgcatcccctcagaggactgaggcatagtctctcatctgctattgaataaagaccttctatcttgt

SEQ ID NO: 2067 - DNA, 310 bp, Homo sapiens
cgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggttggaagtcacattgcagatcttaggcact

SEQ ID NO: 2068 - DNA, 205 bp, Homo sapiens
gtgaacttgaaaacttgcagactcaggggggtccctgatgcagtgcttcagatgaagaatgtggacttgaaaatacagactgggctagtccagtgtctatatttaaacttgttcttttcttttaataaagttagggtaacatctcctgaaaagctttgtagcacaaaggctcagctggggatggtgtttgacttcggaggaaaaa

SEQ ID NO: 2069 - DNA, 161 bp, Homo sapiens
aaaaatacaaaaattagctggtcgtggtggtggcacctgtaatcccagctactcgggagactgaggcaggattgcttgaacctgggcagcggaggtttcagtgagctgagatcccgccactgcattccagcctgggctacacagtgaaacatcatctcaga

SEQ ID NO: 2070 - DNA, 186 bp, Homo sapiens
ttaaaaagaaaagtgtaatgcaagaatttaaagaaatatttttaaagccacaattattttaatattggatatcaactgcttgtaaaggtgctcctcttttttcttgtcattgctggtcaagattactaatatttggggaggctttaaagacgcattgttattggtgctaatgtactttacactttw

SEQ ID NO: 2071 - DNA, 270 bp, Homo sapiens
caggctgactgtgctgtcctgattgttgctgctggtgttggtgaatttgaagctggtatctccaagaatgggaagacccagagcatgcccttctggcttacacactgggtgtgaaacactaattgtcggtgttacaaaatggattccactgagccacctacagccagaggagatatgaggaaattgttaaggaagtcagcacttacattaagacaattggctacaccccgacacagtagcatttgtgccaatttctggttggagtggtga

SEQ ID NO: 2072 - DNA, 280 bp, Homo sapiens
cttagcagaatcttgaaaagcccagagatccaaagagcccttcgagcaccacgcaagaagatccatcgcagagtcctaaagaagaacccactgaaaaacttgagaatcatgttgagctaaacccatatgcaaagaccatgcgccggaacaccattcttcgccaggccaggattcacagctccgggtggataaggcagctgctgcagcagcgccactacaagccatatcagatgagaaggcgcgttgcagacaagaagcctgtggtaggtaagaaaggaaa

SEQ ID NO: 2073 - DNA, 160 bp, Homo sapiens
ggcccgcgccccctttgtctgccttcacctcagttgatagacgcagttcacaccgcataggtggatagctctcatatttctgcataaaaatacttacttgggcgccattgccttctacttggaggagattttcagagccaaagtctcgattgaaccagcc

SEQ ID NO: 2074 - DNA, 360 bp, Homo sapiens
ggcccgcgcccccttgtctgccttcacctcagttgatagaagcagttccacaccgcataggtggaatagctctcatatttctgcataaaaatacttactgggcgccatgccttctacttggagagattttcagagccaaagtctcgattgaaaccagcctcgtgcctgcatcgcaccctaccccgcgcgggccccccgcgccggccccactgcctgagtctggggcggatcctacctggggggcctcccccgactctcagcccggctcaggctgtttctggcttgacgatgatgtgagtgtccagccgtaaattctccagcacaaaagatatttcccttgggaaaaaaaaaaaaaaaaaa

SEQ ID NO: 2075 - DNA, 145 bp, Homo sapiens
gcaaggcctgagaatctggaaagatgaaggtgatatttactgaaatggcctacactcttgaatgaatagattaggaagtcaaattgacagtcttgttattggttttataagttgagacggctatcaaacaatcaaaggaatattt

SEQ ID NO: 2076 - DNA, 404 bp, Homo sapiens
gaaaggcctgagaatctggaaagatgaaggtgatatttactgaaatggcctacactcttgaatgaatagattaggaagtaaaattgaaagtctggttatgggttttataagtttgagacgcctataaaacattcaaagaaattattaaatagtgaactggatatatgagcctgtagttcaagaaagaggtctggattaaagttatgatttggacaacatcatcatatatgtggcattagtgtcatgattccaaatgagataatccagggaataactatagagaaaagaggagaggaggataatttctggtgatatttcaatgctaagtggttgggaaaatgaagagaacacagtgaagttgaccaggatgaagtacttactgaggtggaagaatcaatggagaa

SEQ ID NO: 2077 - DNA, 200 bp, Homo sapiens
gaaaggcctgagaatctggaaagatgaaggtgatatttactgaaatggcctacactcttgaatgaatagattaggaagtaaaattgacagtctggttatgggtttataagtttgagacgcctataaaacattcaaagacattattaaatagtgaacttggatatatgagcctctaggtcaagaaagaggtcttgattaaa

SEQ ID NO: 2078 - DNA, 512 bp, Homo sapiens
aaaaaagtggcattggagactccattgtcccacatctgtaacctggggcccttagctcaagtcatcagcaaggatgagagaaggatgctgggagcagaggagaggagaaaggaaggggaccctgccagcacctgaggtgccaggctccaggccaggagctttccttgggtcatctcatctgagtctccatcatcccaagaggcagatcttacttttgccgttttgcagatgagcaaactgaggctcagaagtttaaacaaccttcccaaagtcacacagcttggaagtggtagagacagaaagaaggccagtagagagagtgactagggatgtgaggcagaggagaagtgatgggatttggcactagtctgtctccccagggggagaacctctgaggttcctccagagtacttctagagcggccgcgggcccatcgattttccacccgggtggggtaccaagtaagtgtacccaattcgccctatagtgagtcgtattacaattcactgggg

SEQ ID NO: 2079 - DNA, 170 bp, Homo sapiens
aaaaagtggcattggagactccattgtcccacatctgtaacctggggcccttagctcaagtcatcagcaaggatgagagaaggatgcttggagcagaggagaggagaaaggaaggggaccctgccagcaccttaggtgccaggcttcacggccaggagcttttcttgggt

SEQ ID NO: 2080 - DNA, 287 bp, Homo sapiens
gaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaaaaaaaaaaaaaaaa

SEQ ID NO: 2081 - DNA, 140 bp, Homo sapiens
aggctctgagctgcaggtacaagtctccagaagctcagaggctaagaaatttcctatacctgcacccactctaatagtggggaggacggttagactgttgttcaattgcattaggttagtgtaagctggtaatatacaat

SEQ ID NO: 2082 - DNA, 105 bp, Homo sapiens
cttacctagaatgcgcattatgagaccgccattatggctcatcttgcagcagacatccctctgagcaggcttctctggattcacgggctctgggactctacacac

SEQ ID NO: 2083 - DNA, 590 bp, Homo sapiens
ctgaccctcagaatggcgcatgatgaagaaccggccattcatgggctccatctcgcagcagaacatccgctcggagcagcgtcctcggatccaggagctgggggacctgtacacgcccgcccccgggagagctgagtcagggtgggccttcggtagatccccggtctgatgtttcctcaacgctcttgggaatccctccctccatcctcccacactgggtgatgtcctggggccctgggcactgagagagggaggagagagaactcctgactgggaaggcgtcctgaggccaatagggctggttggagggagaaaagggacagcacgccaggcaaagacctggcagctgtgctcagccctggaccttgttcctcctcaggcctgaaaagcctcacctgaacctgtggctggaagcccccgacctcctcttggccgaagttgacctccccaaactggatggagccctggggctgtcgctggagatcggggagaaccgcctggtgatggggggccccagcagctgtatcatctagacgcttatatcccgctgcagatcaactctcaatgagagcaaggcaagccttccaacc

SEQ ID NO: 2084 - DNA, 105 bp, Homo sapiens
gctaggtgacctcggctgctcaggatctcagacttcagccatggggccaacttgccgccgtacttggcgatgctcggttggagccaccccttcagatgccacctc

SEQ ID NO: 2085 - DNA, 425 bp, Homo sapiens
gctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggaagaagaaggcggcagagtttggccaaaaggcc

SEQ ID NO: 2086 - DNA, 140 bp, Homo sapiens
cggcagagacaagagtgtctacctggcacttggttatgttcactgcattctctagtccactttgaggtaagccataagtgaggaccattgtgagaggccttaagagacagactagacacagacacgtgtacattgtgcat

SEQ ID NO: 2087 - DNA, 590 bp, Homo sapiens
cggcacgagacaaggaggtggtctaacatgggccaacttggtttgatggtttccatctggcattgctgctcatgtccttacttgtgagttcagagcattcagttgaagaaaccatggatagaaaggacctttaaaagaagacaagaactgagaacacagaacaagtggtcatctcttgtttcatctactctctagaccggtagatttatgtgaaaccctttgattccttttgcttctgttatccagcctgtaagatagtaatagtcgtcatatctttcatctactctagaagaatattttgataattcatctagcaaatacattttgattatggggtatgctttgtgatctagagtttgtcttaaattcatcatctgtgaattcagataccattcatatttaaattcctgataataatcccaatctgttatttttatcattggggacattagatatgtcagggtcagtgtacatttcacagtctataattttgcctctttcaatgagataaacaatttattactcctctggattttttcacccctgagatcatgttttattcagctctcctacctgcattttctctgtgt

SEQ ID NO: 2088 - DNA, 120 bp, Homo sapiens
cggaatatgccaagccagttgaaggtttacaagagttcacaaaagaagctctgtgcgaaagagatgtataaatcgcaatactcgtcgtaatatgcccacacgtgtcacagtgtcgctcct

SEQ ID NO: 2089 - DNA, 617 bp, Homo sapiens
ccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtcctagacacaatttcatttccagcattttataaactaccaaattagtggaccaaaaatagaaattagatttgtgcaaacatggagaaatctactgaattggcttccagattttaaatttatgtcatagaaatatgactcaaaccatattttttatgatggagcaactgaaaggtgatgcagctttgggtaatatgtctttttttcctttccagtgtc

SEQ ID NO: 2090 - DNA, 130 bp, Homo sapiens
ggcggctgggctgtttggttgagcgctcggcgctcttttgcgcacaggcgcacggagaggtctctccggcgcgccgcgctctcgcgtgtgggaatctcagactctctcacacagactctgtgtgcgcgcc

SEQ ID NO: 2091 - DNA, 568 bp, Homo sapiens
ggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcctccttggcgtctccatcatcctggtccttggcagcacctttgtggctatctgcctgactacaggatgaaagagtggtcccgccgcgaagctgagaggcttgtgaaataccgagaggcaatggccttccatcatgggatcaactgcttcgacccagcagatcagctgcagaggatgagtgaccagttgctaagtggggctcaagaagcacgctttcccaacccctggctggcaattctggactccttctcaagagcacctaattaaagggggctgaaagtcctgaaaaaaaaaaaaa

SEQ ID NO: 2092 - DNA, 190 bp, Homo sapiens
gagchmgcgcgcctscaggctttgggtacgtgcagcactacggccttggcagtcctttgacacgtagagcgcgttcttaagagatgttgcttttaagcttgggaagacgcagaaaggtgaaggtgctcacagggcacacggtatacgtgatacgcttatttcagagctctctatactgcggcagcacgtg

SEQ ID NO: 2093 - DNA, 460 bp, Homo sapiens
ctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcaaccggtccagaagctccatgctggtcactagggtgctgtgctctctggcgccccacagcctggccagctccagggacccagttgcaggggccaagcaggtgggagttggacaccaggcttc

SEQ ID NO: 2094 - DNA, 225 bp, Homo sapiens
catccagcaggtgttcgacaatggcagcatctacaaccctgaagtgcttgatatcacagaggaaactcttgcattcttcgctttccttggaggggttgttccgcaatttttgccaggtgtcttgtcttgcagatttggctacccaacctgttgcaatcaagtaccccattctattcaatcaaccggggacaaaacgagtcctggcctttgtcttgttgagacgga

SEQ ID NO: 2095 - DNA, 221 bp, Homo sapiens
ctagaacataaacttaatcagggcacagattttcattcactactgtatcctccagcacctagataaggcctagcaatgtagtaggtgctcaaatattttgcaaataatggaatgttaaagaaggagcagggcatcactcaagggcacttctaaaatacttagtccccttttgctcttgcaagcccttcagccccctcctctcatcctaggcatcaggtcag

SEQ ID NO: 2096 - DNA, 127 bp, Homo sapiens
cttgcgtccccaggtttgcagcttttcccttgggccactaaccatcctggcccgggctgcctgtcttgacctccggtgcctagtcgtgggctctccaatcttgtcttcctcccagtgttccccaatg

SEQ ID NO: 2097 - DNA, 174 bp, Homo sapiens
tcgacactagtggatcaaagaattcggcacgagacagaataaaacttattatacatctctttcttaaattaatatctttacacattttcaacttgctccccaagtcttgataagggaggatttaaaagggaaaaaggaaatgtaattagtttgggtgcccaaggagtgttcctt

SEQ ID NO: 2098 - DNA, 100 bp, Homo sapiens
tcgtccaattcggcacgattctccttcttgccatcctggccctgccctgcgctaacccccgaacccgttcagattccgctaaaacgccccgcccttgtgg

SEQ ID NO: 2099 - DNA, 439 bp, Homo sapiens
ctcgtgccgaattcggcacgagtgctcctgctggccatcctggccgtggccctggccgtgagccccgcgaccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaag

SEQ ID NO: 2100 - DNA, 105 bp, Homo sapiens
ctttggcaggatgtcttggggccttaccagccaggagccgcgttcaaagcgggcaagcggttccacctagaacccacaaagccccttggggagcaaccccaccct

SEQ ID NO: 2101 - DNA, 99 bp, Homo sapiens
acacgccgccgcttgttctgcagccatgtcttctaggttatcccttgaaagttccagcatattttgccggagtactttaacacccaacatcggtttggc

SEQ ID NO: 2102 - DNA, 160 bp, Homo sapiens
ggcagtgcgtggactcgtactgctaggaagctcgtagtcaccgcgagacagaagttgcatgataaacagtataagaaagctcattttggcacaaccctaaaaggccaacccttttggagggtgcttctcatccaaaaggatcctgctgaaaaaatgagga

SEQ ID NO: 2103 - DNA, 165 bp, Homo sapiens
tgaggataagctctttaaaggcaaagctttattttcatctctcatctttgtcctccttagcacaatgtaaaaaaggatagtaatatcagagacagggaggagggatggctttcttgggagcccatccaggacacattgggagcacatagagggttcacccactct

SEQ ID NO: 2104 - DNA, 120 bp, Homo sapiens
caagatagttctggagcccagccagacgtcttggatagcaaggtaagtagtcggatagagaaaagagctccctactccagccttcggtggaaagagcgagactctctctcaaaaaaaaaa

SEQ ID NO: 2105 - DNA, 110 bp, Homo sapiens
acggaaatatatgctatatacacagcatgctcttttttaaggcttcatttatagagtgatcagttgggatctaagctgtttgccagctgaagtacaagtgtgtaatcatt

SEQ ID NO: 2106 - DNA, 472 bp, Homo sapiens
aaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaaattaactc

SEQ ID NO: 2107 - DNA, 236 bp, Homo sapiens
ggctcatgcctgcaatcccagcactttgggaggccgaggtgggtggatcacgaggtcaggagatcgagaccatcctggctaacacagtgaaaccacatctctactaaaaaaatacaaaaaaaattagccagacgtggtggcaggtgcctgtagtcccagctactcaggaggctgaggcaggagaatggcatgaaacctgggaggcggactttgcagtgagctgagatcacgccact

SEQ ID NO: 2108 - DNA, 155 bp, Homo sapiens
gccgcctgccatgccccagccagtccccacagcataacagggtctccttggcagctgtatttctgggaggtctgggatgtttgctctctaaagaccttttaataaaatttttgtacaaagacaaaaaaaaaaaaaaaaaaaaaaaaaaaaaaaaa

SEQ ID NO: 2109 - DNA, 106 bp, Homo sapiens
gagctgagcagtaagatgtgtgacttaaccgcaggacagaccgcagagttcaaggagggccttccagctgtttaaccgcaccaggtaattggcaggatcctgtcaa

SEQ ID NO: 2110 - DNA, 145 bp, Homo sapiens
cccaatgatttcttacgtaatgtattggtttccctcttcacttgaacttttgttgaactgtatgtactttaccccaaacccgttaatattttgagcgcttctatgtgaaagcaaagaaataattttgatactctggcatcataaa

SEQ ID NO: 2111 - DNA, 187 bp, Homo sapiens
gtttgaggctttaatgcaaccctttagcccttggttctttttggtgcaagaattctggctgtttacctcagactcagacccctgaaatgttgccaaattcttcaaataactttttggggggtggggggagatgaaagagagtcgcgttttgtttacagttaaagacatacaatatcttaaaaaggag

SEQ ID NO: 2112 - DNA, 175 bp, Homo sapiens
tcatgctgccacacactcctgggtctttttacaccctgcaccctgcctgaacccgtctatcctaccttgctcccatggcaaaccgttctgtgttcttccaggagtatcacctgctctgtgaaggcttccaggcttcctacttttcttacaatgagcttcacacaagtgtactctg

SEQ ID NO: 2113 - DNA, 371 bp, Homo sapiens
tcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagagtacttctagagcggccgcgggcccatcgattttccacccgggtggggtaccaggtaagtgtacccaattcgccctatagtgagtcgtattacaattcactggccg

SEQ ID NO: 2114 - DNA, 144 bp, Homo sapiens
cggaggctggggcaggagaatcgcttgaacccgggaggcagaggttgcagttagctgagatcacaccacttcaccccagcctgggcaacagagttagactcgctctcaaaaaaaaaataaataaccggggaggggggattacca

SEQ ID NO: 2115 - DNA, 460 bp, Homo sapiens
ggaccgccgttcagtcgccaatatgcagctctttgtccgcgcccaggagctacacaccttcgaggtgaccggccaggaaacggtcgcccagatcaaggctcatgtagcctcactggagggcattgcccggaagatcaagtcgtgctcctggcaggcgcgcccctgaggatgaggccactctcggacagtgcggggtggaggccctcactaccctcgaagtagcaggccgcatgcttagaggtaaagtccatgttccctggccgtgctgaaaagtgagaggtcagactcctaaggtggcaaacaggagagagaagaagaagacaggtcggctaagcggcgatgcagtacaaccgcgctttgtcaacgttgtgccacctttggcaagagaggggcccaatgccactctaagtcttgtattctggcttctctataaaaagcacttagttcagtcaaaaaaaaa

SEQ ID NO: 2116 - DNA, 365 bp, Homo sapiens
cccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctgggcagccccatccaacgaggaggacgacagcacgatgacgatgtgctggctccttcaggggccaccgcagctggtgctggtgacgatggggacgggcagacgaccggagcacatagcggccgggagcccggctgcacaccaggctctgctttgtcgtctat

SEQ ID NO: 2117 - DNA, 105 bp, Homo sapiens
ctccaggagaggcaggtcgacctgcctgccaggcccgatgggctgccgggcttctggtggaacctgccggcctgccttgggagcttcgggcctatgcctctgccc

SEQ ID NO: 2118 - DNA, 150 bp, Homo sapiens
tgctcggtccttccgaggaagctaaggctgcgttgggggtgaggcctcacttcatccggcgactagcaccgcgtcccggcagcgccaggccttacactcgcccgcgccatggcctctgtctccgagctcggcctgcatctactgggccct

SEQ ID NO: 2119 - DNA, 200 bp, Homo sapiens
gagagaactagtctcttttataaatgatgttgagaaaatatatatccacatgcaaaataataaaatcagaccttcatctcacaccatatataaaattacctcaaattagatacttaatacgagacctgaaaatctaaacctaagatgaggaaatatagatgaatgcctcataccattgtctggcaagtacctcttggttc

SEQ ID NO: 2120 - DNA, 300 bp, Homo sapiens
gggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtgggacatcatcaacgccctgtgcttcagccctaaccgctactcgctgtgtgctgccacaggccccagcatcaagatcttggatttagagggaaagatcattgtagatgaact

SEQ ID NO: 2121 - DNA, 400 bp, Homo sapiens
aaaacatgaggaccctgtttgtcctcatggaatttacagtcacaaaaagttgaacagtcatataaatacaatgcttgttataaaaagaaaggacaggatgcaagagaaatgtaaaccagggtcatccacccattctagaaaaccagatgagatcgccctaaaatagcttttcaactaagacccataggaaggaaagaacttgttaaaccaatgggcaggagaagaggaaagatactttggtgagagggtagatgtcaggatcatctctcagattatgtgaatagaaatgataattttataattctcattctccatgtaaataaccccttgtgtatgattaaagataaaatgaaagcctcaatatattggttttctacttatataactggcacatgtcact

SEQ ID NO: 2122 - DNA, 506 bp, Homo sapiens
aaaacatgaggaccctgtttgtcctcatggaatttacagtcacaaaaagttgaacagtcatataaatacaatgcttgttataaaaagaaaggacaggatgcaagagaaatgtaaaccagggtcatccaacccattctagaaaaccagatgagatcgccctaaaatagcttttcaactaagacccataggaaggaaagaacttgttaaaccaatgggcaggagaagaggaaagatactttggtgagagggtagaatgtcaggaatcatctgtcagattatgtgaatagaaatgataattttataattcttattcttcatgtaaataaccctttgtgtatgattaaagataaaatgaaagcctcaatatattggttttctacttatataactggaacatgtcacttgaacttattttggttattttggcgacgtttttttttctttccatcactccagcctggatgacaagagtgaaactccatctcaaaaaaaaaaaaaaaaaaaaa

SEQ ID NO: 2123 - DNA, 495 bp, Homo sapiens
cggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtgagccggagtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaactcctcgtggtgaagggtctaagacgtgggatcgtttccagatgagaatcacaagcgactcattgacttgcacagtcctctgagattgttaagcagattacttccatcagtatgagccaggagttgaggtggagtcaccatccagatgcttaagtcactattttataaattgatgacagttgttaaaaa

SEQ ID NO: 2124 - DNA, 300 bp, Homo sapiens
cattttaaaatgtgatttttcaaaactcagtggaaagagaaataaagggaagaaatagtgaatagagaacaatagtctttaagattaattctaggaatggaaaatcagataacatagtgaactaaacaagacatgtgaagagtaagtagaataaaaggaaaatcagtgcacaaaaattgtcaggactttatcagagacagggtttagattagagagggataacaggctccagattctccacctgtcaagtatatattacattggtagggatactcattagtccatatactttcggttgga

SEQ ID NO: 2125 - DNA, 511 bp, Homo sapiens
ggcattttaaaatgtgatttttcaaaactcagtggaaagagaaataaagggaagaaatagtgaatagagaacaatagtctttaagattaattctaggaatggaaaatcagataacatagtgaactaaacaagacatgtgaagagtaagtagaataaaaagaaaaatcagtgcacaaaaattgtcaggactttatcagagacagggtttagattagagagggataacagggtccagattctccaactgtcaagtataaattacattggtaggatactcattagtccatatacttccggttggacttctctcttttccattccactcatcatgaaaataaatttaggatgtcaaaagttacctatatttaaagaacagacttataacccaagctgtaatatccctatcacatcacagacataaatgcacaagcagaagtatgaaactgggtgggagtaaaagtcattttccacttctctggattgggttcatcactctatcctggctccgttg

SEQ ID NO: 2126 - DNA, 110 bp, Homo sapiens
acggcgggtgcggaggacgtacggactgagtgcggatagctatcagatgacacctccaaagcacgagacttcgtggcagagccatggggagaagccagtgggagcctggt

SEQ ID NO: 2127 - DNA, 259 bp, Homo sapiens
aggtgtggagctcgtgttccagacctttgaggtggaggaggagacccgacttcggctattactacatggagctcttcgacggctacgacagcacaacccccaggctgtggcgctatctgtgtgcgtctagggccttctgaggaggtgttctctggcgcggagagtatctgttccttgtgaagttcactctggatgtacaccatctaccacaaaaggtgttccacctctcgatatacaagcaccacgttgctcacggcga

SEQ ID NO: 2128 - DNA, 157 bp, Homo sapiens
aatcaaagaagccgaggcagttgttgaaaccaaaatggagaacaaacccacctccttcaagaatttcaggaaggtgcaagggaaacaaggaactgtatcaaagagccaggctcgggagtgcctctttgttcttattacaacccttcttggttatttc

SEQ ID NO: 2129 - DNA, 155 bp, Homo sapiens
cgagatgacgaagggaacgtcatcgtttggaaagcgtcgcaataagacgcacacggttgtgcccgccgcttgtggcttctaagggcctaccacccttcagaaggtcgaccctgtgggcaaatgttggctacccctgccaaaggcgcaagaagaaa

SEQ ID NO: 2130 - DNA, 140 bp, Homo sapiens
cgcgggtctgtstcttgcttcaacagtgtttggacgagacacagatccgcgcggacttcttcttccaacctccgaccgcccttccgatttgcctctcccgctttccaacctcccgggaccatcttcttcggccatacttc

SEQ ID NO: 2131 - DNA, 237 bp, Homo sapiens
ctcgtgccgaattcggcacgagccgacatcagtttggtcaagaaaaggatgtgtttgcacccagatttagtaataacatcattaggcacctttccaggaatttatatcgtgtgtccctgtgggatgacacagagtaaaatagttagagtactctaaactctattggcagagagaattaatgtatttaagagtgtagattattcagccccttttggttatagcagccggggttcgcgc

SEQ ID NO: 2132 - DNA, 212 bp, Homo sapiens
ctcacacctgttatcccagcactttggaaggccaagacaagaggatcacttgagcccaggagttcaagactagccttggcaacgcagcaagaccttcaatgtctactaaaaagaacaaaggaaaagtatgagattgccccaaaaatataagacaaacacggcttccattaagagacacagcacgagaaaggcccagggcaaccacatgttgg

SEQ ID NO: 2133 - DNA, 150 bp, Homo sapiens
cggctcctgagagctgcagcggttagcgtgggagctccgcgggaccgcgaggacaggcaggcgccgcttcatcggctgtccgcggcgctgctcgccgtgtgtcgtcaagggtgccgcgggatgtgtgtcagtttacgctcttagatcaca

SEQ ID NO: 2134 - DNA, 458 bp, Homo sapiens
ctcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagcca

SEQ ID NO: 2135 - DNA, 210 bp, Homo sapiens
ctataaagaaacggtatgacttaattttagaaagaaaattatattctgtttattatgacaaatgaaagagaaaatatatatttttcatggaaagtttgtagcatttttctaataggtactgccatatttttctgtgtggagtatttttataattttatctgtataagctgtaatatcattttatagaaaatgcattttttggcaattgtt

SEQ ID NO: 2136 - DNA, 235 bp, Homo sapiens
cacacgtacactgaaaatatatacatctatttattaatttaaaaattctaaatggaaagaaaatttcatcctcactttttaaaatttcagtaaagtgatgtcttatattttatctagtgaatgctgtgttcatagataatgcaaaataaaatgtgttttaggctatatcagattttgaatgaatcattactttttgactctcgttaaaaggtttttaaaggatatttggggtata

SEQ ID NO: 2137 - DNA, 200 bp, Homo sapiens
cgcagagccggcgggcggccacgtcgcggcctggctgggataggagagggcggtcccagtccagttgggtgaactacccgttgcacactggagtttctggtgtcttttccttggaactgacctagctcgtggcagggggaactcggctagcggcccacagaccctctgactcaaaacaactcagttgtaagacgttcatc

SEQ ID NO: 2138 - DNA, 125 bp, Homo sapiens
ccgtgccggcccagcgcaccaggttcaaggcattttgttgctatcggggactacaatggccacgtcggtcttgggtgttaagtctccaaggagggtggccacccccatcccgtggggccattcat

SEQ ID NO: 2139 - DNA, 100 bp, Homo sapiens
tgggctggaacttctggcagtctgcccgccttggcctcccataatgctgggtttacaggcgtgagctttccgcctggcagcgtagtggtttttttttttc

SEQ ID NO: 2140 - DNA, 180 bp, Homo sapiens
gccacatccagcctggatgacctgggaccccagaaactgccgttttggaggcagcaacagcaacgtgcccaggcaggcagttattcccacagaggtgagccaaaattgtagcagggcactttaatcagagctgatgatttgaaaccaacggtcacccaacttgtcaaaaatggcacttac

SEQ ID NO: 2141 - DNA, 150 bp, Homo sapiens
ctcgtgccgaattcggcacgaggtcatgctggtggtggtaattcatcttgttccgcctgtgtatgcttacggtcagactctagataacacaatattcgctatgttttaataacctctagttgtactctggggaaaacatgctatagctga

SEQ ID NO: 2142 - DNA, 510 bp, Homo sapiens
ctcgtgccgaattcggcacgaggtcatgctggtggtggtaattcatcttgttccgcctgtgtgatgcttacggtcagactctagataacacaatattgctatgttttaataacctctagttgtactctggggaaaacatgctatagctgaataatatttttaactgttaaattttgtttaagaatacttaatatattttttctccctcgatttttataccaccatgtaagcaacttgacttgtatttcattgtcccaaagaggaatgcacagggtgaaatggattagttggctagaagtcctgggatttttaccccataaagtattcttattaaaagaactgaatttatgggacaaaggaaaggcttttttgagggtggaaacaaagccctggatagaagagacagacgtcatgctgagtctagaaggagtatgcctctgttccttcttcctggtgcacttttcagaagagtttatgataccttgtgcagaaaatatctgataacagaag

SEQ ID NO: 2143 - DNA, 110 bp, Homo sapiens
agaaaaaagaagagaagaaaccaaatgaaacagggttcccataaacaaaggaatgttcttgtgaaaagggaacctgtattacactagagaacccaaaggtaattgggatt

SEQ ID NO: 2144 - DNA, 168 bp, Homo sapiens
gtgaaatggttcgtattcacttgaccggagacccacgaatcatgcaatcagaggtccatctcgtgtcactttaggacacttgtgaacttgctcaggcattcagggattgcatatccgaaggccccgagattctaaggtgtacctttaaagaacggtgtgtaccttccg

SEQ ID NO: 2145 - DNA, 520 bp, Homo sapiens
gtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaagggacagattgttcctaaaccagagaggaggttgcccagaagaaaaagatatccca

SEQ ID NO: 2146 - DNA, 134 bp, Homo sapiens
aagaaggaaaaggaaaatgttgtggtttttcttttctactttccttcagaaacaacatgatttaagggtttgcttgttcctctaaggtaaaatgcaaccattcttggacaatggttggctgtccacagattaag

SEQ ID NO: 2147 - DNA, 560 bp, Homo sapiens
aagaaggaaaaagaaaatgttgtggtttttcttttctactttccttcagaaacaacatgattgaagggtttgcttgtttctcttaagtaaatgacagcattgcttgacatggttggctgatcagcagagtgagacagcagtgacagcttgcatttatgggaagttcagcctgcagaccagaatattttatttccagattgcccgaggaatttctgacgttcaaaatggatgacagtagagattcaccaagggaaatttatcatgtaattcaatatttgtagaacattttttattacaatgatttttgacctaagtatgaaaaaaatactctagtaagatagcatttaaaagaaaaattaaatagatcagctggggcccttggaaaggattagtgaactaaagttaaggttgattttgacacaagaaatagaactctaggaagtttttctttgttttctgcaagaaaataatggttcggttgagaacaagtgcttatgcttggaaattaatcataattgtacttacaggtgcacagccacggagctactatgtaaaccaga

SEQ ID NO: 2148 - DNA, 183 bp, Homo sapiens
gggagttccaggcatcgatggcatcgacggtgaccgaggtctaagggccccccgggccccccgggttccctgcaggttgaaccggggaaagccaaggagctccaggcaagccttggcaacacctggcgttgatggattaccaggacctgatggatcccttggttccattggtcaaaggggaca

SEQ ID NO: 2149 - DNA, 179 bp, Homo sapiens
ccataatgagatgtgagcccttgtgcaatgtggggggaggagggagagagatgtactttttaaatcattgttccccttaaacatggctgtaaccccactgcatgcagaaccttggattgtcaactgcctgacaattcaacttccaggagaggcctatatccaaatgtgtgggaattgac

SEQ ID NO: 2150 - DNA, 115 bp, Homo sapiens
tggcggcttgtgcagcaatggccaagatcaagggctcgagatcttcgcgggaagaagaaggaaggacctgcttgaaacagctggaccgacctaagggttgaagctgtcccagctg

SEQ ID NO: 2151 - DNA, 137 bp, Homo sapiens
aagtgggcaagacttttatcgagtaccgttacagaagacctcacgcctccccatcaattgacatttgcaccattggacataggaggcccgagcaggatttcggtgtgacaatagggccgtcctgcttctgtaaaaac

SEQ ID NO: 2152 - DNA, 111 bp, Homo sapiens
caatttgggattacaggcgtgaaccaccacgcccggctgaccagacctctacttttaaaatgcccaattaattattgaattccagttggttgacacttaaatacttttatc

SEQ ID NO: 2153 - DNA, 140 bp, Homo sapiens
gatgatgagggcgcggcagtatccttggggcactgtgcaggttgaaaacgaggcccacttgcgacttttgtgaaggctgcgggaagatgcttgatcggggtcaacattggaggatcttccgggagcggaacccacacacc

SEQ ID NO: 2154 - DNA, 140 bp, Homo sapiens
tcgtgccgaattcggcacgagggtttggaattggtgacaacatgctggagccaagtgctaacatgccctggtcaagggattggaagccaaccctaaggattgcaattgccattggaaccacgttcttgagctcttggact

SEQ ID NO: 2155 - DNA, 115 bp, Homo sapiens
gaatgaactgcaagattagaactggactgtagaggctagagtggctctgagtgagacagagacactgaccggttcaagagaaagtcaagcttctgttcagcctcggtagaccaat

SEQ ID NO: 2156 - DNA, 450 bp, Homo sapiens
gagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggcttccgggcattaaggggccccctggtgctcttggtttgagggggacctaaaggtgacttgggagaaaaagggggagcgt

SEQ ID NO: 2157 - DNA, 228 bp, Homo sapiens
ctttggaaagccccagggcactgtggccagggttcacattggccaagttatcatgtccatccgccaccaagctgcagaacaaggagcatgtgattgaggccctccgcagggccaagttcaagtttcctttgccgccagaagagtccacaatctcaaaagaagttgggctttaccaagttcaatgctgatgaatttgtagacatggtgtctgtaaagcggctaatccca

SEQ ID NO: 2158 - DNA, 125 bp, Homo sapiens
ctttataacatggagttgagttgtttctataagactattattcaaatgtaatactacttggagaaaggagagccagatttttgatttgacaaatttcaatccccccacccccccacttcttgggg

SEQ ID NO: 2159 - DNA, 114 bp, Homo sapiens
gagcttttgtcattcaattcacagcgcggcaggctcttgggtgagcacatcctgtccactgtcttcattttgtggggcaccaccctcccctgccaagggtggggtttttttttt

SEQ ID NO: 2160 - DNA, 113 bp, Homo sapiens
cggcacgagagtacttctagagcggccgcgggcccatcgattttacacccgggttgggtaccacagtaagtgtacccattcgccctatatgttagttgtatatacacacacac

SEQ ID NO: 2161 - DNA, 117 bp, Homo sapiens
actgaattcacatatgtatgtttttttttactatttaaaatacccaacatgtattatgaaatacctcaaaagtaatttagttacaattcttaaacaatgacaattgtcggaagacag

SEQ ID NO: 2162 - DNA, 201 bp, Homo sapiens
taaacaagatttgctgcatttccggcaatgccctgtgcatgccatggtccctagacacctcagttcattgtggtccttgtggcttctctctctagcagcacctcctgtcccttgaccttaactcttatgggtcttcacctcctgccaaccaccccaacccaagttcctttagagggtataatatcacattggacgcagaga

SEQ ID NO: 2163 - DNA, 137 bp, Homo sapiens
ccaggatgctccccgcgtacgtgtagatcttttgttgcaggaagcggtgcttgaggttcttcaggaggttgccctcggttagctcggggaggttacacaggtcatcaaagtccccctttcttcccttgcaagaggcc

SEQ ID NO: 2164 - DNA, 149 bp, Homo sapiens
ggacgaagcagctggcaacctcaagaaggccctgctcatccagggctccaatgacgtggagatccgggcagagggcaatagcaggttcacgtacacttcccttaaggatggcttcacggaacataacccgtaagttgggcaagactttt

SEQ ID NO: 2165 - DNA, 129 bp, Homo sapiens
agctgccgcaagacagcaattacagtcaccttccgaccatatttcctcataatgaagatccacacggccatcctcatcccctgtttccaaaagggggggggcaccttttctgataggcgtgcaaagatt

SEQ ID NO: 2166 - DNA, 260 bp, Homo sapiens
agctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgaaaaaaaaaaaaaaaaa

SEQ ID NO: 2167 - DNA, 242 bp, Homo sapiens
ataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaaataaatgtaattgacatcttcaagaatgtttctattgtcttccattcataatcagagatgtaatttgtatggactaaataaaaactttattatgtaaaa

SEQ ID NO: 2168 - DNA, 117 bp, Homo sapiens
cggaggtcctttttccttgcctaacgcagccattgctcgttgtccaagaagcattttaagcgggtttgcagcttcaaagcatttgattgcttggtaaattttacccggttttttttt

SEQ ID NO: 2169 - DNA, 209 bp, Homo sapiens
tcttaatcagtggtggaagaaccggtctcagaactgtttgtttcaattggccatttaagtttagtagtaaaagaccttgttaatgataacaatgcatcgtaaaaccttcagaagggaaaggagaatttttttttgggccccttttggttttctttttttgcgtgtgggcaattttaagttattagtttttaaaaatcagtactttttta

SEQ ID NO: 2170 - DNA, 114 bp, Homo sapiens
tcgtcccgcaataggagttgaagagattaacctgactttgttttggctgtttttttagttctgtatgtattttagcaatctgaatttcacctaactgagatgtgttcaaatata

SEQ ID NO: 2171 - DNA, 200 bp, Homo sapiens
ggacttggctcccccatcctcagaactcacaagccattgctccccagctggggaacctcaacctccccccctgcctcggttggtgacagaagggggtgggacaggggcgggggggttcccctgttacataaccctgccataaccaaccccaggtattaattctcgctgggtttgtttttattttaaattttttgttttga

SEQ ID NO: 2172 - DNA, 165 bp, Homo sapiens
tggcagcgcagaaggaccagcagaaagatgccgaggcggaagggctgagcggcacgaccctgcttgccgaagctgattccctcccgtggcaggcccgggagttgcttggagcggcgccgcgcgacccattccggcccttggagcaaccttcgttggccaacagcg

SEQ ID NO: 2173 - DNA, 150 bp, Homo sapiens
ctttcctttcaccctagcctgactggaagcagaaaatgaccaaatcagtattttttttaatgaaatattattgctggaggcgtcccaggcaagcctggctgtagtagcgagtgatctggcggggggcgtctcaacaccctccccaggggg

SEQ ID NO: 2174 - DNA, 147 bp, Homo sapiens
gtgaacctcacaggcaggctaaacaagtgtgggggtgatcagccccagatttgacgtgcaactcaaagacctggaaaaatggcagaataatcttccttccatcccgccagtttgggtttcattgtacttacaacctcagctgggcat

SEQ ID NO: 2175 - DNA, 169 bp, Homo sapiens
gccaccggcaagcccccccagtacatcgcggtgcacgtggtcccggaccagctcatggccttcggcggctccagcgagccgtgcgcgttctgcagcctgcacagcatcggcaagatcggcggccgcaggaacccttcctacagcaagcttcttttgcggccttcttggc

SEQ ID NO: 2176 - DNA, 130 bp, Homo sapiens
tgatagctggttgtccaagatagaatcttagttcaactttaaatttgcccacagaaccctctaaattcccttgtaaatttaactgttaggtccaaagagggacagcctcttttggacactaggaaaaaac

SEQ ID NO: 2177 - DNA, 150 bp, Homo sapiens
gttgtcaccacctgaacaccaaggcattgtattttcatgcccagttaacttatttacaatatttaaggtctcctgcttctgcattgggtggtttcctgaaggccagccctgttaatacaaggtggctttcattggtgtctctctggcaga

SEQ ID NO: 2178 - DNA, 160 bp, Homo sapiens
ccaatctatcaccctatagaagaactaatgttagtataagtaacatgaaaacattcttctccgcattaagcctgcgtcagattaaaaccactgaaccttacaaatttacacagcccaatattctatcacatcacccaacaagggtcattattaaccctca

SEQ ID NO: 2179 - DNA, 160 bp, Homo sapiens
agaatgtttttgtggaccactttgggttttcttttttgccgtgtcgcagtttaagtattaggtttttaaaatcaagtacttttttattggaacaacctgaaccaaaattttgtcacacgattttgagagcccattaaaaggttaataggaaaaaaaaaaa

SEQ ID NO: 2180 - DNA, 160 bp, Homo sapiens
gtggatcaaagattcggcacgagctcgtgcgaattcggcacgagcctggaaccgtctgaggttatcaataagctcctagtccagacgccatggtcaatttcacaagaggaggacaaggctactattcacaaggcttgtgggcaaggtgtgatgtgtggag

SEQ ID NO: 2181 - DNA, 150 bp, Homo sapiens
cggcacgagctgattcttccctaacacgggttctctattcaaccctaaatacattgaaattgtacctttcaaattttgcaggatcaccattacttcagtcaaggtaggccttaagaagtaagagaaaaggagatccgtgggtcctaaccc

SEQ ID NO: 2182 - DNA, 537 bp, Homo sapiens
cggcacgagctgattcttccctaacacgggttctctattcaaccctaaatacattgaaattgtactttcaaattttgcagaatcaccattactcagtcagataggcttaagaagtaagaaaaaggaatcggtggtcctaaccagccttcaagagggactccagtgattctcacttctggatattcacattcttctatgggcccctctcatatcaaataagataacctgtgtagctgagattaggccatagaagacactgggctatctgccttgcacttagattattctctctggaggaagccagtgatcatgtcatgaggacacaaaagcagccctatgaagtctacttagtgaagaactgaggcctcctgccaacaaccagcaccaacttgctatccaaatgctggcaccatcttagaagagggtgctccagcttcagtcaaccttcaggtgactgtgccttcagccagcactctaaccacaacctcacaaaagactctgagcctgaaccatccagctaagacactcctgaattcc

SEQ ID NO: 2183 - DNA, 210 bp, Homo sapiens
ctgacttcctagtaactgttgcagtttacaacctgccctccagggacacgtcttcatggttttcctacaaatgaattccaagaaattgcttattagcaccataatttaaggttgcgtattcaagtaggtagatttagtcattaaccaacccggtctttgtgtaatgtgtaaggcctcccttcagagtatagtccctattttatatatgtc

SEQ ID NO: 2184 - DNA, 140 bp, Homo sapiens
gacttccagtttgaatgcaaagtgtgtggtccaaagttgaattcttttgaacccaagtacatgcctgcgggttggagggacaatttaaaggttgaggcaaggttcggaggagaagtgttaactgaacttacagagagttg

SEQ ID NO: 2185 - DNA, 155 bp, Homo sapiens
ggcacgagcttagaagtaaggaatacttctacttgcattcaaaagaaatataatgtgagccacaaatgttgagttgcatgtattgattttaaatcaagtagcacatgaaaaaggtaaaaataatccagtgaccattaattttaataatataggtt

SEQ ID NO: 2186 - DNA, 470 bp, Homo sapiens
cggcacgagcttagaagtaaggaatactgctacttgcattcaaaagaaatataatgtgagccacaaatgtgagttgcatgtatgattttaaatcaagtagccacatgaaaaaggtaaaaataatcaagtgacattaattttaataatatagtttacttaacccactgtgtgcaaaagatcatttcatcatgtaatagacacaaaaattattaatgaactattttacattttttcatatcaagtctttaaaatccaggtgtgtttgatccttagttcatctccatttggcctcatcacatttcagctctcaataggcacctgtggctggaggctaccatggtgcacggtgcagctctactgatggaaatgggggttagagacactgaggtctctttctgcttttaatttccatgaaaacccaagtccaaggaagggatcttattatcatcatcatcatgatcatcaccaat

SEQ ID NO: 2187 - DNA, 295 bp, Homo sapiens
ggaaaagctgggaaccttggtggaggggtggtgaccatcgaaaggagcaagagcaagatcaccgtgacatccgaggtgcctttctccaaaaggtatttgaaatatctcaccaaaaatatttgaagaaggataatctacgtgactggttgcgcgtagttgctaacagcaaagagagttacgattacgttacttcagattaaccaggacgaggaggaggaggagacgaggattaaatttcatttatctcgaaaattttgtatgagttcttgaataaaccttgggaccaaaaaaaaaa

SEQ ID NO: 2188 - DNA, 210 bp, Homo sapiens
ctcgtgccgaattcggcacgagcccgcccctcggccgatccgctccctggcgtgactcggcactgagagtcccgggagaagactcgaacggtcgccacctcttctgtcgcaggcctcggcctttctgagtatcctcgtgccgaattcggcacgagagcagctccagccctcaccagccatctgctcagaccctgacaccctgagccccag

SEQ ID NO: 2189 - DNA, 415 bp, Homo sapiens
caccgccgaggaaaaccgtgtactattagccatggtcaaccccaccgtgttcttcgacattgccgtcgacggcgagcccttggccgcgtctcctttgagctgtttgcagacaaggtcccaaagacagcagaaaattttcgtgctctgagcactggagagaaaggatttggttataagggttctgctttcacagagattattccagggtttatgtgtcagggtggtgacttcacacgccataatggcactcgtggcacgtgcatctatggggagagatttgaggatgagagcttcatcctaaagcatacgggtgctggcatcttgtccatggcaaatgctggacccacacaaatggttccagtttttcatctcactgccaagacttagtggttggatggcagcatgtggtgtttgc

SEQ ID NO: 2190 - DNA, 170 bp, Homo sapiens
gttattttttcacatcaatttgcttacctctactctgaatctgtgactcactcagatatgtattcccgcaagaatgctgggttctccaaaatggaaactcttgattttcaatataaatagagctatctcctttagggttcattatattgttctcattttcaggaaaaaaa

SEQ ID NO: 2191 - DNA, 170 bp, Homo sapiens
ggtcgacactagtggatccaaagaattcggcacgaggaaaacccaggcagccagcgttggaggctgttaagatgctggatgagatcctcctgcagctgagcgcctcagtgcccgtggacgtgatgccaggcgagtttgtatccaccaattacacgttccccaagcaagcc

SEQ ID NO: 2192 - DNA, 160 bp, Homo sapiens
ctcgtgccgaattcggcacgaggaaaagtcccaatgtacgtccctggtgtaagaaagacaaatcactaggctagtcccgtgtcattctaaatttagccaaggatggccaacctctttcaggaataggaagggggacccgctacagccctaaacaaactta

SEQ ID NO: 2193 - DNA, 200 bp, Homo sapiens
ggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggataattttatagaaaaataaagcttctgtgtctaaggcaaaaaaaaaaa

SEQ ID NO: 2194 - DNA, 370 bp, Homo sapiens
agaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccactctctcaccctatagagagctaatgttagtataagtaacatgaaaacattctcctccgcataagcctgcgtcagattaaaacactgactgacaattaacagcccactatctacaatcaaccaccag

SEQ ID NO: 2195 - DNA, 160 bp, Homo sapiens
ccgtctctattctdcagccatgtctctagtgatccctgaaaagttccagcatattttgcgagtactcaacaccaacatcgatgggcggcggaaaatagcctttgccatcactgccattaaggatgtgggccgaagatatgctcatcgtggagttgaggta

SEQ ID NO: 2196 - DNA, 250 bp, Homo sapiens
aaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagagctgatcttaattggagatgaactagagccttgcgtgtgagagagaattcgactcgagaagggtgctcctg

SEQ ID NO: 2197 - DNA, 240 bp, Homo sapiens
gaagaacggtctcagaactgtttgtttcaattggccatttaagtttagtagtaaaagactggttaatgataacaattgcatcgttaaaacctttcagaaggaaaggagaattgtttgttggaccacttttggttttctttttttgcgtgttggcagttttaagttattagtttttaaaatcagtactttttcattgaaacaactttaccacaaatttttcacagaatttttagacccatt

SEQ ID NO: 2198 - DNA, 340 bp, Homo sapiens
actagtggatccaaagaattcggcacgagctaaagcttaatgtcactaagtttcatgtctgtacagmttatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccacaaattctgatgaccgcatctagagtatttttttataaaaatgattttcactatagctatgttacgctaagctactctccaa

SEQ ID NO: 2199 - DNA, 305 bp, Homo sapiens
gcttgatggggatggcattgaatctgtaaattaccttgggcagtatggccattttgacgatattgattcttcctacccatgagcatggaatgttcttccatttgtgtgtgtcctcttatttccttgagcagtggtttgtagttctccttgaagaggtccttcacatcccttgtaagttggattcctaggtatttgatcatctttgaagcaattatgaataggagtcactcataatttcgctctctatttgtctattaatgagagtataagaatactttgattatgtacaatagaatttgtatcct

SEQ ID NO: 2200 - DNA, 265 bp, Homo sapiens
ttttaaagtataaagtaatattttagcatgtaaacttaaaagtgagaattacaacagaatcaggaagtcttagagtttcaggagggaaaaactttttttcctcaaaatgcagtagattgtataattattattctaattatgacagtcatatgtttgatcataaaaccttcagccagttcagcaaagtgagaattgcctgtagcttaacactcaactattaacattttgatgtatagtattattattttcatagagattgatatga

SEQ ID NO: 2201 - DNA, 220 bp, Homo sapiens
aggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaa

SEQ ID NO: 2202 - DNA, 160 bp, Homo sapiens
cagaagtgacccccagaaagggagggccaccgctttgcccctgcttttacccttccttcttggtgctctacacctcaggttaccaggcttgaggcatcttcagccaagcttgtttcctgctcttgaggcttgttgggttggagccagagttgaaggtcgg

SEQ ID NO: 2203 - DNA, 150 bp, Homo sapiens
gtttcaagaaagtttacctttgctttaggtcataagttccttatttgattgccgtatatggatacatgggctgttcgtgacattctttatgtgcaaatttgtgatttccaaaatgttcctgccagtttaagggtacacatgtaggagccc

SEQ ID NO: 2204 - DNA, 215 bp, Homo sapiens
ctgctgccctcaaggtcgtgcgtctgaagcctacaagaaagtttgcctatctggggcgcctggctcacgaggtggctggaagtaccaggcagtgacaaccaccctggaggagaagagggaagagaaagccaaggttccctaacggaggaggaacaactcaagaagttaaggaacagccgagagaggacctgtgagagaggaatttacacatacac

SEQ ID NO: 2205 - DNA, 110 bp, Homo sapiens
agtatgataggagtataaggatgtgttctccactgaacattttagaacctgaattcaagaaatacttgatgggtatctattcacctcactcctccaaaaaaaaaaaaaaa

SEQ ID NO: 2206 - DNA, 112 bp, Homo sapiens
agtatgataggagtataaggatgtgttctccactgaacattttagaacctgaattcaagaaatacttgatgggtatctattcacctcactcctccaaaaaaaaaaaaaaaaa

SEQ ID NO: 2207 - DNA, 130 bp, Homo sapiens
caccatctcgccaggccaggaattacaagcctcgggaggataggcagcgtcgtcagcagcggcactcaagccaaacagaagagaaggcggcggttcaggcaagaagccttgagggagaaaggaaagaagg

SEQ ID NO: 2208 - DNA, 106 bp, Homo sapiens
gttccttaactctaatgcactgtcaggtctgtgttcgaagagttagcctcacgtaattgaatattattcacataacacttcaataagacaaatgctgtcaaaaagg

SEQ ID NO: 2209 - DNA, 300 bp, Homo sapiens
gttctttaactcaaatgcactgtcaggtctctttgttcaaagagtttagccctcaccgtaatgaatatatcacataacactccaataagcacaaagccctccaaaaaagaatctgattttcaaaggaaatcctctcctgctggagcactgtgtgagtgaggaagagtgagaaagctgatgagcattctagggggatgcagagcagtgtacaactttaacaaaaaggaaagggcagctctgagtccttcagaacatgaagttcatgcagatttgcagggaaacatttgtctaaaacaagaa

SEQ ID NO: 2210 - DNA, 186 bp, Homo sapiens
gcccggcaggaccttacaagggatgagccagccaaggcagcgagaggcagcagagttacaggagcggcagaagttgaggtctctcttccaagtcttgggaggcttaagggaagagagtgtccccttgcgcgctgctcttggtctctccgtgtcctctctctcacagggctctgggcctctccgaga

SEQ ID NO: 2211 - DNA, 480 bp, Homo sapiens
gcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggctgcagaagcctcctggcctggctgtgtcttccccacccagctctcccctgcgcccctgtctttgtaaattgacccttctggagtggggggcggcgggcaagggctgcttttcttaatctgataccaaagcaagggcttttctgaataaattcatttgactttgaaaaaaaaaaaaaaaaaaaaaaaaaaaa

SEQ ID NO: 2212 - DNA, 146 bp, Homo sapiens
agcagcctggtatgatgtgtcatcaggaagttatgacagagcacttcgcttctctcggatcaaatgattgaggaggatgttcctattgacacatatattcctttattcaaacaatttattatatggtgttcgcgtcacgagaaagg

SEQ ID NO: 2213 - DNA, 137 bp, Homo sapiens
cgagaggtgcaggtcctggtgcttgatggtcgaggccatcttctcggccgtctgcgcgcattccgtggctaaacagagtacttcttggcccgaaggttggttgtcgtaccggtgttaaggcattcacaccattcttg

SEQ ID NO: 2214 - DNA, 161 bp, Homo sapiens
ctggggttggcaggggttgaggggtgagcaggtttcatattcaaggagttcttgctagtcttaggggttggggagcccttttagccctttaaataaagtttaacgaggtgaacaattggcttgctctgttccttaaggatgtctgtttattgggctgtaaa

SEQ ID NO: 2215 - DNA, 380 bp, Homo sapiens
ctggggttggcaggggttgaggggtgagcaggtttcatattcaaggagttctggctagtcttaggggtgggggagccctgttagccctgtaaataaagtttaacgaggtgaacaatggctggctctgtccctgaggatgctgtttatggggctgtaaatcacagtcagccctggactttggtctagtccctggtagaaggaggcaggagggtggggtggcagaggcccagggcttctgcattatcagtccagagctggggctctccaggcagtgggaaagacaggagcaaacaagagggcagcagctgaggagctcactgattgtgagttttcagagcttctgaggctctctctgtagaatgagatctcagattttccct

SEQ ID NO: 2216 - DNA, 175 bp, Homo sapiens
aacaaatgattgtaaccctacacactattcaataagtagtagaaggagcatcacacagatttcaggtctaatctgcccttcttgttggccataatataaacataaatgttgtgttattataaaaaggcattttcctcaaagaggctatcagcttggttcacatatgtgtagagag

SEQ ID NO: 2217 - DNA, 147 bp, Homo sapiens
actgtcctcaagagggaccaggaaggactaggctacagatcagcacccagcccgagtgacacattttccagctttggatacccgagctgttgcttggagggagagaaccccttcggttggcacacttagcttgagggaggagagaaa

SEQ ID NO: 2218 - DNA, 150 bp, Homo sapiens
cggcacgagcccttagctgctaagcctgccttgcccaggggtgggatggcacttaaggccagcagacaggcctaggcttgggcagggtcacggcttgcctttaaccttctctaaggccccatctcttgggtgttttggggtcaaggagca

SEQ ID NO: 2219 - DNA, 155 bp, Homo sapiens
ggactctgggtcagaggaagatgggaaagaaaggacagattttcaggaagaaaatcacatttttacctttaaacagactttaggaaacttacagggcttcaaattttcagtcttatgacttggacacatagacttaatgtagagcaaaggaaaag

SEQ ID NO: 2220 - DNA, 151 bp, Homo sapiens
acccaccttcatcactatggcattatatttagggagtagttcttggctggatttctggttgtggaagtgggcgccagaatagtgtgtctctatttaaggagcaggaagggcgttaggcaagaggagagacttgtggagggaagagcttctc

SEQ ID NO: 2221 - DNA, 170 bp, Homo sapiens
tgtagaactcagccttcttgggaaagaaaaaaaagaggctccgggttgacaaatgggtgggttaacagaaagggaacttgctacctgtgcggactatttttagggcatttacagaaacatggatcaaggggattaacaactcgggcttccctttaacaaggatggagggt

SEQ ID NO: 2222 - DNA, 266 bp, Homo sapiens
ctcgtgccgaattcggcacgaggttcgggacaagctcaataacttagtcttgtttgacaaagctacctatgataaactctgtaaggaagtcccaactataaacttatacacccagctgtggtctctgagagactggaagagttcgaggctccctcgccagggcagcccttcaggagctccttagtaaaggacttatcagactcgtttcaaagcacagagctcacgtaatatacaccagacataccacgggtggagatgctccacct

SEQ ID NO: 2223 - DNA, 108 bp, Homo sapiens
cggcacgggctccctcagcagggacggagggaggggctgctggcggccagggactgcactgttgtaagggggaagccttgcttgttgtggcctggagacaagtgccct

SEQ ID NO: 2224 - DNA, 120 bp, Homo sapiens
accatgggaggtggggcctcaatctaaggccttgcctgtcagaaggggttgtggcaaaagccacattgcgaggctgccatcccctgccccgtttggagtggacccggtggcgcagtgcgt

SEQ ID NO: 2225 - DNA, 117 bp, Homo sapiens
ccgaggtagagtctagagtagtcatgaccagaaggtcgttcagtgacgagttcgcaattgaagacgaggtttggcttgatcggtatacaaggcttaccacgttaggaaggaacctca

SEQ ID NO: 2226 - DNA, 359 bp, Homo sapiens
cggaggtagagtgtagagtagtgatgaccagaaggtgttagtgaagagtggcaatgaagagaggttggttgatgtatacaagcatacagttagaagaaactaattctagtgttcaatagcaaagtagggtgacgacagttaacaatgatttgttgtatattctaaaataactagaagaaaagatctgaaatgtttcaaacacaaagatatgataaatatgttaggtgatggctatcctaattactctgatttgatcattatatattgttttcgtggatcaaaataccacatggagcccataaatatgtaaaattattgggtattcataaaaataaatgatagggattggggataggagg

SEQ ID NO: 2227 - DNA, 129 bp, Homo sapiens
gtgttgttggccctagctattggcctaaattgggctctagggtctctgtccctgggcgcttgaaggttcaagaaggagctcttgtcccgccccttcagtattaaccctgtcttcctcttaaggggtagg

SEQ ID NO: 2228 - DNA, 539 bp, Homo sapiens
ctcgtgccgaattcggcacgaggtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaaggccctttatctgtacatagtgactgagtggggggtgctggcaatgtggcagctgctctgggctgagcacagcttgacccctctagccctgtaaatactgggtcaatgaatgataaaactctcctaagaatctcctgagaaaaaaaaaaaaaaaaa

SEQ ID NO: 2229 - DNA, 181 bp, Homo sapiens
gtggacggaaaggaacggacactgttagtacacaggaagggatccacccgcgctttccctcctcaccatcccctcattgctgttgattaccaactcactggacaaccagtatctcattgggtggcaacattgggaacctgtaggtatgttcttacttggcacttaaacaaggcatgactta

SEQ ID NO: 2230 - DNA, 121 bp, Homo sapiens
tcccatgctctctcttctctgctttcttctcacttcgagtccatgtgcagtgcttgatagaatcaccccacctggaggggcttgctcctgccctccggagctattggtgagccgtccctca

SEQ ID NO: 2231 - DNA, 206 bp, Homo sapiens
gtcagatcggcaacacggggcccaagggaaaacgttggagagaagggtgattccaggaggaagtgggaccgggggccacccggggatgcctgggcccccagggattcccaggaactccttggccggccctggcaaggcaattaaacgcaaaggatgggagatcgagagggtcccaaagggcttccagagagaggagtgtcgactct

SEQ ID NO: 2232 - DNA, 135 bp, Homo sapiens
agaagaggctgcagaatatgctaaacttttggccaagagatgaaggaggctaaggagaagcgccaggcaccaaattgccggaagagaacgcagcctttcctcctctgcgagagcttctacacttcctaagtctga

SEQ ID NO: 2233 - DNA, 190 bp, Homo sapiens
gcttaatcttcctttgcctcagtcttcctatctatcaaatggtaacaatatccttcttcataggggtttcctggagattaaatgagttaatttatttatagtattaaaaatagcaccctcacataggtaaccatcagtaagcattaactgttaattattcacaacctttagataggtatatataatataa

SEQ ID NO: 2234 - DNA, 420 bp, Homo sapiens
gcttaatcttcctttgcctcagtcttcctatctatcaaatggtaacaatatccttcttcatagggttttcctggagattaaatgagttaatttatttatagtattaaaaatagcacccatcacatagtaaacactcagtaagcattagctgttatttaattcaacaaactttaagatagatatataaaataaaaatgatatgaaatctaaccttttgagagtttaatttgggaagacagataatacaaaaatacttgagaacaattttaagacagattttaaggaattgcatggtggggtagtaaactatgaggccctttttttgcctctgcgttattatttacttgttaagatgacgtgaactctgagttgggcactgatctccaccggttgtatatcagggccagcttatgatagcac

SEQ ID NO: 2235 - DNA, 120 bp, Homo sapiens
tccaaactctatccacccctaacgttaggatgagtgtgagacttactacgattagagcccaatccaagggcttgcaacctagggactggcgatgaaaggctttccttgcaacaaagagac

SEQ ID NO: 2236 - DNA, 140 bp, Homo sapiens
cggcacgagcccaaacccactccaccctactaccagacaaccttagccaaaccatttacccaaataaagtataggcgatagaaattgaaacctggcgcaatagataattagtaccgcaaggaaaagatgagaaaattatt

SEQ ID NO: 2237 - DNA, 200 bp, Homo sapiens
gatcaacgcctcactgaaacatggctgtgtttgcagcctgctctagtgggacagcccagagcctggctgcccatcatgtggccccacccaattcaagggaaggaaggaggaatgcttggactctgaggccccttgagaccagatgtgcaagagggttacaacttccttttccgtgtgttactctgttccagcgttccctt

SEQ ID NO: 2238 - DNA, 120 bp, Homo sapiens
aagatcttgcccctctcctttaggtgggtctgcaaagcacaggcatttaccctcaggcctaggggccatcctggaggaggcctcctgaacacgacttagccggccactgtgtaaggacct

SEQ ID NO: 2239 - DNA, 310 bp, Homo sapiens
aagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaacttcaacgactacggggccggcgtccgcttcgtccgcttcg

SEQ ID NO: 2240 - DNA, 448 bp, Homo sapiens
gctccaatgacgtggagatccgggcagagggcaatagcaggttcacgtacactgtcctgaaggattggctgcacgaaacatacccggtaagtggggcaagacttttatcgagtaccggtcacagaggacctcacgcctccccatcattgacattgcaccatggacataggagggccgagcaggattcggtgtggacatagggccggtctgcttcttgtaaaaacctgaacccagaaacacacaatccgttgcaaaccaaaggacccaagtactttccatctcagtcactctaggactctgcactgaatggctgacctgacctgatgtcattcatcccacctctaacagttcggactttctccctctctttctaagagacctgaactgggcagactgcaaaataaatctcggtgttctatttatttattgtctcccgtaagacctcggg

SEQ ID NO: 2241 - DNA, 349 bp, Homo sapiens
gaaattctaacccaagacatgacattcttagctgtaacttaactattaaggcttttacacacgcatttaatagttccattttttctcttgccatttgtaggctttgcccatttgttcttatttggcacatggggtagacacggatctgctgggctctgccttaaacacacattgcagcttcaacttttctcttaagtgttctgtttgaacctaatacttaccgagtcagactgtgtgttcatatcatttcagggtctcgctgcctgtggcttcccaggtcgcctcgaggtgggcaaagggagtacagacacacgttgttgtcaaggatggtttgggactagagctcagt

SEQ ID NO: 2242 - DNA, 398 bp, Homo sapiens
gctatgaaaagactgtcattgaaatcaatacaccaaaaattgatcaagtacctattgttgatgtcatgatcaatgacctttgggtgatcagaaatccgaggttcggatttgaggttggtcctgtttgttttcttggctaagattaggacaaggatcatatcaaatcaacaggaaaatataccttggtgccaccaacctattttgtgccacatgcaagttttgaatagggatggtatagaaaccaccgctgcatatacaggtccatttgggaaatccgcatgcctttgtgggggcagatcacatggcaaagctttgaaaatcataagatatagttggtgtgctagatggaacaggctgattcttgattcccatttctcaccttcttttctatttgaatt

SEQ ID NO: 2243 - DNA, 430 bp, Homo sapiens
gcccgccagaagaatatgaaaaagcagagcgactcggttaaggggaagcgccgagatgacgggctttctgctgccgcccgcaagcagaggggactcgggagatcatgcagcagaagcagaaaaaggcaaacgagaagaaggaggcacccaagtagctttgtggcttcgtgtccaaccctcttgcccttcgcctgtgtgcctagagcagtccaccacgctcgcgtttcctcctctagtgctcacaggtccagcaccgatggcattccctttgccctaagtcttcagcgggtcccttttgtgcttccttccctcaggtagctctctcccctgggccactcccgggggtaagggggttacccttccagtgttttttattcctgtggggatcacccaaagtattaaaagtagctttgtattcaaaaaaaaaaaa

SEQ ID NO: 2244 - DNA, 316 bp, Homo sapiens
ggagccgggagctatccctgcgtccctcccgcagcggggccaacagctcgaggaggaaggcccaatggaggaggaggagggcccagccaattgcggcgccagaaggggaaaccggagcctttctaaccgggccaacgcttggggagcagccaaggcaagttgcgggcgcagacttcgagagccaggacgagggccatggaattttatgacttggaggacgactaccactattcccaagaggagcagctcaattgtgtccgcctacagagtatcacccgctctctaagaggccacacgatttttctcagacacgaga

SEQ ID NO: 2245 - DNA, 274 bp, Homo sapiens
tatgtatcggatttcttcaaagaaagaacttcttttaaagaaagaaaagaggaggactctcatacaacctctgcatgaaacaccaacaactgggattcactatccgaggcattcaccagccttgaaaggcagcagggtgcccaggtgaagctggcctgtttcctaaaggaaaatgattcccacaggccaaggaggtatgcatctctctccctggatgtacaagcctttaaagacttctgctgctgatatgcctctgggatgcacactttgtgtg

SEQ ID NO: 2246 - DNA, 230 bp, Homo sapiens
tccaggttcccctggccctggcatcgacatgtccgcctttgctggcttaggccgagagagaagggccccgacccccttgcagtacatgcgggccgaccaggcagccggtggcctgagacagcatgacgccgaggtggatgccacattcaaggccctcaccacccagattgagagcatcccaagccccgagggttcccgcaagaaccctgctctgaacttgcagtcctgaa

SEQ ID NO: 2247 - DNA, 345 bp, Homo sapiens
gtagaaacgttgggttatggaagactagtttcttccataaccctgaattggagaccttaatgctaagtgtagattattgaggtttgttagtgaggaaaagaataagagttcagaagcctttgttatcagatagcgaaagtcagggcctagtgtaggagcacaggtcgactacataatggagtccattggcgaaccctattgcaatttggtgcaactatatcttctggtgaaggaaattaatgatgtaagaaaatgcaagaggctcaacttctctttcaaaaatcttctggcttctgaactcttctctgcctctctctaaataaataacacagaatttcaagtggt

SEQ ID NO: 2248 - DNA, 458 bp, Homo sapiens
ctaaggactcacccaagctgggtctgctcatggtgcttcttagcatcatcttcatgaatggaaatcggtccagtgaggctgtcatctgggaggtgctgcgcaagttggggctgcgcctgggatacatcattcactctttggggacgtgaagaagctcatcactgatgagtttgtgaagcagaagtacctcgactatgccagagtccccaatagcaatccccctgaaatatgagttcttctgggggctgcgctcttactatgagaccagcaagatgaaagtctcaagtttgcctgcaaggatacaaaagaagggatccaaggaatggacagctcagtaccgagaggcgatggaagcggatttaaggctacagctgaggctgcagctaaagacaaggatagggccgagattagagctcgaatggacatttggctcgcctcagaagaattctgccgggccc

SEQ ID NO: 2249 - DNA, 191 bp, Homo sapiens
gtcgcggcgacatggccaacgtaccaagaaagtcgggatcgtcggtaatacgggaccggctatggggcctccctccggaaaatggtgaagaaatttgaaatcagccagcacgccaagtacacttgctctttctgtggcaaaaccaagatgaagagacgagctgttgggatcttgcactgtggttcctgcat

SEQ ID NO: 2250 - DNA, 172 bp, Homo sapiens
aaaataccttagaatgggtaatttataaacaacagaaatttatttctcacagtttggggaggttgggaagttcaagatcaaggaaccagcagatttgggtgtctggcggagggcttgttcatcataaatgattgcctttcagcggtattcttacaatggaggcttgaaccgc

SEQ ID NO: 2251 - DNA, 198 bp, Homo sapiens
aaatccgggggcaaggccaaaaagaagaagtggtccaagaggcaaagttcgggacaagctcaataacttagtcttgtttgacaaagctacctatgataaactctgtaagggaaggttccaactataaacttataaccccaagctgtggtctctgagagcctaagatctcgagaggcctcccttggcaaggcaagccct

SEQ ID NO: 2252 - DNA, 238 bp, Homo sapiens
accatgttggccaggctggtctcgaactacctgacctcaggttgatcacctgcctttggcctcccaaagttgctgggatgacaggcatgaggcacctcacccaggccaaggtaattattcctgaaaggttgagtaccatgctattgagctagacacttggtgtggtttatcctgtcatcgcctcagatacctacaccaggtggacacgggataggattcctaatttcacagagaggag

SEQ ID NO: 2253 - DNA, 164 bp, Homo sapiens
tatctacccacgtccacgcggccacctcaccctctccgcacacctcttgctgtctttttgtactttttgttccagagctgcttctgtctgggttatttagggtttattcttccttttctttgagagttcgtaaagagggaagccaggattggggactctattga

SEQ ID NO: 2254 - DNA, 121 bp, Homo sapiens
ctacagagaattgcaccgaacagccatctcacaccgagctccagagcccgcaggtcgcagcgagtgcgggcttatctcaacacagtaactctacatgggaacacatctctcmrggttccca

SEQ ID NO: 2255 - DNA, 172 bp, Homo sapiens
agcggaggtctgcttctcggggacgtggctcccaactttgaggccaataccaccgtcggccgcatccgtttccacgactttctgggagacttatggggcattctcttcttccaccctcgggactttaccccaggtgttcaaccaaagagcgtttggagaacttcaaaggttg

SEQ ID NO: 2256 - DNA, 140 bp, Homo sapiens
ctacaggaagggaggggagaggacaagtgataaacacctggagggttgagggatacaggggaacaacacaacttgttggaccttagcgttgttttggaaaaggccaagcagtttgaacctgctgtgtgaggacggaaggc

SEQ ID NO: 2257 - DNA, 420 bp, Homo sapiens
ggaagggaggggagaggacaagtgataaacacctggagggttgagggatacaggggacaacacagctgtggacttagcgtgtttggaaaagccaggcagtttgaccctgctgtgtgaggacgaaggcatggaggaggaatgtcaggaacaagagatgatcaccaggtgtcagaacttggaagatttagagcaaaggacaataggaaaaaggactcacggagttactattcacaatgccagtaagagacacgaccgtcacccttctctattttcacaggccctaaagagctgaagggttacgccctgctgccaacgtgcttaaaaaaagaccgtttctgactctgtgccctgtccctgagctcgtgggagaaagatgacccgtgggaacacttgcctgggcccactcagaatccacgggtg

SEQ ID NO: 2258 - DNA, 276 bp, Homo sapiens
gttgctttttataagaccaagaaggagaaaatccgacaacctggaaagatttttgttttcactgcttgtatgatgtttcccattcatacacctataaatctctaacaagaggccctttgaactgtcttgtgttctgtgagaaacaaatatttacttagagtggaagggcagattgagaatgttccaatccaaatgaatgcatcacaccttacaatgctgctcaattgttgtgagtactatgagattcaaatttttctaacatatagagagcccttt

SEQ ID NO: 2259 - DNA, 303 bp, Homo sapiens
cacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggattttacccttcagactccaggggcagctgtacctctccatcactctattgtagcctctgtgagggctcttttttagacttctctacctcttagagctctaacataatacatatttgggtgttttcaaccactcaagtttgt

SEQ ID NO: 2260 - DNA, 272 bp, Homo sapiens
gcaaaagcagaatcaaccatctcagaggactgtgtagacaagacagatctcatccttttattaacataagtgcttcatgaaggcaggagatgtgaactggacattatggtgtgtgttgaatttggacagattaagatgggatttgggtaggagttaggcttttgacacagacaacagcatgggccaagatggagcagaggtggagatgtaggggatattttggaacagggaagcctgatttagggtgaagtataacttttatagaggagaat

SEQ ID NO: 2261 - DNA, 241 bp, Homo sapiens
cagaggtgacaaaggagaggctggagagcctggcgagagaggcctgaagggacaccgtggcttcactggtctgcagggtctgcccggccctcctggtccttctggagaccaaggtgcttctggtcctgctggtccttcttgccctagaggtcctccttgccccgtcggtccctctggcaaaaatggtgctaattgaatccctttgccccatttggctcctggtgccccttggacgataaag

SEQ ID NO: 2262 - DNA, 310 bp, Homo sapiens
ccgcacgaggtcgtctcagtttgcagctttaaaacagcaggagccaccagctagctcctccaggcagtctaaccattttccagatggttcccatcttcagaggtctttcttatgagtttcaaaacttgtgcccttgcagtttccactcaggcctattagttctgccctgtgggctacagagaacatgcctttcagatacttgaagacagcaattatgactctctccagctgtttactgcttttcaagataaacagacctctccttccatcattgctcaggcataatcctctggggtgacagaaagaacat

SEQ ID NO: 2263 - DNA, 420 bp, Homo sapiens
cggcacgaggtcgtctcagtttgcagctttaaaacagcaggagccaccagctagctcctccaggcagtctaaccattttccagatggttcccatcttcagaggtctttctgatgagtttcaaaacttgtgcccttgcagtttccactcaggcctattagttctgccctgtgggcctacagagaacatgcctttcagatacttgaagacagcaattatgactctctccagctgtttactgcttttcaagttaaacagacctctccttccatcattgctcaggcataatcctctgggatgacagaaagaacatgttatctggggacaggtaacccagatctgaatccagacctcactcatagtcactgtgtaaccctgagcacatcacacctgcctaacagggctcctgtgaggattccaag

SEQ ID NO: 2264 - DNA, 294 bp, Homo sapiens
cagaaatggcacctcgaaaggggaaggaaaagaaggaagaacaggtcatcagcctcggacctcaggtggctgaaggagagaatgtatttcgtgtctgccatatctttgcatccttcaatgacacttttgtccatgtcactgatctttctggcaaggaaaccatcttccgtgtgactctgtggggatgaaggtaaaggcagaccccgatgaatcctcaccatatgctgctatatttggctgccccaggatgtggcccccaggtgcaaagagctcggggatcacccccctacacat

SEQ ID NO: 2265 - DNA, 223 bp, Homo sapiens
aacaatcatgacagaaagggaagtaaacacgtccttcacatggcagcaagagagagaagtgccaagcaaagaggggaaaagtcccttataaaatcgtcagatctcgtgagaactcactcactatcaggagaacagcagcacgggcgtaaccccattggttgggacacagccaaaccatatcaattactatttaattccatttgtggggtcagagtatacatat

SEQ ID NO: 2266 - DNA, 168 bp, Homo sapiens
cagagactttatcaaaaacatgattacagggacatctcaggctgactgtgctgtcctgattgttgctgctggggttggggaatttgaagctgggatctccaagaatgggcagaccccagagcatgcccttctggcttacacactgggtttgaaacaactaattgtcgg

SEQ ID NO: 2267 - DNA, 141 bp, Homo sapiens
gttggttggtatcacagtcaccctggctttggttgttggctttctggtgtggatatcaacactcagcagagctttgaaggcttgtcggagagagctgttgcagttggtgttgattccattcagagttttaaaggaaagggt

SEQ ID NO: 2268 - DNA, 182 bp, Homo sapiens
agaagatgaaaaaaattttatacgttgataaaacttataaatttcattgattaatctcctggaagattggtttaaaaagaaaagtgtaatgcaaggatttaaaggaatatttttcaaggcacaattattttaatattgggtatcaactcgcttgtaaaggggcttcccttttttctttgtca

SEQ ID NO: 2269 - DNA, 188 bp, Homo sapiens
accaagttcaatgctgatgaatttgaagacatggtggctgaaaagcggctcatcccagatggctgtggggtcaagtacatccccagtcgtggccctctggacacgtggcgggccctgcactcatgagggcttcccattgtgctgcccccctcttaatactcaccaataaattctactccctgtcacct

SEQ ID NO: 2270 - DNA, 102 bp, Homo sapiens
gtggaatggaacagtcaggtagttgaaagtttttttttagagatgaaaagcttgtgaactcctgtaaaacatgctgtatttgaaatacatctgttaaaactt

SEQ ID NO: 2271 - DNA, 229 bp, Homo sapiens
atttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactttggtgaagacctccccagacagtcatcagagttctcaggtctgagctcaggtgccccgtgtgtcttt

SEQ ID NO: 2272 - DNA, 158 bp, Homo sapiens
gcagcctccccctggcaggggctcaaggccgacacgctcaaggagcggtaccagaagatcgggggacaccaaacgcgccacgcccatcgaggtcctctccgagaacttcccagaggagatggccacgtacctccgctatgtccgccgcctggaactct

SEQ ID NO: 2273 - DNA, 106 bp, Homo sapiens
gccaagggaaaagtataaactggccttcaaattgtccaattatagtttataaccagtctattaaagggtgtttgtttccaatggatatagttttaggattgtggga

SEQ ID NO: 2274 - DNA, 117 bp, Homo sapiens
  misc_feature 117: n = A,T,C or G
tgtggctctcagccatgccacatccctgttcacacacccagggcatccattcctaagccagacccggctcccctacacctgaggttacactgccagcagtttcccaggcctctcccn

SEQ ID NO: 2275 - DNA, 148 bp, Homo sapiens
acgatccctcccttaccatcaaatcaattggccaccaatggtactgaacctacgagtacaaccgactacggcggacttaattttaacttcttacatactttcccccaataattcctaggacccagggaacctcgagattccttaacgt

SEQ ID NO: 2276 - DNA, 125 bp, Homo sapiens
gccacacaggctatctgaacacgggtgactgtctctccagatggatccctctgtgcttcttgaggcaaggaatggcaaggcctgtttaatgggtctcaaccgaggcaaacaacctttacaacgta

SEQ ID NO: 2277 - DNA, 139 bp, Homo sapiens
gggaaaccgagagggaaaggacttggccgctggagacttcactcattccctagcaaggaaacaaaagcagttaaaaggttggccgagggacaaccctgaaggttcaattccttaaggaactttttgccggaaggcaact

SEQ ID NO: 2278 - DNA, 56 bp, Homo sapiens
tggcttggcgctgttgctttccttgataacttgaacatgcaaatacactatttaga

SEQ ID NO: 2279 - DNA, 460 bp, Homo sapiens
gttggcttggcgctgttgctttccttgataacttgaacatgcaaatacactatttagatagcagagaagagcaatcagatcctacacattccaatgtgtgatcatctttatcatattgcctaaaaacagccttaaacattttttggacttctttgtttgttttgcaagtctcatggccttctggctttaatcaaagtcttgtccattatgatgagaaaataaatgtcagaaacatttaaatttacctaaatgcaagacacataaaaggattatagtcctcctttggcttcagagaaattggcttttcaaaaaaagtttttaagttgactgcatttttgtgaacattaaaaactacattgcatcaaaaaattgcaaaattaagtatatgtaagcaaaatagtacttaaatataaagtttcattgaattttattaccaacattctaaaatttcacaagatat

SEQ ID NO: 2280 - DNA, 116 bp, Homo sapiens
tcaacagagctcatggtcggattacccatacatgagctctccctgccacattgagatgatccttacggaaarggacagattgttcctaaaccagagaggaggttgcccagaaggaa

SEQ ID NO: 2281 - DNA, 203 bp, Homo sapiens
cggggctgcactgccaccctgggcaacttcgccaaggccacctttgatgccatttctaagacctacagctacctgaccccgacctctggaaggagactgtattcaccaagtctccctatcaggagttcactgaccacctggtcaagacccacaccagagtttccgtgcagcgactcaggctccagctgtggctacaacatagg

SEQ ID NO: 2282 - DNA, 184 bp, Homo sapiens
tggaggtgggacccctttcaattttcaagttttgctcatctagggaaaataaggctttggtttccagtttaattgtttttgaccttctaaaatgttttttatgttagcactgataggttggcattactgttgttaagcactgtgttccagaccggtgtcttacttagggtaacctagggaattt

SEQ ID NO: 2283 - DNA, 126 bp, Homo sapiens
atcaagtccctggaggagatctatctcttctccctgcccattaaggaatcagagatcattgatttctycctgggggcctctctcaaggatgaggttttaagattatcccaatacagaagcagaccc

SEQ ID NO: 2284 - DNA, 110 bp, Homo sapiens
tttcacttttaaacctctagatcagaatttgttgactcgcattcagaacataaatgcacagaactctgtacatgtctcccatcaagagagattcattgggcatcccaagg

SEQ ID NO: 2285 - DNA, 102 bp, Homo sapiens
agaaacacttaagatacaaggttcttttgaattcaacagcaagatgcttgcgatgcagtgcggtaaggtaattctcacctcctgtggaatgggcttcaaccc

SEQ ID NO: 2286 - DNA, 102 bp, Homo sapiens
cttgagctttagtgtgctatacctatgtgtcttatcgtgggacactgtgccaataacacaaaaaaacaactgtttgggtttacctcagttcgcagtagttat

SEQ ID NO: 2287 - DNA, 106 bp, Homo sapiens
cttccccacccacggtgttcgtttggttttaaaggtcacctgtctcactcacccagccagcccttaaaggtgccttctacttccagyvacaaagcagaccactggg

SEQ ID NO: 2288 - DNA, 137 bp, Homo sapiens
gcgcctcggaggcgttcagctgcttcaagatgaagctgaacaactccttcccagccactggctgccagaaactcattgaagtggacgatgaacgcaaacttcgtactttctatgagaagcgtattgccacagaagtt

SEQ ID NO: 2289 - DNA, 149 bp, Homo sapiens
ggaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaa

SEQ ID NO: 2290 - DNA, 158 bp, Homo sapiens
cgacactagtggatccaaagaattcggcacgaggagaaaagaagaaacgctcgcgagaagaatgctggagataatgatgacacaaagggtgctatttgtgtcaagaacaaggtggctggagggaaaatgaagaagcggaaaggccgttaatcactttt

SEQ ID NO: 2291 - DNA, 233 bp, Homo sapiens
tggttccgaaaattggaataggtgccaaggatctggagatgacaacttgacttctctggggactctgaacttccctggtcgaacagttttttctaatggctattcaaggtaagatcagtgtttttctgtttcttaagaaatgggacaattaaggtagattaatagatgtaaatctctcattgatttatatgtgtgtctctaaagagatcatgtgctcttttatatataataag

SEQ ID NO: 2292 - DNA, 126 bp, Homo sapiens
atcacctaccactgcaagaacagcattgcctatctggacgaagcagctggcaacctcaagaaggcccttctcatccagggctccaattacgtggagatcccggcagagggcaatagcaggtttaag

SEQ ID NO: 2293 - DNA, 136 bp, Homo sapiens
atcgtgcgggaagtcgacaggccgggatccaaggtgaacaagaaggaggtggtggaggctgtgaccattgtagagacaccacccatggtggttgtgggcattgtgggctacgtggaaacccctcgaggctccgacc

SEQ ID NO: 2294 - DNA, 158 bp, Homo sapiens
ctcgtgccgaattcggcacgagggctttttaccaagcatactgcctgcaaacatattgttaacaaggcacatcctgcacagccctaattccattaaaccttgattcaatatagcacatgtttctgggggcacagagttggggctaaatttacagatta

SEQ ID NO: 2295 - DNA, 111 bp, Homo sapiens
atttttggtccgcacgctcctgctcctgactcaccgctgttcgctctcgccgaggaacaagtcggtcaggaaggcccgcgcgcaacagccattggtttttaaggataccgg

SEQ ID NO: 2296 - DNA, 140 bp, Homo sapiens
ggaatattctgttgaccataaaaccttgatatcattctgtgtatatagaatgtaaaaggaatattacagtgttaactgccatatatgtaatatacacaaactcaattagcattgtaatggccaaatgcattcccccatgc

SEQ ID NO: 2297 - DNA, 167 bp, Homo sapiens
cccaaacctgttaatattttgagcgcttctatgtgaaagcaaagaaataattttaatactctggcattcataaattttattgatgagattatttattttaaaggtttgaggtaacatctcttggttgtacccaagaagaaataaatatgggttcttaawctcttgca

SEQ ID NO: 2298 - DNA, 167 bp, Homo sapiens
gttgttctggatccgtcgtacttaagggaattttccaatgtcgggccttgtgtgctgcaatgggggggggtgtcctttgttccttgcgcggggcccctttggtggcgccatcttgtcttccggtgggcagagcctattttaagggggagtggtggctctttttcttt

SEQ ID NO: 2299 - DNA, 520 bp, Homo sapiens
gttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaacagcctctcacggaggcatcttatgttaacctaactacattgcgctgtgtaacacagattctcctctgcgctatgtggacattg

SEQ ID NO: 2300 - DNA, 181 bp, Homo sapiens
cttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgccctatcaaatgagtttttcccagttaaggaggggggtcttt

SEQ ID NO: 2301 - DNA, 268 bp, Homo sapiens
cggcacgaggcaaaaccaggattagaatccagagctattggcccatggtcttcccaccacaaactattgttattgaaaataggatcaggttcctttagatgtttaataacccttatgagttaaaatgctgcctaatattttggcatcaaacatttatagctcttaataaaacttacctctacaggtacttctcacttttattcttatgtctaaagggtgtggagacatatatcacactgtttttcacacgcagattatgactctcttg

SEQ ID NO: 2302 - DNA, 470 bp, Homo sapiens
acactagtggatccaaagaattcggcacgagcggcacgaggcaaaaccaggattagaatccagagctattggcccatggtcttcccaccacaaactatgttattgaaaatagatcaggttcctttagatgtttaataacctttatgagtgaaaatgctgcctaatatttggaaatcaaacatttatagctctaaataaaacttacctctacagttacttctcacttttattcttatgtctaaagggtgtggaaacatcattgaacattgtttttcacacgcagatgagactctgttgaagggagttttgtggtttaggggtttagggggttacaggtacctttgagaatctgatgacagctgtggacatggacaaacacgtgtatgcccagacccagcagttttactcgtggcatccgggcagttcaaagaccccatcatgaggatcctgatttggaggctctgcaccat

SEQ ID NO: 2303 - DNA, 241 bp, Homo sapiens
gcccagcctcgaaatgcagaacgacgccggcgagttcgtggactgtacgtgccgcggaaatgctccgttagcaatcggatcatcgggtgccaagggccacggatccatccaggtgacggtggccaagggttacaagggcacaagcagggtttattgccagtttaaaccttttgcttttttcggggccaattggtggattggtagagaaagatgtcccaatccccagttgccaaagccagtg

SEQ ID NO: 2304 - DNA, 404 bp, Homo sapiens
gctgatccgagtccactcggctccccgctccggggctccggctgcagagagcacggagatcgtgcgcggctacacgtgggctgagtaccatgcggacatctacgccaaagtgtcgggcgacatgcagaggcaaggctgcgactgtgagtctctggccggcgggcgcatctcccaccagagtcaggacaagaagattcacgtgtacggctattccatggcctatggccctcccagcacgacatttcatctgagaaaatcaaggccaggtaccccgtctacgaggatcacctggtctaacgacgtctactgcagcacttccagcccggggtctgctgcctcagcagcactcagagccccgcctttgcctcactctctagagggctggccttcctctctgcgcagct

SEQ ID NO: 2305 - DNA, 145 bp, Homo sapiens
gcgcagtagtgctagcggcttcgcggttcggtcctcgcaccccgcagccgcactggtgctgagctgctaggaaggccctatcgccgagctcgttggagcttgaacccaatttcaacccctccgactcaaccgccccaaaaaaaaa

SEQ ID NO: 2306 - DNA, 200 bp, Homo sapiens
tggagttactgaaggtctccaaggacaaacgggccctcaaatttatcaagaaaagggtggggacgsacatccccgccaagaggaagcgggaggagctgagcaacgtacttgccgccatgaggaaagctgctgccaagaaagactgagcccctcccctgccctctccctgaaataaagaacagctttacagagaaaaaaaa

SEQ ID NO: 2307 - DNA, 212 bp, Homo sapiens
aaaatttgatttagcattcatattttccatcttattcccaattaaaagtatgcagattatttgcccaaatcttcttcagattcagcatttgttcttttgccagtctcattttcatcttcttccatgggtccacagaagctttttttctttgggcaagcaggaaaattaaattgtacccatttttgtatatagtgagatgtttaaataaattg

SEQ ID NO: 2308 - DNA, 458 bp, Homo sapiens
cctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtgtggctcatgccttaatcccaccactttttttttaaggcaggcggatcacctgaggtcaggagtttaagaccagcctaccaacatggagaaacctcgtctctactaaaaatacaaaaattagccaggcatggtggcacacgcctatagtccagctactcaggaggctgaggcaggagaatcactttaccc

SEQ ID NO: 2309 - DNA, 380 bp, Homo sapiens
ggaaaattaattttacttttttttttgttctggccgaaatttttatgagatatctctcacttgtcttccactttgaacccggttaaagctcatagctktcagctctgaatggaggaggggagaagcccctggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacagttttcgactaccagaaaggggagtccttggttct

SEQ ID NO: 2310 - DNA, 245 bp, Homo sapiens
cttccctcccatctgggcagtgtagtccctcctcgtgcttcccttctctcccctgacccctggaacgagggatgcttatcatgtttaagaactcattggcctctaccctaccttagagcttcacttcatcttcagtagcaaatggattggtagctattctcaccattgacatggatagcctgtcccagcatgattgggggggtatcaggcagggggagtcgacatctcttggaacagagcatcta

SEQ ID NO: 2311 - DNA, 250 bp, Homo sapiens
cccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctccctcggcctccaaccggtctggaataccaggcataagccaccatgcctggccaggctttggtttaaataatatatatggatctatgcgctcatc

SEQ ID NO: 2312 - DNA, 335 bp, Homo sapiens
gcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtgctcggctatttttgtgtcatttattcaagtattgagaacctcggcctgtggtaggcactgtactctaatactaggatacagagatgcaaaagatacgggcccatgcaattttattaaatgcatcaatatgtattacaaaaaaaaaa

SEQ ID NO: 2313 - DNA, 290 bp, Homo sapiens
cgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctgttttaaaaataaaaaaaa

SEQ ID NO: 2314 - DNA, 260 bp, Homo sapiens
gttgattgtgattatctcaaagccaaaatattcagtaaattcagttttttaagagccttgctttattaccagcacaaattaccagcatttgtgattgtatagtgcccaaaatgcaaggactgagacttgaacttttttttatgccccccagcacacttagcccagtgtgaggcatataatgggcccttagtaaaatacctgttcatcaattgttatagaaataacaatttgttaattcatttagcaggtaattattgagc

SEQ ID NO: 2315 - DNA, 290 bp, Homo sapiens
cgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatgggaaatcccatcaccatcttca

SEQ ID NO: 2316 - DNA, 360 bp, Homo sapiens
cgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgacccttcattgacctcaactacatggtttacatgttccaatatgattccacccatggcaaattccatggcaccgtcaaggctgagaacgggagcttttcatcaatggaaatcccatcaccatctttcaggggcgagatccctccaaaatcaagtggggcgatctggcgctgagtacgtcgtggagtccactgcggtcttc

SEQ ID NO: 2317 - DNA, 135 bp, Homo sapiens
ccgcggcgggagaggaacgcgcagcagcctttgggaagccaggcccggcagccatggcgttggaggaggattaatttgttagttcttgctctacgtgcctctgctggcttttgcgctgtccagttgggactgatt

SEQ ID NO: 2318 - DNA, 220 bp, Homo sapiens
cccgcaagaagctcctggctgaccaggctgaggcccgcaggtctaagaccaaggaagcacgcaagcgccgtgaagagcgcctccaggccaagaaggaggagatcatcaagactttatccaaggaggaaggagaccaagaaataaaaccttccactttgtctgtacatactggctctgtgattacatagatcagccattaaattaaacaggcttcatctgc

SEQ ID NO: 2319 - DNA, 125 bp, Homo sapiens
cttttatctaaaatttccttaccaggcttaaatcattgccttttaaaaaatgtgtactataagtactttttgttaggtgagctctctagtattaacttggtgagactgatttgtaggaccacatc

SEQ ID NO: 2320 - DNA, 136 bp, Homo sapiens
cttttatctaaaatttccttaccaggcttaaatcattgccttttaaaaaatgtgtactataagtactttttgttaggtgagctctctagtattaacttggtgagactgatttgtagtaccaaatcttttttttttt

SEQ ID NO: 2321 - DNA, 205 bp, Homo sapiens
ctcgtgcgaacagtttgccagctaaattcaaaaaactcctggtgccaggaaaaattcagcacattctctgcacaggaaacctttgcaccagagcagagttatgactatctcaagactctggctggtgatgttcatattgtgagaggagactccgatgagaatctgaattatccagagcagaagttgtactgttggccagttcaac

SEQ ID NO: 2322 - DNA, 186 bp, Homo sapiens
ttgtataattggacatttaggattttaactttagatgatcatttggttccatttttatttcatttttatttttgttaatgcaaacaggacttaaatgaactttgatctctgttttaaagattattaaaaaacattgtgtatctatacatatggctcttggggccttagctttcactacactacagg

SEQ ID NO: 2323 - DNA, 204 bp, Homo sapiens
cttgacgaggctgcggtgtctgctgctattctccgagcttcgcaatgtcgcctaagggacggacaagaggaagaagggacggttggaaaggtcggccaagaaagacaaagaccccagtgcacaaataccgggggcaggacaaaaaggaggagttgttccacagccaagttcgggacaagttcattaacttagtctgtttttaca

SEQ ID NO: 2324 - DNA, 200 bp, Homo sapiens
aagacgtgaaccagcaggagttcgtcagagctctggcagccttcctcaaaaagtcccggaagctgaaagttcccgaattggtggataccctcaagctggacacagcacaaagagctttcttccctacgatgagaacttgttctacacgggagctgactttcacagcgcggcacctattaccttccgggtgagcgcttggg

SEQ ID NO: 2325 - DNA, 190 bp, Homo sapiens
ctagagcttgtctcaatggatctagaacttcatcgccctctgatcgccgatcacactctgagacccaccctttgctcataaacaaaatgcccatgtttggtgccctgcccttggacctgtgacaatctggcctatttctgtgtttatatggtgggcgcagtgtaacaaacatataataaatcaccctttt

SEQ ID NO: 2326 - DNA, 196 bp, Homo sapiens
cccaattggaccaatctatcaccctatagaagaactaatgttagtataagtaacatgaaaacattctcctccgcataaggcctgcgtcagattaaacacttgactacaattaccagcccactatctccagtcaaccaccaggtcattattaccctcactgtcaacccaccacaggcatgctcatagggaagggtaa

SEQ ID NO: 2327 - DNA, 239 bp, Homo sapiens
ataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaccccaagtcaaggcacatggcagaggatgctgacattcttgggat

SEQ ID NO: 2328 - DNA, 207 bp, Homo sapiens
gttcactctacttagcatgtccctaccgagtctcttctccactggatggaggaaaaccaagccgtggcttcccgctcagccctccctgcccctcccttcaaccattccccctgggaaatgtcaacaagtatgaataaaggcacctactgaggtacatttccatggggaatggtttctcgtgccgaattcggcaggggcgtaagtcgg

SEQ ID NO: 2329 - DNA, 169 bp, Homo sapiens
ctcgtgcaattcggcacggaagaacatgaggaccctctggattaatcgaattacagctgctagccaggaacatggactgtaagtatccagcgctcatttggaattagttaagtgccaagtggagctcaacaggaaagtcctagcggatctggccatctacgagccaaag

SEQ ID NO: 2330 - DNA, 215 bp, Homo sapiens
gagaaatcgcttggacttcggggcggcctcggacggccatggctttaccctgtactcactgctgcaggcagccctgctctgcgtcaacgccatcgcagttctgcacgaggagcgattcctcaagaacattggctggggaacagaccagggaattggtggatttggagaagagccgggaattaaatcacagctattgaacctattcgatctgtaga

SEQ ID NO: 2331 - DNA, 250 bp, Homo sapiens
atcgatctgggtatcaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatcctatcctggcaaataaattcccgtttctatccaaaagagccataaagagttttcagtgaaatgtg

SEQ ID NO: 2332 - DNA, 186 bp, Homo sapiens
cttcggcccacttgctcacacggtgaagcagaagctcttcaccgaggtggaggggacctccacagggaagtatggctttgtaattgctgtcaccaccattgacaatattggtgctggtgtgatccagccaggccgaggctttgtcctttatccagttaagtacaaggccattgatttccggccatt

SEQ ID NO: 2333 - DNA, 250 bp, Homo sapiens
gcggagactgcgggcccgtagctgggctctgcgaggtgcaagaaagcctttgaggtgaaggtgtatgaaagtcatcataacagatgttttccaaaaacttgtaggaggttgtgaaaaacctactagggtcacgcggcatgtattgagcatataggttgctgtagatgaatgttcttagctgtctatgtttaaaaatacttcctgcttcgtaccccaagtaagggatttgtcaagcaaccatgtctccgac

SEQ ID NO: 2334 - DNA, 195 bp, Homo sapiens
gaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctg

SEQ ID NO: 2335 - DNA, 245 bp, Homo sapiens
cggcacgagttatggttcccgatgatcctctgggaagaagtggacctcgattagaggagtttcttcagaaggaagtctgtcttagagatatgcagcccctactcagttccctgccaaatgtgggcatgtttgaccccagcttcagagtccctggcacccaggcagccagcaccagccaccagtcttcgaccggattcagggagccccttcaagccacttgcttccgtaagaagcccactttgcca

SEQ ID NO: 2336 - DNA, 210 bp, Homo sapiens
ctcgtgccgaattcggcacgagccggggcagagggcaatagcaggttcacgtacactgccctgaaggatggctgcacgaaacataccgtaagtggggcaagacttttatcgagtaccggtcacagaagacctcacgcctcccatcattgacattgcacccatggacataggggggccccagcaggattcggtgtggacatagggccgtct

SEQ ID NO: 2337 - DNA, 180 bp, Homo sapiens
gtgcgaattcggcagagcgggagaaggtgcgccgcatcatggagtcctacttccgcctggatacgcccctctacttttcctactctcatctggtgtcccgcactgccatcggacgaggtccaaggcagagaggaaggtatgttagtcatccagttcacgtggacaactgcatcctgattg

SEQ ID NO: 2338 - DNA, 219 bp, Homo sapiens
cagtacaagatccagactggttcttgaacagacagaaggatgtaaaggatggaaatacagccaggtcctcgccaatggtctggacaacaagctccgtgaaggacctcgagcacctaaggaggattcgggcccctagggggcttcgtcacttcttggggcctctgtgtcccaggcaggacaacaagacaccttgccgccgtggccgaaccctgggttttt

SEQ ID NO: 2339 - DNA, 258 bp, Homo sapiens
gcagtacagatccagactggttcttgacagacagaaggatgtaaggatggaaatacagccaggtcctagccaatggtctggacaacaagctccgtgaagacctggggcgacttaggaggattcgggcccatagagggctgcgtcacttctggggccttcgtgtccgaggccagcacaccaagaccactggccgccgtggccgcaccgtgggtgtgtcaagaggaatatgtctgtaggccttgtctgttaataagtagt

SEQ ID NO: 2340 - DNA, 141 bp, Homo sapiens
tgaagtctttctattgcaccgaggttgttttttgtaatagtatttgtggaaatggaattttagccagatgctgtccaggtacactggggcagatttttatttacatccaataaaaatcacactacctcactatatgtaagc

SEQ ID NO: 2341 - DNA, 178 bp, Homo sapiens
tgaagtctttctattgcaccgaggttgttttttgtaatagtatttgtggaaatggaatttgagccagatgctgtccaggtacactgggcagattttatttacatccaataaaaatcacactacctcactatatgtaagcaaaaaaaaaaaaaaaaaaaaaaaaaaaaaaaaaaaaaaa

SEQ ID NO: 2342 - DNA, 147 bp, Homo sapiens
tgaagtctttctattgcaccgaggttgttttttgtaatagtatttgtggaaatggaatttgagccagatgctgtccaggtacactgggcagattttatttacatccaataaaatcacactacctcactatatgtaagcaaaagaaaa

SEQ ID NO: 2343 - DNA, 204 bp, Homo sapiens
ccgtcatctactctaccatctttgcaggcacactcatcacagcgctaagctcgcactgattttttactgagtagggctagaaataaaccatgctagcgtttattccagtggtaaccaaaaaataaaccctcgttccacaggaggtggccatcaagtatttcctcacggaaggaaccggatccataatccttctaatagctatcc

SEQ ID NO: 2344 - DNA, 158 bp, Homo sapiens
ccgtcatctactctaccatctttgcaggcacactcatcacagcgctaagctcgcactgattttttacctgagtaggcctagaaataaacatgctagcttttattccagttctaacccaaaaaataaaccctcgttccacagagagctgccatcaagta

SEQ ID NO: 2345 - DNA, 188 bp, Homo sapiens
cttcgccacgtgctggccacgctgggtgagaggctgacagaagacggagtggagaagttgatggcttggcaagaggactccaattgctgcatcaactatgaagcatttgtgaagcacatcatgtccagctaaacctcggtgcccagggagcccagggaaaggctgtgcagggagcgtctcatctccca

SEQ ID NO: 2346 - DNA, 154 bp, Homo sapiens
cttagccaaaccatttacccaaataaagtataggcgatagagattgaaacctggcgcaatagatatagtaccgcaagggaaagatgaaaaattataacccagcataatatagcaaggactaacccctataccctctgcataatgaattaactag

SEQ ID NO: 2347 - DNA, 117 bp, Homo sapiens
cggcacgagagtacttctagagcggccgcgggcccatcgattttccacccgggtggggtaccaggtaagtgtacccaattcgccctatagtgagtcgtattacaattcactggssvg

SEQ ID NO: 2348 - DNA, 185 bp, Homo sapiens
ttaggatcacagctctggaggcagatagcctgaattttccaattctgactgccttactagtgcctgtgtaaccctgagcaaattactttactctgtgcctccactctcctcaattaaaaaataaaatgtggttaataatagtaactggcctcaaaggggttgctgtgaggattaaattagtatgt

SEQ ID NO: 2349 - DNA, 194 bp, Homo sapiens
cccgtatggggctcttaaagccgctgcctcccagagaccttccggtgttgcgccgccccggccaagcctcagcctttctgggccttagcttcttcacgtgtaggtggggagggaggacttgaccacctgttgcggctttggagcccgcacgccctaggtatatcctgaggtgcaccgcgaggtgtgagtcggtg

SEQ ID NO: 2350 - DNA, 177 bp, Homo sapiens
gttttgacaaatgtacatacacggcaatctattttttatttcaccaccccagaaggttccttcatgcccttttcccagtcaatacctcctcatccccaagggtacttttcctttccccatagcttagttctctgttctagaatttcctggaaatggaatyacacagtatgaactttt

SEQ ID NO: 2351 - DNA, 551 bp, Homo sapiens
gttttgacaaatgtacatacacggcaatctatttttatttcaccaccccagaaggttccttcatgccctttcccagtcaatacctcctcatccccaagggtacttttcctctccccatagcttagttctctgttctagaatttcctggaaatggaatcacacagtatgaactcttttgtgtttggcttctctctcccaacacgatgtttttgagtcatcaggttgttgcctgtaccaggttaaataggatatcactaacagcgagatagtgttaagaaggggacaatttttaccccgttggcctccaggctagatactacctatatcctggtaagtggccctccttgcccttccaagtgagtctctctccagggccatgcaagttcctctcccagaaccgctcaggcggcctcgggcaccacccagatggctgcggggccatcaccaggtcgcctccccagaacagctgccccctgcttccccccagccccattaaaactcaaaagggaactctggccctctgccgatcagaattcagactcgcttaattc

SEQ ID NO: 2352 - DNA, 224 bp, Homo sapiens
tgctgactacatagaatggggttgagagaagatcagtttgggcttcacagtgtcatttgaaacgttttttgttttgttttgtaattattgtgggaaacctttcaagtgaaccggagggtggtgtccaccttttggttgaggggttggaccaaggggttggctttgatcccattggggctcgggggggttcccccgaagcttttcctttggcgggttttttaaat

SEQ ID NO: 2353 - DNA, 184 bp, Homo sapiens
agataaagaaatcaaggagatgagacccaaggtcagcagccacctcaacgtcggtaccgcgcaacttcaattaccgacgcagacgcccagaaaacccttaaccacaagatggcaaagagacaaaagcagccgttcccccacctgaggatttcgtccgttcccgagcttatccgggcggggcttt

SEQ ID NO: 2354 - DNA, 107 bp, Homo sapiens
gcgaggtgcctttggaaagccccagggcactttggccaaggttcaattgtgacaaggttttcatgtccatccgcaccaagctgcagaaccaaggagcaatgtatgtt

SEQ ID NO: 2355 - DNA, 214 bp, Homo sapiens
ctcaccacctgcatcagcgcccattgtccgcggagaagcccgacggccccctgaactactctctcggtggctgcgccgggagccttgactctggggagcacgaacggacaaactacggggtttggcgccgccgcctgcgttatactttggcatagcgcgcctccctggtcacgattgggccgccttgggggtctgggaggtgtttacaaaaccc

SEQ ID NO: 2356 - DNA, 129 bp, Homo sapiens
cggcacgagcagaatggaaagtatttctatttgtcctttttttgttttctgttctaattgtcagggacatatgtagtggctataggtttacttaaaaggaataaatttggcatgctcaaaaaaaaaaaa

SEQ ID NO: 2357 - DNA, 140 bp, Homo sapiens
gaagttttgctttcactgaagccccaagatcttctgctagccgtggtaaatgaagctggctacagttgagtagcttggtgaagcaaaggtagagagcaaatcgagatacgctgattagtaaggtgaggtgaattccaccg

SEQ ID NO: 2358 - DNA, 540 bp, Homo sapiens
gaagttttgctttcactgaagccccaagatctcctgctagccgtggtaaatgaagctggctacagttgagtagcttgggaagcaaaggtagagagcaaatcgagatacgctaataaggaaggtagtagaagccacgtggaagagaagaagaaaattcataattaaaaatgagctgctcaagttaggacccaaattataatttttaaaatgtaattttctttgtgtctaacaatttgcaatttttcatagcataagcacattcattaatatgacccattcacagcaatatttagctgtcttttatgtaagtttatatgtgtgtgtatatatatgacgaaggtttatatatacacacacacacatatggcatgatttactcacaagttaacattttaacaattcaatatgaaatgtaattatacaagatgctattttaaagagtacttctagagcggccgcgggcccatcgattttccacccgggtggggtaccaggtaagtgtacccaattcgccctatagtgagtcgtattacaattcac

SEQ ID NO: 2359 - DNA, 106 bp, Homo sapiens
gcctgaatttcttggaccatactccaactttcttccgccgactacgtaagatttccgcaatcccaattccaggatttccccgataaacgacggcccaaaaaaaccc

SEQ ID NO: 2360 - DNA, 554 bp, Homo sapiens
gcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaa

SEQ ID NO: 2361 - DNA, 103 bp, Homo sapiens
ggtcgcaattgttcggccatgaacttcccttggccaaatcgctggagttaaaccttggggcgtcaatatggtcccgccgggttttcaccacagggcttacctg

SEQ ID NO: 2362 - DNA, 163 bp, Homo sapiens
tagtcgcctgaatttcttggaccatactccaaacaccctagaaaacttaaaaataaagatgccctatccaaaggaaaaatgcggagtcagcgaggaaacccccccaatcatccaaagaaaaggaaaggccttcgagcaacgtccccgacagcccccgccccct

SEQ ID NO: 2363 - DNA, 553 bp, Homo sapiens
gcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtc

SEQ ID NO: 2364 - DNA, 215 bp, Homo sapiens
ctatagtcgcctgaatttcttggaccatactcagatcgcaacttgtatcttactcatcttcaatctaatcaaaagtagtaatacgatatccaagcctccccctcttaaactctcaggtaagaaggcaataaaaaaatttaggtaggtaagggagaggctaagttaggggtgtcctgagcaacgcgatggtggggtctcccctggtgccctctccc

SEQ ID NO: 2365 - DNA, 219 bp, Homo sapiens
ctcgtgccgaattcggcacgagcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgcttttttttttttttt

SEQ ID NO: 2366 - DNA, 216 bp, Homo sapiens
gcttgctgtgcggagggcctgctatggtgtgctgcggttcatcatggagagtggggccaaaggctgccgaggttgtggtgtctgggaaactccgaggacagagggctaaatccatgaagtttgtggatggacattatgatccacagcggagcacaatgttaacatacatacagttgacaaatcatgttcagccaaagtgtttgcattaaacaagag

SEQ ID NO: 2367 - DNA, 280 bp, Homo sapiens
gctaaatcccctagaagtcccactcctaaacacatccgtattactcgcatcaggagtatcaatcacctgagctcaccatagtctaatagaaaacaaccgagaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcact

SEQ ID NO: 2368 - DNA, 279 bp, Homo sapiens
gtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaggaggaccatcacattttcagtctgtctctaggatgcttactactgaaaagggtttaagtgcaaactatgttaaaaaggtaaccaaag

SEQ ID NO: 2369 - DNA, 268 bp, Homo sapiens
ctcgtgccgaattcggcacgaggtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcagattacattgcagtgaagggggagtatgccaagtacctccctcacggtgcagggcgttttgccgccaaacgttccgcaaggctcagtgtcccat

SEQ ID NO: 2370 - DNA, 163 bp, Homo sapiens
attctagcacccctaatgatttcttcatgatagactcaacttcgagccctaatccctggaaaccacaaaaagtttcactatcattaaagctttacctatatcagtatatcaagtgaatggaatcatacagtatataaccattttgagtctgtcatctttcact

SEQ ID NO: 2371 - DNA, 186 bp, Homo sapiens
gagaatgaagactattctcagcaatcagactgtcgacattccagaaaatgtcgacattactctgaagggacgcacagttatcgtgaaggggccccagagggaccctgccggagggaccttcaattcacatcattgtaggacctcagcctccttggaaaggaaaaaaaggagctccgggttgcaaaa

SEQ ID NO: 2372 - DNA, 186 bp, Homo sapiens
attgagctcataaggtacttacattactacctataaatgtttcctgtacttgttagttgttgagaaacattttaggcagtaaataaaatagtaaatattatgtgtcctataatttgaccctaagctgtgtgcctttggattcagctctaggccagggccccctgggggtcatgttaggaaccacgt

SEQ ID NO: 2373 - DNA, 233 bp, Homo sapiens
ggagaatgaaatgatattagttgagaatgaatgacagactacttaggataacatgtatgccaagtgagttgaatcagctgatgtagtagtatgactgacagtttttgttgaatatttatgaatctattaaattaggaaatgaaatggtctctaaatatcctcatattgtggccatcctctgggttttaatcctaccatacctctattatttgtggccaccctcattctctgcm

SEQ ID NO: 2374 - DNA, 550 bp, Homo sapiens
ggagaatgaaatgatattagttgagaatgaatgacagactacttaggataacatgtatgccaagtgagttgaatcagctgatgtagtagtatgactgacagtttttgttgaatattttatgaatctattaaattaagaaatgaaatggtctctaaatatccttataatgtggacattctctgagtttttattctaacataactctaataatttggacaacctcaatatctgacagcatatttcccttgtgatataaagtcagtctcagacatggtctcctctagggaaccttccctaaatgccactacaactgtccatgcccaaatctgaagcttctcctggctccttctctttttctccttgacactgtgcttatattactactacaaaggccccaaaacacagcagagaataatttgttaaatgagttaagtccatttgagacctgtaaagtgactttcactgttaacaatagtccccctctgtgggtagaagcaagaatgagtttccaaacttgggaggttgaggttctggcatcacaggaatactc

SEQ ID NO: 2375 - DNA, 151 bp, Homo sapiens
gacacttcgagttcagacttttagcttccagaactgtgagactatacggttttgttgtttaagacccccggtttgtagtactttgttacagcagttctaggcaattaatacaggtatattattagggctttaggcttttaccttctttttt

SEQ ID NO: 2376 - DNA, 135 bp, Homo sapiens
gagagttgcggtgggtgtcatcaaagcagtggacaagaaggctgctggagctggcaaggtcaacaagtcttgccaggaaggttaggaggctaaattaatatatatatccctataaacctcgcccacccacactct

SEQ ID NO: 2377 - DNA, 190 bp, Homo sapiens
atgatgtgggaggcctacttggacgctgacttttgccctggaccctgacaaggccaccaaccttcaaccaaacccccgtgtattccaacaactcttacaaatggggggtccattgcaaggtcgccactcccttggccagcacgggacgagaagcgagaacctccttggcccggggcccttaaggacgaga

SEQ ID NO: 2378 - DNA, 108 bp, Homo sapiens
cggcacgagagtacttctagagcggccgcgggcccatcgattttacacccgggtagggtaacaggtaagtgtaacccaattcggcctatagtgagtcgtaatacaaaa

SEQ ID NO: 2379 - DNA, 157 bp, Homo sapiens
aagtcaatgtcctctacgaccgacaaggcatcggcaggagaatgcgcgggctctttttctgatgagggtacttgaagggctgatgggacaaggggtcaaggcaactattcccaaagggggaggggcactacaatttccctggagaagaaacccctgt

SEQ ID NO: 2380 - DNA, 216 bp, Homo sapiens
cagccatgagtatgctcaggcttcagaagaggctcgcctctagtgtcctccgctgtgcgcaagaagaaggtctggttagaccccaatgagaccaatgaaatcgccaatgccaactcccgtcagcagatccggagctcatcaaagatgggctgatcatccgcaagcctgtaccggtccattcccgggctcgatgccggaaaaacactttggccgccg

SEQ ID NO: 2381 - DNA, 142 bp, Homo sapiens
tggcctggtcacccaccgtgttcttcgacttgccgtcgacgcgagcctttggccgcgtctcctttgagctgtttgcgggcaaggtccaaagacagcggaaaattttcgtgctcttagccctggtgagaaaggttttggtttt

SEQ ID NO: 2382 - DNA, 197 bp, Homo sapiens
agcaaaacttgtttgggagtaggaaagtgagagggcttaatgcttgccttaatttctgttaactctttattttgttttttgggggacggggtctcactttgtagcccaggctggatggagtccaagtggtgccgatctgggcttaactgcaaccctctgcctccctaggctaaggcgattcgcccccctaagtctct

SEQ ID NO: 2383 - DNA, 289 bp, Homo sapiens
ccatggcgcaggggcagcgcaagtttcaggcgcacaaacccgcaaagagtaagacggcagcggcagcctctgtaaaagaatcggggcccaagaaaaggcgggtcggtgtttatcgcttcccaagaaggcgcgcgtcgtgcagcagcaaaagctcaagaggaccccagaagtcggattccggaagagatcgacattacgtggtgatgaaagccagcagcagcctgcccaagaagctggcacttctgaagggcccagccaagaagaaaggggcagcttcgccacctctcta

SEQ ID NO: 2384 - DNA, 169 bp, Homo sapiens
ggctccacgagggttcagctgtctcttacttttaaccagttaaattgacctgcccgtgaagaggcgggcataacacagcaagacgggaaggccctattggggctttaatttattaatgcaaacagtatccttacaaacccacaggggctaaacttaccaaacctgcatt

SEQ ID NO: 2385 - DNA, 238 bp, Homo sapiens
gagcgacttcttcaacattgagccttccaatcatgattttcaattcatttaggtcttctgtaatgtttcttaatataattgtatttgttgctatgcagaagtttcactgatcttttattatatctctatatatatttgatatttctgacactattgtaaatagkatctttttaatatttcattttccttttttgttgcttaaatatatataaaataagctaatttgcccactaatttt

SEQ ID NO: 2386 - DNA, 323 bp, Homo sapiens
gacattcagacttagcgtgcctaccaaaagcagccgaccatctttcaaaacaagaagagggtcctgctgggagaaacttggcaaggagaagctcccgcggtactacaagaacatcggtcttgggcttcaagacacccaaggaggctatttgagggcacctacattgacaagaaatgccccttcactggtaatgtgtccattcgagggcggatcctctcttgcgtggtgaccaagatgaagatgcagaggaccattttcatccgccgagactatcttcactacatacgcaagtacaaccgcttcgagaggcgccacaagaacat

SEQ ID NO: 2387 - DNA, 185 bp, Homo sapiens
aaaaatgtgccaagagttttaccttaaatcatacttggttgttgatttttatcaaatgtcttttctgcatgtgagataatatggttgttcccattttatttgtttatatggccaagtacgtggtatgaactattcttgaattcctgggataaactcaagttgtttatggggtgttatatatttaa

SEQ ID NO: 2388 - DNA, 125 bp, Homo sapiens
tcgtgccgaattcggcacgaggctgatgaaagagagcttgcagaccggagaccttctgagcaccttccacaccattctcggcttcagttccaacttaaggcttcttccttccttcctttccttta

SEQ ID NO: 2389 - DNA, 104 bp, Homo sapiens
gagaaaatgttgttatgtggtttgtatgctacttttggggacagagctcattcagcagcctaatctcctcctttggataattgttaatataataatgatggtga

SEQ ID NO: 2390 - DNA, 105 bp, Homo sapiens
cgaagaggagatattttttaagaagcgtaaattattttcagttgttttctgatcctgcctttttcttttcccacaacttcaaggcagtgtattcggtcaacaaca

SEQ ID NO: 2391 - DNA, 212 bp, Homo sapiens
caaacaacaaagcataatatttcgcccactaagccaatcactttattgactcctagccgcagacctcctcattctaacctgaatcggaggacaaccagtaagctacccttttaccatcattggacaagtagcatccgtactatactacacaacaatcctaatcctaataccaactatctccctaattgaaaacaaaatactcaaatgggcct

SEQ ID NO: 2392 - DNA, 313 bp, Homo sapiens
tgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgtttctcgggcaccgtcaggcttaagtccactccccgccctaagttctctgtgtgtgtcctgggggaccagcagctactttagacgagtgctaaggccgtggatatcccccacatggacatcgaggctgctagaaaaattctcaacaagtataaaaattctg

SEQ ID NO: 2393 - DNA, 157 bp, Homo sapiens
agagtaagataggattcagtgcgcaaaatttgcttttgatgcttattaagagtaaacccatgaatttgaatttttatattatgcttggtacttggaattgatatataccctattaaagcttgaaaacaattagcatttgaatagtaagtttcatcac

SEQ ID NO: 2394 - DNA, 148 bp, Homo sapiens
caaaaatcaagaggcttccttggggatgaagacccccgaggccccggcccattctgaaaagccccggcgaaggcagcacgttgcagaaacctcggaggccaggcccttcccggggtaagttccggtagggtttaacagtccaattttt

SEQ ID NO: 2395 - DNA, 186 bp, Homo sapiens
gaggcgccatcatgggagtggacatccgccataacaaggaccgaaaggttcggcgcaaggagcccaagagccaggatatctaccttaggctgttggtcaagttatacaggtttctggccagaagaaccaacttcacattcaaccaggttgttttgaagaggttgtttattagttgcaccaaccggg

SEQ ID NO: 2396 - DNA, 184 bp, Homo sapiens
tcgtcggaatccttgccgtgttctacagttttaaccaggctcaaaagaaccctactggaattctactggacaggagtacaggccctggccttccgcctaagagaccgtaacctgcgccgccgctcaacaagccgggagccctaaggaccagaggcagccgcaggagggcgcgtctttccctctg

SEQ ID NO: 2397 - DNA, 292 bp, Homo sapiens
ccgagtcgtccggaaatccattgcccgtgttctcacagttattaaccaagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaa

SEQ ID NO: 2398 - DNA, 189 bp, Homo sapiens
ctcgtgccgaattcggcacgaggtgctcctggacttcaccgggggcagcttcagcctcctgcagatgttcctccagtcctacaacagcggccaagttggaccggttggatcttcggagaccaaccaggttggacttgggtcttctccattgtcttggaggtggtcttcttatatccagcacttcttttt

SEQ ID NO: 2399 - DNA, 188 bp, Homo sapiens
ggcaagtcactcaccctctctgagcctcagtgtcctactctgtaaaatgaacccaccaatggtacttatttcctagggcaaatgtgaggattgacagataaaacatgtaaacttcatgaaagcaaggggttttgttattgatttatccccccttgcagttccttggacatataaggcacttaattaat

SEQ ID NO: 2400 - DNA, 230 bp, Homo sapiens
ggaccgtcaggagaaaatggccagatgatgagctgcacatgtcttgggaacggaaaaggagaattcaagtgtgaccctcatgaggcaacgtgttatgatgatgggaagacataccacgtaggagaacagttgcagaaggaatatctcggtgccatttgtctcctcgcacatactttgaggcagcggggcttgcgctgtgtacaacttccgcagagctctggggtgtaacc

SEQ ID NO: 2401 - DNA, 300 bp, Homo sapiens
gggagactgttctgagactctacctacatctcattgattagatcagcgagggtcacatgccactcctagttaaaaaggagctgggaaagttagtgttctgggttttcttccagctagcatgagaataactattagctgtgtgggaggaagctgtccacacatagtttccacagccacaggccgatttcccaaaccctgaagcctcctccacccatcgctcactagtgatgctggcactcccagagagcaggtcctctccctgctgtcagttagtgatcaagatggttgtgacgccacgct

SEQ ID NO: 2402 - DNA, 350 bp, Homo sapiens
tgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaa

SEQ ID NO: 2403 - DNA, 180 bp, Homo sapiens
caatcatgaaccaggaaaaactcgccaaactgcaggcacaagtgcgcattggtgggaaggactgctcgcagaaagaagaaggtggttcatagacagccacagcagattgacaaaaaacttcagttctccttaaagaggtaggggtaaacaatatctctggtattgaggaggtgaatatgt

SEQ ID NO: 2404 - DNA, 240 bp, Homo sapiens
cttcctcattatcagaaattaaagaaatttctgaataaattggcagaagaacgcagacagaagaaggaaacttaagatgtgcaaggagatttaattgatttcaaagaaaataattggtcttttgtttttaatgttaacctttttaaatacaatacttatagtatgaaggaaccattttactctctttgttttagtggagagataatatatgtctcttcacatgtgtaagtgttatatgcg

SEQ ID NO: 2405 - DNA, 220 bp, Homo sapiens
ggtctgggcgcgtgcagaatggcactcgaaggggaggaaagaggagacaagtctcagcctcggacctcaagtggctgaaggagagaatgtatttggtgtctgcctatctttgcatccttcaatgccaatttgtccaagtcacatgatctttctggcgaggaaaccatctgccgtgtgcatagtggggtgaaggtaaagccgaccgagatggatcctcacc

SEQ ID NO: 2406 - DNA, 158 bp, Homo sapiens
gccattaggaccaatgaaagcaaagtacctcatcccctcagtgactaagaatcgcagtatttaaggagggtaggcagggaatggggctggaggagtgggtgtttggcttttctcccacccaggaggggcacactttcatctaaatttgggggatcact

SEQ ID NO: 2407 - DNA, 418 bp, Homo sapiens
tgacaggggtgtagtcggtgaaccgggtccaaagggtgaacagggtgcctctggtgaagaaggtgaagcaggagaaagggggggaacttgggagatatagggattacctgggcccaaaggatcgtcagggtaatcctgggggaacctgggctttgagagggccctgagggaagtcgggggctttctggagtggaaggaccaagaggaccacctcgaccccggggtgtgcagggagaacagggtgccaccggcctgtctcgtgtccagggccctccgggtagagcaccgacagatcagcacattaagcaggtttgcatgagagtcatacaagaacattttgctgagatggctgccagtcttaagcgtccagactcaggtgccactgggcttctggaaggcctggccctcctggtccccc

SEQ ID NO: 2408 - DNA, 280 bp, Homo sapiens
caagaccgcagtgcagagtgaaggtcaagctgttgcagcgcagatttcctccctgctgaggtttgccgccggtgaagatgggagctacgaagtgaagagtgtcctcggaaaggaagtggggttgttaaattgttttgtcccagtccctaaaccgcccacccgaccagctgtcattgggattggagggaaatgcagcttctcagtacaggagggggtctctacgacaacactgtgcgcttccgccgaatctctcaactctacaatatggcttcaggggtgg

SEQ ID NO: 2409 - DNA, 196 bp, Homo sapiens
ttgacttagaatcttcccttttttactccattcaagagcagcattcataaatttccagttccacaggcttgtaaaggaagcatgacttgggcaggccttaggaaacttacagttgattggcaaaaggcacagggggaagcaggcccattccttcatgtcttggggcaggaggaagagagttaaggaggaggttcta

SEQ ID NO: 2410 - DNA, 288 bp, Homo sapiens
gtcgcacgcgtgagacttctccgccgcagacgccgccgcgatgcgctacgtcgcctcctaccttctggcttgcctagggggcaacttcttccccaagcgccaggacaataaggaggtctttgacaaccttggtattcgagccgaccgcggcccgctcttacaaaggttatcacagtagccctgatttggaaaaacacatttagagcgtgtcattccccagggatatggcacacgctccagagtatccctcctggtggcgctatagccgtctcttctcccagagtctct

SEQ ID NO: 2411 - DNA, 291 bp, Homo sapiens
atcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcgcgattttaaggctgcagctgagagctccagctgtaagccaaggctagaggccgcgattagagctcgcaatgggcatatggctctcctctcaga

SEQ ID NO: 2412 - DNA, 134 bp, Homo sapiens
accctcggaggagccgcccagcacagcccacttagaagagcttcaggacgcacccaggacgcttagcccaggagccttccaaggcttacggtcaattccacccagacgggttttcccttttttgtgcttttttg

SEQ ID NO: 2413 - DNA, 158 bp, Homo sapiens
tcaggttgtacaagccaatcaatgtggggtattaacactccatgggcacacttggtcaatgggatgtggggagccaatagatacatgcttccttttttttttcacctcagactgtcaagtcttgagtacattcatatacctgtaggccactatgggcc

SEQ ID NO: 2414 - DNA, 524 bp, Homo sapiens
tcaggttgtacaagccaatcaatgtggagtatttaacactccatggggcacactttggtcaatgggatgtgggagccaatagatacatgcttccttttttttttcacctcagactgtcagtcttgagatacatttcatatacctgtagccaactaatgggccagctattgcagcactttatattggctctctgtcttttttggttatgctgctctgtccttctacaccttgcagaagtattcatgcataaaccttctcagactgccctggtcctcacaacaaagaattatagagcctggcatgtcagttgtgctgaggttgagaaactggtatctgaagtcaatgatttgctttaaaatccaggctcttcagtatttaatgtctatgatttgaattaagaccattgagtcttaatttttgtctctataaaatagtcatgataaataaatacaaacagagtccttaaggattaaatgaggtaagtttgataaacttaatgcctagaacatagaagagttcaacaa

SEQ ID NO: 2415 - DNA, 240 bp, Homo sapiens
attgacaggagactcaaagctggatatgtattctagggccaaggtatatcaccactacctttcggataaaattcaagttaggtgggaagggcaggcaacctttaggaatttttatattccttaattgtcacagacccctgggtattataacatctccccaagggttcacatacattagggaccatgtaattttttaaatttgaagggtgagtaggtgatattattctgggagtcattgta

SEQ ID NO: 2416 - DNA, 432 bp, Homo sapiens
attgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaaaaaaaaaa

SEQ ID NO: 2417 - DNA, 150 bp, Homo sapiens
attgacatcaagaaggttggtgaagcaggcgtcggagggccccttcaagggcattctgggctacactgtagcaccaggtggtcttctctgacttcaacagcggacacccacttctctcaccttcgacgcttgggcttgcattgcccttaa

SEQ ID NO: 2418 - DNA, 159 bp, Homo sapiens
ggtcggaaagctatcataatctttgttcccgttcctcaactgaatcttccagaaatccaagtccggctagtacgcgaattggagaaaaagttcaatgggaagcatgtcgtctttatcggtcaaaggagaatcttgcctaagccaactcgaaaaagccgt

SEQ ID NO: 2419 - DNA, 115 bp, Homo sapiens
ccgcaagttggggcctgcgcctggggatacaatcattcactctttggggacgtgaaggagcttaatcacttgatgaggtttgtaaaggcaggaggtccctgggcctaatcccaag

SEQ ID NO: 2420 - DNA, 217 bp, Homo sapiens
gcagagtcctaaagaaggaacccactgaaaaacttggagaatcatgttgagctaaaccatatgcaaagaccatgcgccggaaccaccattcttccgccaggccaggaattcacaggctccgggtggattaaggcagcttgctgaagcagcggcacttaaagccaattcagttgagagggcggcgttgcaggaaagaggcttgtggtaaggtaagaag

SEQ ID NO: 2421 - DNA, 158 bp, Homo sapiens
tttaagtgcctattttgatgacttttgaaaaatgtgtacacccttgtaaccatcaccaaatcaaggacaatttgcaccacctagaaaagctcttctcttggcccccttccagtgttgtcttaagtccacaaggaacctgctttcttgacatcatccat

SEQ ID NO: 2422 - DNA, 539 bp, Homo sapiens
tttaagtgcctattttgatgacttttgaaaaatgtgtacacccttgtaaccatcaccaaaatcaagacatttgcaccacctagaaaagctctctcttgccccctccagtgtgtctcagtccacaacggacctgctttctgacatcatccatgagatttctttttgagagtttcatatataagaaattacatggtatatgtactctttttgactcaacataatgtttttgagatccatccatgtgctgtgtgtagagacagttcatgctttgtattgctaagtggtatcccatggtgtaggttgtaccacagggcgtcttccattcactgtggatggacatttgggttgttaccagtctgggggcttttaagaataaggctgctgtgagcattaaagtacaagtattggtggaaacgtatatttttatatatttcatttcacttggctaaatacctatgatacctataaccttgccaacttttttatacagttaaacatatacttaaccgtcttccctaagagtggatataagagtctgt

SEQ ID NO: 2423 - DNA, 101 bp, Homo sapiens
caagacctcccgcctgcccatcatcgatgtggcccccttggacgttggtgcccagaccaggaattcggcttcgacgttggccctgtctgcttcctgtaaat

SEQ ID NO: 2424 - DNA, 222 bp, Homo sapiens
aaataaaaggattctaaagtttgatgcattggaaaatttcttgaggcattagcaacacataggcaaatggcttttgattcttttccaaaacttttaggccataagggtcttttataagacagggatagtaaaatgaaaattgagaaatataagatgaaaaggaatggtaaaaatatcttttagggggcttttaattgggtaatctgaaatctcgggagagct

SEQ ID NO: 2425 - DNA, 550 bp, Homo sapiens
ggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttccttcataaaacctcaagagcat

SEQ ID NO: 2426 - DNA, 306 bp, Homo sapiens
ggcaagatggcagtgcaaatatccaagaagaggaagtttgtcgctgatggcatcttcaaagctgaactgaatgagttttctttactcggggagcttggctgaagatgggctactctggagtttgaggtgcgagtttacacccacccagggacagaaatcattatcttagccaccagaacacagaatgttctgtgtgagaagggcccgcggattcgggcactgactgctgtagttcagagaggtttcgctttcagagggcagtgtagagctttatgctgaaaaggtcgccactagaggtctgtgtgc

SEQ ID NO: 2427 - DNA, 341 bp, Homo sapiens
gaagccggtggggccttcggaaagagagagcaggctgaagaggaacgatatttccgagcacagagtagagaacaactggcagctttgaaaaaacaccatgaagaagaaatcgttcatcataagaaggagattgagcgctctgcagaaagaaattgagcgccataagcagaagatcaaaatgctaaaacatgatgattaagttcacaccgtgtgccatagaatggcacatgtcattgcccacttctgtgtagacataggttctcgtgtaactaatatttgtctgtgtgctactaacagattataataaattgtcatcagtgaaaaaaaaaaaaaaaaaaaaa

SEQ ID NO: 2428 - DNA, 319 bp, Homo sapiens
cgtacccaaagtctcgcttctgccgaggtgtccctgatgccaagattcgcatttttgacctggggcggaaaaaaggcaaaagtgggatgagtttccgcttttgtggccacatggtgtcagatgaatatggagcagctgtcctctgaaggccctgggaggctgcccgaatttgtgccaataagtacatggtaaaaagttgtgggcaaagatgggcttacatatacgggtgcggctccaccccttacacgtcatacgcatcaacaagatgttgtgctgtgctggggctgacaggctccacacaggcatgcgaggtgccttt

SEQ ID NO: 2429 - DNA, 304 bp, Homo sapiens
ggaataagatgtaatttgctgagatagttctacaggccaggtatgatgtcccagagaggaaagtgacctacccaaggcccacatacatagaaattggcagtgctaagtctcaaacggacaatggggggctctaccctacactttccggcttccagtattgtgggaaaatggccaggggatcacaattttccaactcttgcgggaagccactaggatcctccttgagtcaagcccatggcactaaatagacccaggaatgacactctcctcggaacttttggcctcgaacatatttacacagctc

SEQ ID NO: 2430 - DNA, 543 bp, Homo sapiens
ggaataagatgtaatttgctgagatagttctacaggccaggtatgatgtccccagagaggaaagtgacctacccaaggccacatacatagaaaatggcagtgctaagtctcaaacggacaatgggggctctaacctacactttccggcttccagtattgtggaaaaatggccaggggatcacaattttccaactcttgcgggaagccactaggatcctccttgagtcaagcccatggcactaaatagaccccaggaatgacactctcctgggaacttttggcctggaacatatttacacagctccggaggggatgaaaatatcccaacccactccctacagactcaaattagcaattttcttattctttataacccctctggaaattccaactatgtaatattagtctaaaattaggagtgtaagtcacaagagaaaagtcccactacttggggagagaatgtttttgtagcctcatcctgagcatgtgttctaaatcagaacacagcagttgtctttcaaatactgtttttttctcctaatc

SEQ ID NO: 2431 - DNA, 127 bp, Homo sapiens
ctcgtgccgattcggcacgagccccaggaggcggagtttgcagtgagccgagatcacaccactgcactcccatcccagcctgggtgacagggtgagattctgtctcaaagtaaaaaaaaaaaaaaac

SEQ ID NO: 2432 - DNA, 302 bp, Homo sapiens
gccgctgtggctctaaggcctaccaccttcagaagtcgacctgtggcaaatgtggctaccctgccaagcgcaagagaaagtataactggagtaccaaggctaaaagacgaaataccaccggaactggtcgaatgaggcacctaaaaattgtataccgcagattcaggcatggattccgtgaaggaacaacacctaaacccaagagggcagctgttgcagcatccagtttcatcttaagaatgtcaacgattagtcatgcaataaatgttctggttttaaaaaaaaaaaaaaactcggggagt

SEQ ID NO: 2433 - DNA, 319 bp, Homo sapiens
tgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaataaggcatcaacacagatccaccaaaataaatgttttctacattttcatttggactaaatcccacgattgacaactaccacctttttttcctttttaattaatactaaatattgtgatttcttatttgaggtcaaaatgacctccttgaaactttgatacatattggaatacatt

SEQ ID NO: 2434 - DNA, 469 bp, Homo sapiens
cacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgagtcaaattgactttatcagctttaatcgatgggaagaacttcagtgtcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttcaaagaattgtaatcctccccacactgaagtctaggggtgcgaatccctcctgagggagatgcttgaggcatgcctggaagttgtcatgtttgtgcacgttt

SEQ ID NO: 2435 - DNA, 335 bp, Homo sapiens
gcgacctgcgactccttgacgttgacaatcgagtagtactcccgattgaagccccattcgtataataattacatcacaagacgtcttgcactcatgagctgtccccacattaggcttaaaaacagatgcaattcccggacgtctaaaccaaaccactttcaccgcttacacgacccggggtatactacggtcaatgctctgaaatctgtggagcaaaccacagttttcatgcccatcgtcctagaattaattcccctaaaaatctttgaaatagggcccgtatttaccctatagcaccccctctaccccctctagagccaaaaaaaaaaaaaaaa

SEQ ID NO: 2436 - DNA, 166 bp, Homo sapiens
cacgcaacatgatgtcactgtgcctgccgcctcggtccacttgcggccgtgtttgactccactcagctccttttacgcttatatttccggccaaatccctgcttgggttttgtcttttaccttgttcgcttgccatccccattaaggtttaaagtctaaaaaaaaa

SEQ ID NO: 2437 - DNA, 159 bp, Homo sapiens
acagaaaagccaagcctcctcactgttgtaaaggaaagccctgcgtggctgtgagggagacgcgtgttgaacctacattgtcgtgttagcgcccttttgagaacccccttgtgggctttttgagacttaaaccggggacaaggcttagagggtttttca

SEQ ID NO: 2438 - DNA, 549 bp, Homo sapiens
acagaaaagccaagcctcctcactgttgtaaaggaaagccctgcgtggctgtgagggagacgcgtgtggaacctcatgtcgtgtggcgccgttggggacccgttgggctcttgagactgaaccgggacaggctgagaggctctccaggacacttccgggcagcaggccccctctggctgtgcttgaccctggcccctgggccctcttggttcaccaagtctcccacgtcctatgctcttgagatcccagactcggcactggatggggtggccctgggtcccactgctgttccagagcactggcccttcctttcggccactcagggtagaggctggagcccctggaatcacacagaaggggcctggctgaagcacaaagggtggagatctggggttaagccagagcctggggccccctgagcccaggggctgggcagctggggaagcaaggagagccaggtgtcactgagtcagtccctcccatgcaggtacttgggggtgtgaggggccgcccccgggcttcctctctcaaccctacggcctcttccgg

SEQ ID NO: 2439 - DNA, 191 bp, Homo sapiens
attagctagaactgctctgttgaaatctacttcccaaacccccacatgtgctaccaattcctcatttcctcaggttcttttcaatttcctgggaggcgggaaggcttaatccaggtggtgtcaacccaccctgaatttaggtatattttgggaaaatctctaaaactcttgggccaaaaaataaaatctct

SEQ ID NO: 2440 - DNA, 540 bp, Homo sapiens
attagctagaactgctctgttgaaatctacttcccaaacccccacatgtgctaccaattcctcattcctcagttctttcattcctggaagcggaaagcttattcagatgtgtcatcctactgtatttaagatattttggataatatcttaaatcttggtcaaaaataaaattcttcatttttaagcatgctttgtagccagctgtttatttctgtgacctcccttttccttctcagtcacagcccttaaggcaatgtcctaacctcctggtgttttgttatctgctctgggttaatcacgtaacagtagtggtggcttctctaaaaagctgaaggttcttattcttttcccttgagattgcacacattcatctgctaaaagataaggggaggaaaaaaactgttaaaatgttatgtgggattagataaactataaatttatttccagttcaaaaattgattttatataatgaatataagagggacctgtgaatttgtgtttaaatactctcacactatacagctttaaaaaaaaaaaaaa

SEQ ID NO: 2441 - DNA, 223 bp, Homo sapiens
gcgcaacagcatggcttttaaggataccggaaaacaaccgtagagccggagtcgcaattcaccgaattctgaattaaccttacaaaggccggaacgtaaaattcctttggaaaggtgtgttctgaatttataaggagcgcaaaagaaaaggatctctaaagtgtaaagggcccattcggatgtctctccagagctttgtgagactcatctacgagaaaactcc

SEQ ID NO: 2442 - DNA, 253 bp, Homo sapiens
cttaggcgcagacggggaagcggagccaacatgccagtggcccggagcttggtttgtcgcaaaacttatgtgacccccccggagaccccttcgagaaaatctcgtctcgaccaagagctgaagctgatcggcgagtatgggctcccgaacaaacgtgaggtcttgagggtcaaatttaccctgcccaagacccccaaggccgccccggaactcctgacgctttatgagaaggacccccggcgtcttttctaag

SEQ ID NO: 2443 - DNA, 229 bp, Homo sapiens
catgacataagatgtgtctttattcagctcgtcgtgaagatgctgctgctgaatgggtcagcatatctctgtttgcatggtttgcaggaggtcggttttcatggtcattcagttccacagatcttaatgattactgtctgtctgtgtcttttttccatgagaaatcactgttgcaaattgcctctaaattgactctactaaaataacaatgtttcagtctgaaaatttg

SEQ ID NO: 2444 - DNA, 194 bp, Homo sapiens
ctgggacctgcctcaggccccctacccacctctgccatgcctaggaatcccacccctgtgtgaatgggactccctttcctccatgtgacaaccacaggggtccatgacccatctaggggactttatagcagttgggtgggaggggaattctcttaatttatcaataaaatattttcagaggggaaaaaaaaaaa

SEQ ID NO: 2445 - DNA, 233 bp, Homo sapiens
gctgcgtgcctatagtcccaactgctcaggagaattaggtgagaggatcggctgagacgatcctcccactctggttcactcctctcaggctagactctctctccctttcattggcttgtcttagctattaataaggaggctcggcccggcgcgggttgctcacacatgttaattccagcacttttggggggcccggacgggtggatcacgaggtcaggagatcgagaccatcc

SEQ ID NO: 2446 - DNA, 166 bp, Homo sapiens
ttagcaccagaacacagatgtcttggtagaggccgcggtttggactactctgagtcagagaggttgctttcagaggcagttagacttatctaaaggtgccctgaggcctttttccattccaagcgagcttcgataaccccatgaggccttcttcggggcctcattg

SEQ ID NO: 2447 - DNA, 546 bp, Homo sapiens
cttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaaccaaagatgagatactgcccacaccccatctcagaacagaagggtgggaagccagagcc

SEQ ID NO: 2448 - DNA, 232 bp, Homo sapiens
ttttctttcacgtacatccatcatttgcaactgctgttcgtacacagaaacaggactgctcaaatgatcctatttgtattttctgatgctatcagactctaatgtttttttccctaaaatattattgccatcatgctttagggattttatattttttcacaatcatattttggtattgggtctgtgttatgtgaactctgtacctgcttgggaaagggttgaactctccaat

SEQ ID NO: 2449 - DNA, 278 bp, Homo sapiens
gccctgttaggctaagtggatagttgctgttggcagcactttgcagaattgaccaaagccttgcctgcaaggtcccctttccctcccactttaccacccatagaggggttcaaggtgcacttgagttcaactcagggggatacccttcctaagggggctctcaggatatatgaggggtggatatagagtgagagcatcccatgatataggttgggggttttcacagaaggctctcctagcgctagacgacgcaaagacatcccgagacaggcggcaca

SEQ ID NO: 2450 - DNA, 541 bp, Homo sapiens
gccctgttaggctaagtggatagttgctgttggcagcactttgcagaaattgacccaaagccttgcctgcaaggcccccttccctcccactctaccacccatagagggttcaagtgcactgagtttcactcaggagaataccttcctaaggggtctcaggtatatgaaggtgggatagagtagagcattccatgaataggtgggggttttccagaagtcttctgaagctagacaagcaaagacatcccaagacaggagcacaagcaagggttcaaatcactgtagtcgggatcttcccaaatttactgcagaaaccagtctaattttgttttttcctaaaagccactttcctcttctctcttcctttggaatttccatatattagcattaattcatttattctttgagaggaaggaaaaattgggaagtctaaatggaagctgaaatcttctgagcatttgctttctaacttgtagaggctaaaattagaccttggaaaaggttagttttcttctctttacacccctttttagagtgtgag

SEQ ID NO: 2451 - DNA, 263 bp, Homo sapiens
cggcacgagccggaagacaagtcctgaatctgtgcccataatctctgtcagtctgctgtttgcaggcgtcattgctgctagaatcggtctttggtcctttgatttaactgtgaacacagttgctgcaggaaatggtaattgaatctgaaagaggctattataattggtgtcacagacttccatgaactatctcctggatcttctgcattcatcatggtcatcctggctccaaatcctgaagcttttggctcgctcgtatagat

SEQ ID NO: 2452 - DNA, 183 bp, Homo sapiens
gaagacctcacgcctccccatcattgacattgcacccatggacataggagggccgagcaggaattcggtgtggacatagggccggtcttgcttcttggtaaaaaccttgaacccaagaaacaacacaattccgttggcaaacccaaagaccccaggttactttccaatctagttcattttagg

SEQ ID NO: 2453 - DNA, 209 bp, Homo sapiens
ggctcatgtagcctcactggagggcattgcccggaagatcaagtcgtgctctggcaggcgcgccccttggaggatgaggccactcttggccagttccggggtgggaggccctgactacccttgaagtagcaggccgcattgcttggaaggaaagtccatggtttcctggcccgtccttgaaaaggtagagagtcaacattctagggtgc

SEQ ID NO: 2454 - DNA, 198 bp, Homo sapiens
ggctaatgtaggaaatggtagcagttcataaacactacttattgttcatcacttcagatgtcactaggcttatgtaaattgaaaccgagatatttttcctttcttctgtgtgaaggtcaaggccatttttttcttcttaacattattaggcatcccagaggtggtattcagcattttgaaagccagcagggccctctt

SEQ ID NO: 2455 - DNA, 183 bp, Homo sapiens
ctcgtgcgaattcggcacgagggtctgaggttatcaataagctcctagtccagacgccatgggtcatttcaccagaggaggacaagcctactatcacaagcctttggggcaaggttgaattttggaagatgctggaggagaaacccttggaaaggctccctggttgtcttaccattgacccaa

SEQ ID NO: 2456 - DNA, 186 bp, Homo sapiens
cctgaacgggcagcactcccttattttccccgcagatatggtgcccatgccagcctccgctataacccccgaggaaccgccaggctctattgccttggatgatgggctaccagattgtcctataaggctggagatgagggaggaaggagggaggaggtttgaggagctaggccttgtttttgggca

SEQ ID NO: 2457 - DNA, 181 bp, Homo sapiens
ccaacatgggccgcgttcgcaccaaaaccgtgaagaaggcggcccggtcatcatagaaaagtactacacgcgccttggcaacgacttccacaacgaacaagcgcgtgttcgaggagatcgccattatccccagccaaaaaggttccgcaccagataggcaggtattctaaggaattctatg

SEQ ID NO: 2458 - DNA, 199 bp, Homo sapiens
catcaatggaaatccatcaccatcttccaggagcgagatcctcaaatcagtgggcgatgctggcgctgagtacgtcgtggagtccactggcgtcttcaccaccatggagaaggctggggctcatttgcaggggggagccaaaagggtcatcatctctgcccctctgctgatgccccatgttcgtcaagggtgtgaccct

SEQ ID NO: 2459 - DNA, 300 bp, Homo sapiens
gtggaatagaaaggggggaaaggtggggaaaagattgagaaatcggatggttgccgtgtctgtctagaaagaagtagacatgggagactttcatttgttctgtactaagaaaaattcttctgccttggatcctgttgatctgtgaccttaccccaaccctgtgctttttgtaaccatgtgctgtgtccactctaggggtcaattgagttaagggcggtgcaagatgtgctttgtttaaacagatgcttttagggagcatgctctctgatgagtcatcatcactctcattatatggagccc

SEQ ID NO: 2460 - DNA, 140 bp, Homo sapiens
ctagatagcaccccgtggcattacataacacttcatgagtgctgtgtcttgtaatttttgggacaggtttctcttccttccccctcttttttttgttcaaaagcccagagactgacaaccagctgcagtgtctaagtgtt

SEQ ID NO: 2461 - DNA, 105 bp, Homo sapiens
caaatcctgaagcatccttggccaaccgcaacagcattggtgagcagaggcatgacaaggaacatagggaggccagttttggcacttggaattcaattcctcaga

SEQ ID NO: 2462 - DNA, 125 bp, Homo sapiens
ctgaatctcccctcctcacagttgccatgtagaccccttgaagaggggaggggctagggagccgcaccttgtcatgtaccatccaataaagtgaccctgttcttcaacccaaaaaaaaaaaaaaa

SEQ ID NO: 2463 - DNA, 145 bp, Homo sapiens
caaggaaggtgcttgtttcaacagtacaaactgggatgctacagagaagattcggatggccctgtgcaaggattgacacccaagtttgtgaagcacttcatatatggaggggaaaacatttaaaggcacaaggggggggctttgc

SEQ ID NO: 2464 - DNA, 180 bp, Homo sapiens
tgcattcttagaccacacccagaaaattatgtttcgtttgagattatgcaatttaaggatgttgacaaatctgaatgcatgcaaagaaaaatggtaagggtgaagaaaacccaggaagactgctatatacggagaaagttgctaaaactttgagaggggttgtcttaaggagattatggg

SEQ ID NO: 2465 - DNA, 125 bp, Homo sapiens
cagccctgtcttcttggcgtgggttatatgtccgggatctcgatcagattctcggggctcagaaaccgtccggttgccattaggctacttgggggttagggagttcccaccattttatgtccaga

SEQ ID NO: 2466 - DNA, 110 bp, Homo sapiens
ggctgaacagacttcccgctgctgggtggggtgacatggtgatggcacagtcaaggaaggcaaaccaggagctcagaaaaagggtcatcccacaattggtcattcggaca

SEQ ID NO: 2467 - DNA, 200 bp, Homo sapiens
tacactcaaccatgacctcacccctccttggtttctccctcgatctgttgcctttttggatgtattcttatctaacaacacaatcccgaaagacttaattgaatawttatacttaatggtcatatcctttattgctcaatgatctaattaaaggggtcattgcccaattcatggttataattctaccattggttaggaac

SEQ ID NO: 2468 - DNA, 150 bp, Homo sapiens
tcatttgcagaacagaatgccagaaaagaagttaagcctagaaaggctcagaaatctcacaggtgtctttcaatcttttgctaaataataatctatgtatgcataggggtgaaacaacacccaggcaaatttaagaccaattaattccag

SEQ ID NO: 2469 - DNA, 546 bp, Homo sapiens
gtcatttgcagaacagaatgccagaaaagaagttaagcctagaaaggctccagaaatcctcacagggtgtctttcaatcttttgctaaataataatctatgtatgcatagagtgaaacaacaccaggcaaatttaagaacaattaattccagggggcagaaaaaaaggcataagaaaagaacaaaaaacatgggagaaataaaaaacaaatggcaagatggtcaatttaaacctaaccctatcaaaattacatcaagtataaatggtctaagcacttctaattaaaaggcagaaacttcagattggataaaaaagccacacccaaatatataacatccacaagaaaaccactttaaatataaagtaataggtaaaagcaaaagtatagagcagacataccactcaagcactagtcgttagattgctgaagcagctatataaatatagtagtctcccttatctgcaggggatacagtggatgcctaaaactttgaagagtgggcaggtgcgtggttcacacctataatcccagcattttgagaggcc

SEQ ID NO: 2470 - DNA, 139 bp, Homo sapiens
cagaagcgagatgacgaagggaacgtcatcgtttggaaagcgtcgcaataagacgcacacgttgtgccgccgctgttggctcttaaggcttaccaactttcagaaggttcgaactttttggcaaattgaggctaccctt

SEQ ID NO: 2471 - DNA, 176 bp, Homo sapiens
ggtgattgaaaaaaatcaacagctatctcattaaatgcatggcaagtaaatatatcttctgggccaaaaatagaccagaatttatctgcttacttgaatgtttggcaaaactttcctggaaacctgagttgatgtttgattggttaaggcttcttaaactttcctactaaatttac

SEQ ID NO: 2472 - DNA, 112 bp, Homo sapiens
tgattttgtaaagttgcctttattttgctgttaactgttaactattgacagtatattaagccttattaaaccaattcttaaaccaatattaaatcacaaaattcaggtttta

SEQ ID NO: 2473 - DNA, 111 bp, Homo sapiens
attcagtgaagttagaagcctgaaacttttctcgtattggcgttggtttgcattaaatcctggggtccattttacaatccaattatttttgaccattgctatgtgttcaag

SEQ ID NO: 2474 - DNA, 144 bp, Homo sapiens
ctcgtccaattcggcacagttgggaatgtagccgtcacgacaaccggagtcactcttgtcgccaatttgctttttgtgggatttggccgcttctttacttcaagctgttgtatcagcaaggtttttatgacctgtaccttgtag

SEQ ID NO: 2475 - DNA, 119 bp, Homo sapiens
gcctaccatgaacagctttctgtagcagagatcaccaatgcttgctttgagccagccaccagatggtgaaatgtgacccttggcattggtaaatacaatgcttgcttgcctgttgtacc

SEQ ID NO: 2476 - DNA, 144 bp, Homo sapiens
ggaagagaaagcgctagaggtttatgatttgattagaactatcccggaccagaaaagccaattactttagaaggaccttggaagtgtgtcttcggaaagtgttgtgtgtgaagttcagagagatataattgaagagaggaatat

SEQ ID NO: 2477 - DNA, 242 bp, Homo sapiens
gctttgtgaaatggccccgctatatcaggttgcagcggcagagagccatcctctataagcggctgagagtgcctcctgcgattaacccagtttcacccagggccctgggaccgccaaaacaagctactcagctgcttaagctggcccacaagtacagaccagagacaaagcaagagaggaggcagagactttttgcccgggccgagaagaaggctgctggcaaaggggacgtcccaacgaag

SEQ ID NO: 2478 - DNA, 257 bp, Homo sapiens
ccaacatgccatccagactgaggaagacccggaaacttaggggccacgtgagccacggccacggccatagcaagcaccggaagcaccccggcggcccgcggtaattctggtggtctgcatcaccaccggatcaacttcgacaaataccacccaggctactttgggaaagttggtatgaagcattaccacttaaagaggaccagagcttctccccaactgtcaaccttgacaaattgtggactttggtcagtgaacag

SEQ ID NO: 2479 - DNA, 230 bp, Homo sapiens
gtaaaaagaacaagaaagcaatgtatttacataaccacaaaaggccaggcgtggtggctaacgctgtatccagcactttgggaggttgaggtggacgtatcacctgagatcaagagttcgagaccagcctggccaacatggtgaaaccctgtttctactaataataaaaaattagctgggcatgggggcatgtccctataatcccagctactcaggaggctgaggcaggg

SEQ ID NO: 2480 - DNA, 205 bp, Homo sapiens
gttcacgtacactgccctgaaggatggctgcacgaaacataccggtaagtggggcaagactgttatcgagtaccggtcacagaagacctcacgcctcccccatcattgacattgcacccctggacatagggagggccccccgcaggaatttcggtgtggacatagggccggtctgcttcttgtaaaaacctgaccccagaaacaa

SEQ ID NO: 2481 - DNA, 125 bp, Homo sapiens
cttagttttcctttttttttaagaacttagtctttttccaaaagtcagtttattttgttgaacattttttctttgattggcagtttaggtattttaagaaggttgtcaagttttgcctttaccta

SEQ ID NO: 2482 - DNA, 618 bp, Homo sapiens
  misc_feature 106, 108, 120, 122, 125, 132, 136, 144, 145, 151, 156, 158,163, 168, 174, 181, 191, 208, 218, 232, 239, 248, 254, 256,264, 267, 269, 273, 284, 286, 288, 291, 294, 301, 315, 331,338, 348, 351, 364, 366, 371, 383, 392, 403, 415, 423: n = A,T,C or G
  misc_feature 425, 449, 452, 457, 468, 473, 486, 500, 502, 510, 513, 514,524, 536, 560, 597, 599, 608, 614, 617: n = A,T,C or G
ctaaagggaacaaaagctggagctcgcgcgcctgcaggtcgacactagtggatccaaagaattcggcacgagcttgagtttttttttttttttttaaagtaacggngncatttttaccananagnccatttngcangtaaaccnnggaaanatgtntngcccnaaatngggcantttaagncattttaaanaaagttagtccaaagtngtggcctttnaacccaaagccaancttcagnctttcaaanaaaaangngggatttncantnactngcggaaatttngnanttnggnaaccctngggggcattatccnaacggaaacgtaaacncttactnggaaattttnggncattaaattaaangngggcnaccggggaaatnggttaaatnagggggcttgncaaaggtttttnccaaaatngnaaagggccggcatttttaaaaaanccncattngcctttaggcnaaatngtaaaaaattatnttagaaggcaaaananatgttttnccnncaaaggcaanactttcccaagnatttcggatttcggggttgccagngggggatttttaacccggaatttggtttaaaaaaaancnggggggaanaaatgnggna

SEQ ID NO: 2483 - DNA, 208 bp, Homo sapiens
ctcatctttcttgatcaacatcttttcttgcctctgtccccttctctcatctcttagctccctccaacctcgggggcaagttgtgtgggagaagccacaaggcctgcagatttcatctgctcttccttcctgggagcccagaggagggcagcagaagggggtggtgtctccaaccccccagcactgaggaggacggggctcttctcat

SEQ ID NO: 2484 - DNA, 158 bp, Homo sapiens
ggggggttcagatgactctgctgaggagggggacctactgggatgatgatgataatgaagatcgggggatgacagctggagttgatcaaggatgatgaaaagaggcttaggaaggagaggatgacagacacagcgccaatgcagggctgactctcaag

SEQ ID NO: 2485 - DNA, 209 bp, Homo sapiens
gagaccatcggcagcacctacatggctgcctccggcttcaacgactctacctacgacaaggtgggcagaccacatcatgggcactggccgacttttggccatggaagctgattggaccacatgaaggtaacatcaattaaggcacttcttcaacaacttccagatgaagatcgggctcaacatcggccccgtggtggccggggtgatag

SEQ ID NO: 2486 - DNA, 236 bp, Homo sapiens
ccggaaagggaggcttgcccttccgcggtccgagaaccaccggcctccccagtttgagggctgttacccgtgcgcgcttcgacgtttgctgctgttgggctctcctcgcccctcgttcccttggaacccgccctgggaactccgccatgtcatccacttcgcccaacctccagaaagcgatagatctggctagcaaagcagcgcaagaagacaaggctgggactacgaggagccct

SEQ ID NO: 2487 - DNA, 222 bp, Homo sapiens
gtcagcatagccgcccacggtctgttctcagattcctaatcattccagaagtattaaacgtcattgctgcaacctcggcaggtgccttgttgaaggggcttaattgaccaccacagggaggctcagaccccaaccctgggatcccaggagaaaggagtggacccgaggaaggaaggaaggcaaggctgttttttccatccgtccgtctgtccacctaccttt

SEQ ID NO: 2488 - DNA, 183 bp, Homo sapiens
gtctcggtccttccgaggaagctaaggctgcgttggggtgaggccctcacttcatccggcgactagcaccgcgtcccggcaagcgccagccccttacaattcgccccgcggccaatggccttctgtcttccgagcctcgcctgcaaatcttacttcggcccctcaattcttgcaccgaccgat

SEQ ID NO: 2489 - DNA, 104 bp, Homo sapiens
ctcacagaatgttctccgctcccagacatgggtcccctggcttcctgcccttggatgcgcagagcaggcatcgtggttatggggatgatgcctccccaagggaa

SEQ ID NO: 2490 - DNA, 330 bp, Homo sapiens
  misc_feature 55: n = A,T,C or G
caggcagccgctctggctctagctccagctcgggacctctggacccccggacccngtgaccagcgcctcgcgctggagtggaggatgccttctacacgttggtgcgtgagatccggccagcacaagctcgggaagtgaaaccctcctgatgagagtggccccggctgcatgagctgcaagtgtgtgctctctgacgcaggtgagggggactccagggcggccgcacgccaccggatgaccccggctcccgcccttgccggtctctggctgcggtagagcctcctgtgcccgccagacaagtaaggcatgaggtgccgatcaggaggagtt

SEQ ID NO: 2491 - DNA, 131 bp, Homo sapiens
gaagacatccagttgctcgcggatacggggagagagagcttaagttaaggcagttttttatggcgtttgtagtaatctgtaaaatactttggtttaatttgtgacttttttttgtagaaattgtttataat

SEQ ID NO: 2492 - DNA, 140 bp, Homo sapiens
aatcaggacttgatggaattcacggtataaagccataagaaactgaagactcctaagtaccttccattgtctgatttttcaaaggctgtgacactcagacgagaagttcaaaaccaaaataattttaatttgtactgctt

SEQ ID NO: 2493 - DNA, 504 bp, Homo sapiens
aatcaggacttgatggaaattcacggtataaagccataagaaactgaagactcctaagtacccttcccattgtctgaatttttcaaaggctgtgacactcagacgagaagttcaaaaccaaaataatttttatttgtactgcttttaagaattcagaatgctattatgagacagaggaagcaggtagagttctgacctcctaagggaaaaggaggaattatgtcaccttttgcttcctttaccctactgagactcaatggtgaaatggaaacaagttaaaggattgttctttttatccttaaatgtcaaacgtggttgcatctcctaaagaaataatgcaactgattaattgtgtaatttcacagggaagcagtaattctcagccttataaacatgtaatgcactaatttggtttcagagttaactgaaacagtttaatgagctgctgtatcacgtgtgtgtacagtgttacatagagcagatgccaaaaaaaaaaaaaaaaaa

SEQ ID NO: 2494 - DNA, 125 bp, Homo sapiens
ggccactgcgcagaccagacttcgctcgtactcgtgcgcctcgcttcgcttttcctccgcaaccatgtctgacaaccgatatggctgagatcgagaaattcgataagtcgaaactgaaggagaca

SEQ ID NO: 2495 - DNA, 225 bp, Homo sapiens
cggcacgagtgtggctctaacagcccttatcactgtctgacttgcattaattatcagcatccatatctcttagatacaagctcacaaggagcagaatccatgtcacactcaatattgtttccccattgcttagcatagaggrttaagaatacttgggttaataacttactgaatcctgcaaacacagcattgctcacttcgaatctcacggcttccaacccgcat

SEQ ID NO: 2496 - DNA, 550 bp, Homo sapiens
cggcacgagtgtggctctaacagcccttatcactgtctgacttgcattaattatcagcatccataatctccttagattacaagctcacaagagcagaatccatgtcacactcaatattgtttccccattgcttagcatagaggattaaaaatacttgggtttaataactttactgaatcctgcaaacacagcatgctcacttcgaatctcacgtctccaacccgcatcaatccaaatcacactccaacctttcaggctcgattcaagcccacgcttccttagagtcctattagtctctttttctctaggaatcccaccctcctttcagtccacgcctcgtatttttgcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgcatgtatgaatgtactccacttt

SEQ ID NO: 2497 - DNA, 280 bp, Homo sapiens
gaagttcctcaaggttatacaattcctaacggacatgttagacatcaatctgtctttttacactgcacatcacattgcttgtattaaaaggcagattggagctactagagataagcagtgtgagaagagcagagttaatagctggtgtatacctcatggagagccaagcaattaaagtttaaacagcagataaacctttaaactatatttggacaaatttactcttctgtctttcatagttcccagattatttctattttgtaacaagctctatcttgag

SEQ ID NO: 2498 - DNA, 539 bp, Homo sapiens
gaaagttccctcaaaggttatacaattcctaacggacatgttagacatcaatctgtctttttccaactgcacatccacattgcttgtattaaaaggcagattggagctactagagataagcagtgtgagaagagcagagttaatagctggtgtatacctgatggagagccaagcaattaaagtttaaacagcaagaataaaacctttaaaactatatttggacaaatttaactctgctgtctttcatagttcccaagattatttctattttgtaaacaagctctatctttgagttttatattgatactcatatgaataatttattgagtgctttctatttaccggacactgtactaggtgtcttctgtacattcccattcaatataccagtcatttgagataattaccatttattattcccatattatagacaagaaaactgagacccagagaccttacactgctttgggattgaacccaagtctgatatcagaaactaaacttttaactgtgatggtgttctctggatcattctgtaa

SEQ ID NO: 2499 - DNA, 180 bp, Homo sapiens
gcgcgtgcgcggtgctggaccagtggctcacactgcccatctttgcatggcccgtgctggtgctctacctagaccgcggctggcggccctagctgttcctctctcttgagtgcgtctccctggccagttatggcttcgctctgctgcatccccagggcttcgaggtcgcactgggttctc

SEQ ID NO: 2500 - DNA, 190 bp, Homo sapiens
tccctgcctctgacctcaggtgtaagcggtggtggtatgactttggttacgatgagactctacaggctaccagcctcgctcagcaccttctctcagacccaaggactattaaggttgatgctactctgaagtctctcaacaaccagattgagacccttcttacttcctgaaggctctagaaaggacccag

SEQ ID NO: 2501 - DNA, 225 bp, Homo sapiens
ctaaggtatatctgaattttttcttcctttgaggcaggttcttgctttgttgtccaggctggagtacagtggcacgaccttggttcagtatagccctgatctactgggctcaggtgattctccctcagacctccagagcagttgcaaccgcagcacgtgccacctcacccagctaattttttattttttgtagaggtgaagtctcttcctgtgtggccaggctgg

SEQ ID NO: 2502 - DNA, 271 bp, Homo sapiens
gagaaatacatggaaaagtatagagggctacaagtgtgtaagaattatgcttttacaattgaagagaattgcaagccactctttcctttatatactcccagcatcagttacaattgtttttagtattcatgtactgcttctgcctcaatcacatgaatacaaatagtacatcctgatagcctactctgttcacccaatggcaaaaaataaatacaaagaaagacagccattaaatcatcaaataatagataaactagatatttcgactctt

SEQ ID NO: 2503 - DNA, 111 bp, Homo sapiens
  misc_feature 97: n = A,T,C or G
gtttggaactttaatagcgttgcaacgaaatgctatatccagtttcctgtaatttaattgaaggaaaatacattcaaataaagactttattattaanagaccagatagcat

SEQ ID NO: 2504 - DNA, 267 bp, Homo sapiens
gcgaattggcaccaaagcagcagctgtattgccgcagttctagcttcaccttcacgatgtttcccttggtcaaaagcgcactaaatcgtctccaagttcgaagcattcagcaaacaatggcaaggcagagcaccagaaacgtacacctgattttcatgacaaatacggtaatgctgtattagctagtggagccactttctgtattgttacatggacatatgtagcaacacaagtcgggatagaatggaacctgtccccttttggcag

SEQ ID NO: 2505 - DNA, 274 bp, Homo sapiens
tttctccttaattgcttaaggccggggagcaaagtgtcttaacttctgtctttgactttcccagcgttgagtcatcaacaatttgccaattagctcattggtctggcaacctcagaaaccccttaaggtttaaaaactttcttggtcccacgacccagaatgaaacagctttaaaatagccttaagcaaaaggatgttatttcattaaatttggtttaatggaaagataaagtaaatgaaaacacaccctacacactagactccgaacactggt

SEQ ID NO: 2506 - DNA, 223 bp, Homo sapiens
catggctcgtgggtcccaagaagcatctgaagcgggtcgcagctccaaagcattggatgctggataaattgacccgtgtgtttgcttctcgtccatccaccggtccccacaagttgagagagtgtctccccctcatcattttcctgaggacagacttaaggatgccctacagggatgaagtaaagaggtttcattcagcggttcattaaaatcgattgcaagg

SEQ ID NO: 2507 - DNA, 131 bp, Homo sapiens
ccctggtcctcgcggtcgcactcgtgatgctggtcctgttggtccccccgcccttcctggacctcctagtcccccttggtcctcccagccgcttggttcggacattaaacttcctccccaaccaccttaag

SEQ ID NO: 2508 - DNA, 162 bp, Homo sapiens
ctcgtgccttttttttcgctttgcaaggttttgatttgtttgacagcaggaattggcttgggagggtccccgcaagctggaccccttgttccgttcggcccgttaggagaacggaacttgcggccaaggggacccgcggaacgagatcaactggagccaact

SEQ ID NO: 2509 - DNA, 207 bp, Homo sapiens
aaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgatggtatcttaaagatgtcactttcacagacacagtgtgtcccatccccgcgttcacaatggtggtagt

SEQ ID NO: 2510 - DNA, 102 bp, Homo sapiens
tggagttttcaggggtgaggggaaagagtagtggctaagcatcgggattagtcttttttcccattggagctagggatctttgggtagtacttttggcttgta

SEQ ID NO: 2511 - DNA, 552 bp, Homo sapiens
agagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtc

SEQ ID NO: 2512 - DNA, 276 bp, Homo sapiens
gctcagagaccttgaaagccgttgtacgtttctaaaaaaacaataaagtataaccttctggtcatatcataaagagctcaagactttggtttccatatttcaaaatgtcttgggcagaatatattcaaaattttagccaagaccatagaatgttcacttactatatgcgtgtgtacgtttttaaagctaaaaaaattacttctagatccctagaatgaaactctttttttatctatgaattccatatggtcttttccaaatatctttcttcatttt

SEQ ID NO: 2513 - DNA, 107 bp, Homo sapiens
agcatgattttggttttaaatattagtccaagaactattaagaccggcaaatggaaacaggcaatgcgtggaccaaccgaaagcacgttgagctagcgaattttccg

SEQ ID NO: 2514 - DNA, 198 bp, Homo sapiens
aagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaa

SEQ ID NO: 2515 - DNA, 100 bp, Homo sapiens
acggtcttcttcactcggcccgtccggggcttacactcggtcgtcccctggcccgtcctgcgttacccgaggagccgctccctaacgaagagccctttcc

SEQ ID NO: 2516 - DNA, 273 bp, Homo sapiens
ggttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagattttttttttttttttttttt

SEQ ID NO: 2517 - DNA, 210 bp, Homo sapiens
cagcaaaagggtccccggggagctcatctttcagttaatgacaaaccgagagagggggctccggacgagataggaccaaggacagaaccgagaagaggtaaggggcaggtgatgcgagattgaaaaggcgcagataacggagggaaggagttgagggcgcagacgagggcgtcttgtccgcataagtttgagacgttctatggctgcctc

SEQ ID NO: 2518 - DNA, 282 bp, Homo sapiens
cagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggctgataaatagagacagatcccagtcctggatacttct

SEQ ID NO: 2519 - DNA, 320 bp, Homo sapiens
gtcagtggtggacctgacctgccgtctaggaaaaccctgccaaatatgatgacatcagaaggtgtgaagcaggcgtcggagggccccctcaagggcatcctgggctacactgagcaccaggtggtctcctctgacttcaacagcgacaccactcctccaccttcgacggtggggctggcattccctcaacgaccactttgtcaagctcatttcctggtatgacaacgaatttggctacagcaacagggtggtggacctcatggccacaatggcctccaaggggtaagccccctggccaccagccccagcaagagcacaag

SEQ ID NO: 2520 - DNA, 255 bp, Homo sapiens
aatagagatcgagtctggcccacgacgacgtgatgcaagaaaagtttattatgtgaggagagaggctcataaaacgctgttgcaacagagaaaggatccctmtttccatctagccccaaagctatgaggaacaggaataaaggagatggcaccaacatatgcctaaatggttgtatgtctttcattatcccatccgggagggatattgacagggctgtaaggtgccaatgaaggtttattttgtgaatggcccct

SEQ ID NO: 2521 - DNA, 200 bp, Homo sapiens
cctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcaaaaaaaaaaaaaaaaaa

SEQ ID NO: 2522 - DNA, 190 bp, Homo sapiens
ctgctgggaaacatttgcactcttttagtgcatttcctcctgcctttgcttgttcactgcagtcttaagaaagaggtaaaaggcaagcaaaggagatgaaatctgttctgggatgtttcagcagccaataagtgcccgagcacactgcccccggttgcctgcctggcccatgtggaggcagatgcctctc

SEQ ID NO: 2523 - DNA, 215 bp, Homo sapiens
cctacgcacacgagaacatgcctctcgcaaaggatctccttcatccctctccagaagaggagaagaggaaacacaagaagaaacgcctgtgcagagccccaattcctacttcatggatgtgaaatgcccaggatgctataaaatcaccacggtctttagccatgcacaaacggtagttttgtgtgttggctgcctcaattgtccttgtccaccta

SEQ ID NO: 2524 - DNA, 287 bp, Homo sapiens
gtgccgaattcggcacgaggggagaccacctggtggggaacgtgtacgtcaaggtaggagccagggcgagacggcggcgtggcctttagtgtgccaaggccaaggccaacaggcgaaagcgagacagtgtgtgcagccgcttagtgttccggggccaaggccgacagagagatggggtgcctcttcgccatgcaccttgagatcctgtgatgctcagagcgcacagcagaggctcagtgtgcactttgctcggcgcctaccacatgcgtcatatatggcggtggcca

SEQ ID NO: 2525 - DNA, 532 bp, Homo sapiens
ctcgtgccgaattcggcacgaggggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttgggttcctttttcctttttagtgataaaactttatttgcctacacagccatatttgctcctttaaccagttgaatttgaaaaatgaaggcacatttggcaaaatccttgg

SEQ ID NO: 2526 - DNA, 227 bp, Homo sapiens
cttagctgtgctcgcgctactctctctttctggcctggaggctatccagcgtactccaaagattcaggtttactcacgtcatccagcagagaattggaaggtcaaatttccctgaatttgctattgtgtcttgggttcattcattccgacattgaaggtgacttacttaaggattgagagagaattgaaaaagttgagcattcagacttgtctttcagcaaggactb

SEQ ID NO: 2527 - DNA, 215 bp, Homo sapiens
tctcaggctacaccctagaccaaacctacgccaaaatccatttcactatcatattcatcggcgtaaatctaactttcttcccacaacactttctcggcctatccggaatgccccgagttactcggactaccccgatgcatacaccacatgaacacatcctaatcatctgcaggtctcattacattctctctacacagacagtatatattaaataa

SEQ ID NO: 2528 - DNA, 205 bp, Homo sapiens
agaaaagaaaaaaacagaaacagaagctcctgttcagcacctcagtcgtccacaccaagtgacactactggcccaggctaccttctccatctggtttttgtttttgtttttttttcccccaatgcttttgtttggctgctgtaatttttaaggtatttgagtttgaccagattagctctggggggaagggggtttccacattgtg

SEQ ID NO: 2529 - DNA, 232 bp, Homo sapiens
gaagatagaagacaacaacacacttgtgttcattgtggatgttaaagccaacaagcaccagattaaacaggctgtgaagaagctgtatgacattgatgtggccaaggtcaacaccctgattcggcctgatggagagaggagggcatatgttcgactggctcctgattacgatgctttggatgtggccaacaaaattgggatcatctaaactgagtccagctgcctaattctg

SEQ ID NO: 2530 - DNA, 224 bp, Homo sapiens
ctcgtgccgaattcggcacgagctcgtggtgaggctgacatgctcacacattacaacagtagagagggaaaatcctaagacagaggacctccagagatgagtgtctggagcgcttcagttcagctttaagggccaggacgggccacacgtggctggcggcctcgttccagtggcggcacgtccttggccgctctctattgtctccagctcagggctctgcgcac

SEQ ID NO: 2531 - DNA, 253 bp, Homo sapiens
cttgggagtagttctgaatatgaagtgtgttgatacaagaagcactgacaatgtttctgtttcttaaattaaaactggcctggttgcctttttatcaagagagcttaacagataaaaaatgaaataggtctatttcctactggccagcggagaatcttgcctaatttaaggatgcagtgtgaacctaaccattccactctgaccactctagtgtgtcatctatgtgaaatttaaacacatttctctctaggca

SEQ ID NO: 2532 - DNA, 241 bp, Homo sapiens
gaagcttgggatccgtctcctctttcgcctcctgcaccttgggagccccgggctactctctcacagcccctgttgccctgtgatctgtaggtccttggggacgatagtcaaggtgccaggccatcctggaggctgggaattgtattgaatcaatttcctaccaccgtggtggaggatatcctatcctatatcttaccatctatatagcatttccacacagtacgctgtagagattctcgct

SEQ ID NO: 2533 - DNA, 241 bp, Homo sapiens
atcctcacatctgttttcacaccttcatccctgtcttcctcatgttcacacttgtcttccccatgttcatagctgcctttcttaccattttggtttgaagggcagtcttctctggcttgtttttttgtttttcccagaaaatcaggattatttttgaaattaggagaaccattcctaggaggtgattattgtgtgaaaccctcctttggctaattgccttttccgagatttgagttccttc

SEQ ID NO: 2534 - DNA, 173 bp, Homo sapiens
ctcgtgccgaattcggcacgaggtgaaaccctatctctattaaaaaatacaaaaaaatacaaaaaaattagctggggcatgttggcatccacctgtagtcccagctattttggaaggctgaggcacgagaattgcttgaatcccggaggttgaagttgcagttagccaagaat

SEQ ID NO: 2535 - DNA, 323 bp, Homo sapiens
ctcgtgccaatttcggcacgagggccacctcaagagaaggctcacgatggtggccgctactaccgggctgatgatgccaattttggtccgtgaccgtgaccttgaggtcgacaaccaccctcaagagccttagccagcagatcgagaacatccggagcccagagggaggcccgcaagaaccccgcccgcaccttccgtgacctcaggatgtgccactttaactggtagagtgggagatccctggattgaccccaccaaggctgcacctgggatgccatcagagtcttctagcacatcgagacgggtgaaactgcgtagtaccc

SEQ ID NO: 2536 - DNA, 338 bp, Homo sapiens
cttgactactcgcatcgcgcactttttggatcggcatctagtctttccgcttcttgaatttctctctgtaaaggagatatataatgaaaaggaattattacaaggtaaattggaccttcttagtgataccaccatggtagactttggctatggatgtatacaaaaacctttattctgatgatattcctcatgctttgagagagaaaagacccacagtggttcgcacacctgaaacagcttcaggcagacacagacccaattgtgaagatgtttgaagatccagaactacaaggcaaatgcagtcacccaggaatggtaggatgctctttgactacctt

SEQ ID NO: 2537 - DNA, 272 bp, Homo sapiens
cggtagcccggtagctctagccgggcctgagctgtgctagcacctccccccaggagacctttgcagtcggccagcccccttctccacggtaaccatgtgcgaccgaaaggccgtgatcaaaaatgcggacatgtcggaggagatgcaacaggactcggtggagtccgctactcaggcgctggagaaatacaccatagagagggacattgcggcctcaaatcagagggattttgacaggacgtccactcccacctggcatgcatcgtggggag

SEQ ID NO: 2538 - DNA, 119 bp, Homo sapiens
ctgatgtgactgatggtgtactgagtgatgtgactgatggtgtactgactgatgtgactcatggtgtactgagtggtgactcatcgggtactgaccaatgtgactaatggggtactgag

SEQ ID NO: 2539 - DNA, 250 bp, Homo sapiens
ctgatgtgactgatggtgtactgagtgatgtgactgatggtgtactgactgatgtgactgatggtgtactgagtggtgactgatggtgtactgactgatgtgactgatggtgtactgagtgatgtgactgatggtataccgagtgatgtgactgatggtgtactgagtgatgcgactgatagtgtattgactgatggtgtactgagtgatgtgactgatggtgtactgactgatgtgactgatggtgtac

SEQ ID NO: 2540 - DNA, 344 bp, Homo sapiens
cgaagatgcgcgggaggtcgcaggtcctggtcgctttgataggtccgagggccatctcctggggcccgcctggccgaattccggtgggcctaaaccaaggtaacttgctgggccccggaaaggttgggtgggtccgtaccgctgtgaaggccatccaacatttcctcggcaatttcttccagaaccagagttgaggtacctggcttttcctccgcaggcggatagaacaccaaccctttcccagaggccctctaccatctcccgggccccagagccgcatcttctgcgcggcaccgtgcgagggtatcgttgccccacacaccaaggcgaggccaggccgctct

SEQ ID NO: 2541 - DNA, 313 bp, Homo sapiens
ggtctacgccgagtgacagagacgctcagggctgtgttctcagggatgaccgaggtgggaagacagcagcaccagcggtggccagagacccaagacaatccaagctctttggggaggttggagcaccgatggatgtcacagatcaatgctatttccctgcaggattcacattgcagtgaaggagatgtatgccaagtacctccctcacagtgcagggcggtatgccgccaaacgtttcccgcaagctcagtgtcccattgtggagcgcctcactactccatgatgatgcacgcccgcaacaccggcaagaagt

SEQ ID NO: 2542 - DNA, 151 bp, Homo sapiens
gcgggtgccagtagtcccagctactcggggaggctggaggcagggagaattcgctttaaaccccaggagggggaaggttgcagttaagcctgagaatcacgccgactgtgcctccagcctggcaacaacagagcgagaactccgctctcca

SEQ ID NO: 2543 - DNA, 311 bp, Homo sapiens
ccacaacggccaccccataaggcataggccaagaccataccccgccggaatgtaaggaaaggaagctctctctcagacagccatctcatagggccccatttccaggaccacttctgagtacatcattttcatgtcatcctgttggcactgatgaggaaccctttacagtccagggttcctgggaccttctaccagtgccactctgacaggcctcaccagaggtgccacctacaccatcatagtggaggcactaagagccagcagaggcataaggttcgggagaggttgtcaccgtgggcactctgtcaccg

SEQ ID NO: 2544 - DNA, 201 bp, Homo sapiens
aagcgttcttcttggcttctgagttagaacgttgaagatgaagtcagttccccatccatcagatgcggtctgtattatcttcaactttgatagcctcagtagacataagggctttcaaggacagcatggcccatgcaaagctagaggaacagaaagtgccttacttgttttgggcaacttgagtcttgcttagctctgcac

SEQ ID NO: 2545 - DNA, 616 bp, Homo sapiens
aagcgttcttcttggcttctgagttagaacgttgaagatgaagtcagttccccatccatcagatgcggtctgtattatcttcaactttgatagcctcagtagacataagggctttcaagaccagcatggcccatgcaaagctagaggaacagaaagtgcctgactgttttgggcaactggattctgcctgagctctgcacaaatgtgcctttgtctcactctctctgggaagctacagtgagccctaagcggccctgttgcctacctggccttcactgctgtgtctgctttcatttaagttttaacagcctctcccaactccaactctggcagtagccggtctcgcctatctacagggcacagctcctggttgggatttctcttcatggcaaacaagctctcaagcaaggtgctgggtgggctggttcctccccctctggcccttcaaagccatcctgggtaggtgtcactattggcccgtggcttctctaatactaaccacatcaaccggaaatggtcctttcaataaactctcttcaatcaactcaactggtcgcaacaatgtgttttccctgccaaggaatcctgatggattgaccaagcgagtggaaaacac

SEQ ID NO: 2546 - DNA, 120 bp, Homo sapiens
tatcacacaatattaagtctttctcctatagcttcagacagaatatttcaactaattgggtcactggaaaacaataatttcatatagcattctgataaataggtccacaggctaaacaat

SEQ ID NO: 2547 - DNA, 638 bp, Homo sapiens
tatcaaacaatattaagtctttttcctatagcttcagaaagaatatttcaactaattgggtcactggaaaacaataattttatatagcattctgataaataggtccacaggctaaacaatttttttttaaagttatttatcaatgtattcaagctgtgtgtttgatccgcaaagagatagggtttcagtttatacttgctgtttgttgaagcagcctcaggcaggaaagggatatgaaaaaagaagacaaccctgattactgcaaaatgaagagggcagcatggtcaccagctcaacgttagaaaaagggcattataaaagcagtgctgagagaccaggtattctgcctacttggatgagctgccacctttgaagcaatgccaaggtcatgtgcattgagctgttaaagatatctgagtaggaaaatgtcttcaggcaaggtaactttctttaaagtatgcttagcacctggtcatctggtcatctcaacagtggctcaatgatcaatagacaagagagcataaaacgttagtcaaatgccagaaagcttgacatctcggctggagagttaaattctctgacttttggaaggcttctcaaatttatttatatctgttccaggagctaggctaaattta

SEQ ID NO: 2548 - DNA, 144 bp, Homo sapiens
ataaattattttctcattgccattggaatagatatctcagattgtgtagatatgctatttaaataatttatcaggaaatactgcctgtagagttagtatttctatttccatataatgtttgcacactgaattgaggatttgttg

SEQ ID NO: 2549 - DNA, 228 bp, Homo sapiens
acctgccaccccactcttaatcagtggtggaagaacggtctcagaactgtttgtttcaattggccatttaagtttagtagtaaaagactggtttatgataacattgcatcgtaaaaccttcagaaggaaaggagattgttttgtggaccactttggttttcttttttgcgtgtggcagttttaagtgattagtttttaaaatcagtactttttaatggaacaacttga

SEQ ID NO: 2550 - DNA, 104 bp, Homo sapiens
gctaattaatagtatttcagatacttgaagaatgttgatggtgctagaagaattttgagaagaaatactcctgtattgagttggtatcgtgtggtgtattttta

SEQ ID NO: 2551 - DNA, 166 bp, Homo sapiens
tgcttcagaaaaaatgaaagaagcagtcagatttggttcatcttccttcctgtacagtatttcaaacttcccagtcattaaaaataagaatattctcatgttcataccatggattttctccgaggaggtggatattttgccttgggaattgaaaaggccaaggcct

SEQ ID NO: 2552 - DNA, 171 bp, Homo sapiens
tcttaagggggtggacccaagttcctcgaggaacatgcgcttttgccaagaagcacaacaaaaggggcctaaggaagatgcaggccaaccattgccagggcattgagtgcaacgtgccgaggctatcaagggccctcgtaaggcccaaggaggtaaggcccaaggatccca

SEQ ID NO: 2553 - DNA, 166 bp, Homo sapiens
ctttgttaaattgacaacaatggccatgtatccccatccccggttacgctgtatgtgcacctgcaaacaggtgtacaatttggcatctgtcaagactttctcaactcaagacttgctggcaatctgtaaaggaccaaatcttcaactgcaggtcctaacaaggaag

SEQ ID NO: 2554 - DNA, 227 bp, Homo sapiens
tctttgcaacaccatcttctagctgttctttctgagcaggtttagtgttatcctccgttcttttgtggaacctaattcttttgggacctcaattactttctcaacctatttgttctcccgtctgatgcctctttggtgggatactctttataaaaacaatatgtaattgtagcctatggtgtataactctaacactctaaaatgttgccacgatctcgagggctaaa

SEQ ID NO: 2555 - DNA, 276 bp, Homo sapiens
  misc_feature 46: n = A,T,C or G
tgtctttgcaacaccatcttctagctttctttctgagcaggtttantgttatcctccgttttttgtggaacctaattctttttggacctaattactttctcaacctatttgttctcctgttgtgcctcttgggtgaatcttttataaaaacaatatgtaattgtagcttatggttataactgaacacttaaagtttgccagatctgaggctaaatgctttatattgataactctttgatcctcttcatcaccttatgaggtaggtataatttccta

SEQ ID NO: 2556 - DNA, 226 bp, Homo sapiens
catcgacagcacaccgtaccgacagtggtacgagtcccactatgcgctgcccctgggccgcaagaagggagccaagctgactcctgaggaagaagagattttaaacaaaaacgatctaaaaaaattcagaagaaatatgatgaaaggaaaaggattgcaaaacagcagtctctggaggagcagttccagcagggcaaggtttttgcgtgtcattgcttcaagggcc

SEQ ID NO: 2557 - DNA, 254 bp, Homo sapiens
ctcgtgccgaattcggcacgagctttaatcagtggtggcagaacggtctcagaactgtttgtttcaattggccatttaagtttagtgggaaaagactggttaatgataccaatgcatcgtaaaccctycagagggaaaggagattgttttgtggaccactttggtttctcttttttcgcgtgtggccagttttaggtatatagagttttataaaacacagtactctttaatggacacaactggcccacatattt

SEQ ID NO: 2558 - DNA, 370 bp, Homo sapiens
tcgaagcgaggacgtggtgggtcctctggtgcgaaattccggatttccttgggtcttccggtagagctgtaatcaattgtgctgacaacacaggagccaaaaacctgtatatcatctccgtgaaggggatcaagggacggctgaccagacttcccgctgctggtgtgggtgacatggtgatggccacagtcaagaaaggcaaaccagagctcagaaaaaaggtacatccagcagtggtcattcgacaacgaaaagtcataccgtagaaaagatggcgtgtttctttattttgaagataatgcaggagtcatagtgaacaataaaggcgagatgaaaggttctcccattacaggaccagtagcaaaggagt

SEQ ID NO: 2559 - DNA, 324 bp, Homo sapiens
caccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggactggggacacagagacccctgtggggtgtgcgctgtggggaaggtccctcccaggtgtttagaagagcctaactgtgtccagtgccttggagcagaaagccagggtcctgagtggct

SEQ ID NO: 2560 - DNA, 243 bp, Homo sapiens
ctttagagaaatgtctattcctatcctttgctcatcgcttaaagggattatttgttatttaatgttgagttgtttgagttccttgtatattctggatattatcgccctctcagatgagtagtttgcaaatcttttatccctttcaggaggttattactccactctggattgttctctctgtctgtccagaggctttttacctcatatatagtccactcgtctatacgtgctctgtgctgtgcc

SEQ ID NO: 2561 - DNA, 226 bp, Homo sapiens
ctcatccccatggagcattgcaccacccgcttttttcgagacctgtgacctggacaattgacaagtacatcgccctgggatgagtgggcccggctgtttcggcatcaaggcagagggttatcgacagggatctgttgatctaaatccattccttccaaagaaccggattctctctttaaccctcccctcgcgtgtttctcccaatgttataaaatgtttgagatgg

SEQ ID NO: 2562 - DNA, 108 bp, Homo sapiens
gcgggtggagagccccggactggagctcctgcgaactccccttcctgccctcaggagatgccactgcaggacccaaggagcagggaggaggcggccaggaccaagaag

SEQ ID NO: 2563 - DNA, 490 bp, Homo sapiens
gcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgaactgccgtcgggtgagcacgtttcccccaaaccctggactgactgctttaaggtccgcaaggcgggccagggccgagacgcgagtccggatgtggtgaactgaaagaaccaataaaatcatgttcctccaaccaaaaaaaaaaa

SEQ ID NO: 2564 - DNA, 135 bp, Homo sapiens
aaaaaacaggggcagaagaacaaggaagcggagaggcaagagagagctgtagtacacatggatgaaccgacgagaagaacaaattgtacagttactaatttctgtcaaggcgaggaattgataaagagtcagagg

SEQ ID NO: 2565 - DNA, 111 bp, Homo sapiens
gtttaatttcggatttgcattgaaaaatatagtcttactgtacaatatgtcaaacatgtgaatttatgtgtaaaagcagggatatatcatgtgaaaatggaggatttttaa

SEQ ID NO: 2566 - DNA, 570 bp, Homo sapiens
gtttaatttcggatttgcattgaaaaatatagtcttactgtacaatatgtcaaacatgtgaattatgtgtaaaaagcaaggaatatatcatgtgaaaatgagattgtgaatatgttattaatagtaaaatgtcaggtggaaaaataggcagagtccaacttggacatatatctgtagctttcatttttccatctatttctctctctcgacacacacatggatatgtttaagttaagacatacatgaatttatttacagataagacacacatgaatttatttatagataagagtaatgaatgtatgtcagacatcatgcggatttatgaatttgatgttttggcttcagatggattatcatgttatctccgatgttctctcagttatgacccagaaacatttcttatcaggggcagaacttacagtacctcttttcttctaccccctttcccaatcctgactattacctgcttatttatcaccaattacaacatcttacatgggtcacagctactgctgcaggctggtatgaactcctggtgtcttaattcctattttttgctgttcaaaa

SEQ ID NO: 2567 - DNA, 282 bp, Homo sapiens
gatgttgtaagataaaacctcatctccagggtcacagccgggcctcggcctcctgtgagcagcgggaacctggaaagcagcacccagagcgccacgccgttccacagatgggggccagactccggcccctcagagacatagtggccgggtggtgggggccacaggcagggcttctgagccctgtcttgtatacagccagactttcagagtggtggggaggaggtttatggatgtcacacaccctcacctgagatatcctacacacacatagcacgttgtggg

SEQ ID NO: 2568 - DNA, 323 bp, Homo sapiens
gcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacggctgctgtccacggaaggctcccagaacatcacctaccactgcaagaacagcattgcctatcttgacgaagcagctggcaacctcaagaaggccctgctatccagggctccaatgacgtggagatccgggcagagggcaatagca

SEQ ID NO: 2569 - DNA, 332 bp, Homo sapiens
aaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatacctggtttatattggcctgtattgtgtgcctccaggagaacaccagggaaaaaggtgacccagggctccctgtgaactcaaggatctccagagagcaaaaggggatgggggaattcctctgtcctcctggtcccttag

SEQ ID NO: 2570 - DNA, 323 bp, Homo sapiens
attcgtaaggtctttccaataaaatttagtactttattgagtcaaatttgaacattgggattgtttattcatttttaccagggaaatgatcgtttaagcttctgttagaagaatattgacctggctacataggttaaaatggggaatcaattggagatagagaaataagttagatgtctaatttaacaacaagtagagtattaagtcattgatgcaaaaaaggctatggtaattataactatcaataaattttgtgaatgtattattaattaacattcttagaatgaggtggtgagaaaagatggagatgcatctcctttgtc

SEQ ID NO: 2571 - DNA, 325 bp, Homo sapiens
gcggcacgaggattgaccccaaccaaggctgcaacctggatgccatcaaagtcttctgcaacatggagactggtgagacctgcgtgtaccccactcagcccagtgtggcccagaagaactgtgtacatcagcaagaaccccaaggacaagaggcatgtctggttcggcgagagcatgaccgatggattccagttcgagtattgcggccagggctccgaccctgccgatgtggccatccagctgaccttcctgcgctgatgtccaccgaggcctcccagaacatcacctaccactgcaagaacagcgtggcctacatggaccagca

SEQ ID NO: 2572 - DNA, 229 bp, Homo sapiens
ggtggctgtgcacatgaacatcgtctattgtgtgccagccaaaacaacaaacagttggaagtaaaaacaaaaaccaaaacctcgttagattcccagcttcaccacttactagctttgtgacctaagcacatcacttaccttcttagactgttgtctaaggagggaaaattgtaatgtcaggtgtatgtgtagagagcgcgttagcgacatatgtgagacgctgtctagt

SEQ ID NO: 2573 - DNA, 250 bp, Homo sapiens
gtggctgtgcacatgaacatcgtctattgtgtgccagccaaaacaacaaacagttggaagtaaaaacaaaaaccaaaacctcgttagattcccagctccaccactcactagctttgtgacctaagcacatcacttaccttctcagactgttgtcaagaagggaaaattgatgcaggtgtatgtgaggagcgcttagcacatggtagacgttcagtaaattcatggaactctgaaaaaaaaaaaaaaaaaa

SEQ ID NO: 2574 - DNA, 216 bp, Homo sapiens
ctcgtgccgaattcggcacgagtacaaaagaaccaagtattaaaagcattttgtggggtacatcatttctataattgtataatgtagtactttgtgggtttaaatgataaagacattagaggtaacacacatataaggcatgtatgcactgtttgaaatgtaaatatattcttaggacaatttcaatatgggggtcgcactatgtcctcttgagtg

SEQ ID NO: 2575 - DNA, 257 bp, Homo sapiens
cccatcatgaacgacaccgtaactatccgcactagaaagttcatgaccaaccgactacttcagaggaaacaaatggtcaattgatgtccttcaccccgggaaggcgacagtatcctatagacagaaattcagggaaaaactatgccaaaatgtacaagagccacaccggatgtcatctttgtatttggagttcaggactcattttggtggtggcaagacaactgatgactttggcatagtatttatagtattcccta

SEQ ID NO: 2576 - DNA, 287 bp, Homo sapiens
gctcgtgccgaaattcggcacgaggatcaggccagtgggtatgtaaagaaggccctgaagctgatggggtcaaatgaaggtgaattcatcggctgaaggaaatagcaaatttcacctacacagttctggaggatggttgcacgaaacacactggggaatgtgagcaaaacagtctttgaatatcgaacacgcaaggctgttagatctatcctattgtgatgagtattgcaccctttgtacattgatgtggtcctcgtatcaagagtttgtgtgtggacgttggccct

SEQ ID NO: 2577 - DNA, 214 bp, Homo sapiens
catcctccagagaaggtggcccctggccccgcccctggttacagaggcaactaatatcctgccctgaaccgggaaccgaaaaacaattatatgtctaattcccctaagaaatataagaagagcgagccccctaattgaaggaaaaagacaggacaagaggcctctcttagacaaccaactctagtggccccattcaggacacacttgtagcaca

SEQ ID NO: 2578 - DNA, 290 bp, Homo sapiens
tgcaggcaggtgttggttcgggcacgggccacggtctaagcagttgcaggacagcaaggaaaggagcctctccagaccagaaggtgaagtcgggcccctaagatcacggagaggcccagccgtggctgtccacatccacagaggggctcaggatccccatgactcctacatcctctcttgtgtctccgccaccacccactgcctcacctcattccaaccggaccacaccgccttaaggggcccagaatggccagtcccccatggcagccctgatctaggtggcagacatt

SEQ ID NO: 2579 - DNA, 300 bp, Homo sapiens
cggcacgaggtgcactgggcttcctggaagcctggcctcctggtccccccggccctcctggagagaatggtttccaggccagatgggaattcgtggccttccgggcattaaggggcccctggtgctcttggtttgaggggacctaaaggtgacttgggagaaaagggggagcgtgcgccctccaggaagaggtcccaacggtttgcctgggagctataggtctcccaggtgacccaggccctgccagctatggcagaaatggccgagacggtgagcgaggcccccagggttggcaggaat

SEQ ID NO: 2580 - DNA, 307 bp, Homo sapiens
gaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcagggctggggctgctgccagcgagtccctctgcgtctctaaccacgcctattaagcggaggtgttcccaggctgcccccaacactccaggccctgccccctcccactcttgaagaggaggccgcctcctcggggctccaggct

SEQ ID NO: 2581 - DNA, 196 bp, Homo sapiens
gtaaaacagtccagactcctgatttctgtccccagctctgtcttacccactcctcttctttgggcaggtcatttctctccgggcctgagtttccttactttttaaatgagagaattaaactttgcaatctccaaggccccttctcactcttgaaaacactatcttcataggtaggtattatttccacattccccat

SEQ ID NO: 2582 - DNA, 450 bp, Homo sapiens
gtaaaacagtccagactcctgatttctgtccccaagctctgtcttacccactcctcttctttgggcaggtcatttctctccgggcctgagtttccttactttttaaatgagagaattaaactttgcaatctccaaggccccttctcactctgaaaacactatctacatagtcagatataatcacacatccccagtgtcctgggatcattaaaagttcagtctactaacagaactgtgtggtaagaatggtaatgaggttgctggtcagtctgacacaggagcctcagggattcctacttgatctgtatatccgttaagcctggtaccttcttctgcaagtatcagaaaccctgcaactgactaacttaaactaacttaacagtagaactaatttaactaaccgaaacaggacaatgcatttataacaagacagtttattataaaaagaaa

SEQ ID NO: 2583 - DNA, 153 bp, Homo sapiens
ctttactcgacatttactaaggtgtttcttttgtggttcttgtaatctacaatccaacagtgtttttgagtagagctgtgtgtaaatatttgacaaccaggttacttgattatttctgttctcatttaggaccaggaatctcaaccgagtagg

SEQ ID NO: 2584 - DNA, 103 bp, Homo sapiens
ctttactcgaaatttactaaggtgtttcttttgtggttcttgtaatctacaatccaacagtgtttttgagtagagctgtgtgtaaatatttgaaaacaggtta

SEQ ID NO: 2585 - DNA, 151 bp, Homo sapiens
caaccatcggcagccgattccgtgtcttgatcacggggtgggagggaaccgtgggcgtccctgcgtggggcccatgggtgagacactccagtactgagacctagagtccagatgcttgtaggagccaagtcgtgttctaagtatttattta

SEQ ID NO: 2586 - DNA, 108 bp, Homo sapiens
  misc_feature 4: n = A,T,C or G
tggnacagctgaccagtttctgaagcgttccttagaaatgagggagcgagttctaggaccagatcaccctgactgtgctcagtctttgcattattctggcagctctat

SEQ ID NO: 2587 - DNA, 107 bp, Homo sapiens
caactctttgctttatagcattttgttgtattcacatgataatggtagcatttccatgcttgtgacagcatttttaaggttattaatatatttgcatcaacctttca

SEQ ID NO: 2588 - DNA, 225 bp, Homo sapiens
ctcgtgccgaattcggcacgagcaagttttaggagttcatatcctatatcatttcaaattaagtacataataaagtaaaattttgagatgaacactttaggtattttttgccaagatttagatgtttttaattaaacttttctctccctttttttttcactaaagcatgtttattcccctaatccattaaagagcatgaaaaaaagataaatgtatttgagaatt

SEQ ID NO: 2589 - DNA, 320 bp, Homo sapiens
gttcatctcccaccaggacattcgaaagcgaaactatgtgcgggatgatgcagtcttcatccgtgctgctgttgaactgccccggaggatcctcagctgagtgcaggtgggggttcgaggggaaaggacgatggggcatgacctcagtcaggcactggctgacttggagagggggccggaccccgtcagctgcttctcctgcctaggttctgttacccatcctcctccccagccaccaccctcaggtgcctccaattggtgcttcagccctggccctgtggggaacaggtctttgggtcatgaagggctggaacaagttg

SEQ ID NO: 2590 - DNA, 240 bp, Homo sapiens
gtattctccctgtgtgcatgcctgtctccaaatttccacatttcaaaaggacacaagtcatattggagtaggggcccaacctattccaatatgacctcatcatcgtcactaattacatctgcaatgaccctatttccaaataaggtcataatctgaggtactgggggttaggacttcagacatccaaatcttgggggggacacatttcaacctgtaacaaggggggtgggcagttcacag

SEQ ID NO: 2591 - DNA, 113 bp, Homo sapiens
gcaaaattaccgaattaaacctgttttatggatggcagcttggagcatagcaaggaagttgggaggattttgaattccatttccaagttcttcaatggtgtttttggtttctt

SEQ ID NO: 2592 - DNA, 172 bp, Homo sapiens
gttaatagtaattatagtcaagctggggttaaaaatttgttgtagatgatgcatacttggggataattaagagtaccatctaattttctgtcactttagaaaggaacaagtggcaactttgttgacttattggagaaagccagatgttctttactcagtaataccccttact

SEQ ID NO: 2593 - DNA, 181 bp, Homo sapiens
ctcgtgccgaattcggcacgagggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgac

SEQ ID NO: 2594 - DNA, 154 bp, Homo sapiens
atttagacagacttctataaacagtgatcatattgctgtccaatatgatatcccctagctacatgtagctattgaccacttgagatgtacaggttagagctgacatgtgctgtgagtgtgaaatacacacaagatttggggaacttaatatgag

SEQ ID NO: 2595 - DNA, 348 bp, Homo sapiens
ctcgtgccgtcataccacacacctatggtggacagaacatctgcattcaccagaatgtacttgttcctttggctgtgaataaattggataagacttttttattgtaagttccagcttttggaagatacggggataagattgacattgctgttgcagtattgcaaaaacatgactaaattgtgttataatatgtctaccgcttatgtttaagagaatcctcttcactaacttaaattgttaacattgttgtgatatttgagagagagtattaacctcaacagtcactttacaacactcatgtgaagacgtgtgcctccagttgaggggttttgcatttctgagcctcct

SEQ ID NO: 2596 - DNA, 106 bp, Homo sapiens
ttacagtagtgtataaattaaatattgtggaaaaacagtcttgtatttttctgtatgtgtgtatatatatatcgcttatggacttccttggcaattctatctgtat

SEQ ID NO: 2597 - DNA, 116 bp, Homo sapiens
ctcggtttctcggctgctgggtcggtcccgcccacagctggggcggcctatgtcgagtggcggccatgggaaggagggctcaactcgcatgttgaagactctcaccttcttcgtcg

SEQ ID NO: 2598 - DNA, 148 bp, Homo sapiens
ccacaaccgacttcatcaagtctgtcatcggtcacctgcagactaaagggagctagagccctttatttcttccaaccttgcaaggaccacactccccatacccttcagtgcagtgtaccaggggagagaccttgtgcctctaagcagt

SEQ ID NO: 2599 - DNA, 200 bp, Homo sapiens
ctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcggttgcattgtctttaatataataaaaggtattacctctcacatattaa

SEQ ID NO: 2600 - DNA, 225 bp, Homo sapiens
gccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttgtgagggcaaggggaggggaatgtgtgagatcccagccctcgtgtcatatgatcttttgtg

SEQ ID NO: 2601 - DNA, 268 bp, Homo sapiens
gagaggctcttttcaaccctattttctctctccatccttctagatgatcccacctccccaaactctatggtcttctggatgtgcaagatacgtgcactggtgatgcacgcgagcctaggagggggtagattccagaatatgagtttctggggcctcggaaaggaaacagctatttatcatgcatcattatacaccctgctgtctgcagatacttcagtgttactgcaggggggttctctgaatttctccgcttttggcttcccatttg

SEQ ID NO: 2602 - DNA, 216 bp, Homo sapiens
ccggaccaggaccgccagcagctgggaggaggactggttcgccaagatccccctggcctgggaggcaagcagctcgtattaaactctacggaggccgactttgttctcttcggctaccccaagcccgaaaacctcctccgagactgtaaagctttcgcgttgctttttctcgcgtgcctcgaacctgacgaacgcgccactccagttttttttatg

SEQ ID NO: 2603 - DNA, 247 bp, Homo sapiens
ctgggaggctaggcctgtctctccttttgacgtttttctgcctggtttatgtttgctgggagctattagactgtagccagcagattcagggtggatctggcttgcccaggccactgactgcgatgttaatgctcttttgatcagcagccacacgacgcacactcaggaattgatgactttgatatcactcaatgccaatcagtttagacactcactattaggccatcacatatataggtatttatgt

SEQ ID NO: 2604 - DNA, 299 bp, Homo sapiens
ctggtgcgggagctacggggcccagggattgtgtttaaagtagtgcttctaccaacatgtcccgtggttccagcgccggttttgaccgccacattaccattttttcacccgagggtcggctctaccaagtagagatatgcttttaaggctattaccagggttggcttacatcagtagctgtcagaggggaagactgtgtcagtgaattgtcacacagagagagagtgtctctacacattttttgggttcagcgcagtgtctctctctttcacgatatctctgaacacatggtgttgtgt

SEQ ID NO: 2605 - DNA, 226 bp, Homo sapiens
gagaaatctcgtctcgaccaagagctgaagctgatcggcgagtatggctccgggaacaaacgtgaggtctggagggtcaaatttaccctggccaagattccgcaagcccccccgggaacctcttgacgtttgatgagaagtgcccgaagtcgtctgttcgaaggcaacgccctgtgtgcgcgcgcgctggtccccaatatggggtgctgtatagagagccaaaatg

SEQ ID NO: 2606 - DNA, 247 bp, Homo sapiens
gcaccatccctactgccccccaagaaagaaacactcaaaatgttgctattccaaagtgtaagtcagtaaccattccctaattcttttaggaaacacctttcatattacttttataacacaggtaaataattaatggtcaccattgttttattgttagatggatagtaccctagttgaaggccccaattaatatactctaaacgcgaagactctaaaactctaagatgtagcgccacagtttttttta

SEQ ID NO: 2607 - DNA, 610 bp, Homo sapiens
gcaccatccctactgccccccaagaaagaaacactcaaaatgttgctattccaaagtgtaagtcagtaaccattccctaattcttttagaaaacacctttcatattacttttataacacaggtaaataattaatggtcaccattgttttattgttagatggatagtacctgagttgaaggcccagaattaatatactaaaaacgtaaagacttaaaaacttaaagatgtagcaacagatttttttttaacccgcttcaatcaaaaataactaactagaattaaaaaccatttgtctttgtgaatctcttccttgctggattaaccctcatgctgagagccgtcaatctcctacttatatttgacttaacatttttctggtttgtttttggttacggaaactcaccttagaaacagactcagtgctctctgtgccagtttgcctgcctgcttgcctgctctttagcaagtaacctataaatattcgtggtctatgaattctctctttgatgatgtatttacttcctggttagctgttttatcacttaatctgccatcagttcaagagataaagtgcatacaaatcgtaaccctgactaaaaaagtgggcac

SEQ ID NO: 2608 - DNA, 218 bp, Homo sapiens
ctcgtgccgaattcggcacgagcccaggttccagcgtgcccctccctcagacacacggacacaatcagccgagaagttcctggtctgcatcacgagaatttggaggggtagggggtgtcaattgaaaggcataaggctgagctgagaccagttgctggtgaaactcgggccaatctctgggaggggaacatacctttccacaggagtgtttttagggg

SEQ ID NO: 2609 - DNA, 229 bp, Homo sapiens
ctcgtgccgaattcggcacgaggagaatgaagactattctcagcaatcagactgtcgacattccagaaaatgtcgacattactctgaagggacgcacagttatcgtgaagggccccagaggaaccctgcggagggacttcaatcacatcaatgtagaactcagaccttctttggaaagagaaaaaaagagggctccccgggtgtacaaatatgtgtgggtgtacacaaa

SEQ ID NO: 2610 - DNA, 265 bp, Homo sapiens
ctcgtgccgaattcggcacgagtgatgtcatgatcaatgactttggtgatcagaatcagaagttcggatttgaagttggtcctgtttgttttcttggctaagattaagacaaaggacatatcaaatcaacaggaaatataccttgtgtgccaccaaacccattttgtgccacatgcaagttttgaattaggatggtattgagaacaacgctgcatatacaggtgccacttttggggatatcgctgtctctgtggggggcagagtc

SEQ ID NO: 2611 - DNA, 284 bp, Homo sapiens
ctggagtgtggtggcacaatcacagctcattgcatcctcaatcacccagggcctaagcaatcctcccacccttgtagctgggactacaggttcacagcacacctgggctaaaatttttttttttgttgagacggattcctctatgttgcccaggctggtcctcaggcttcctgggctcagatggtcctcctgccctcagacttccaaagggcacagagccaagtttgttggctttgtcccttgcccatacatgccccaacaggaggttctttacccttttaatg

SEQ ID NO: 2612 - DNA, 288 bp, Homo sapiens
attgccacacatacagtaggagccttttgcttctcctaaagccattttcatctgccccaaccctgactgtagttgtcagggagcattccaggttgtttgtcaccagtagtaaaactctaggagcatgtattcattcaggaaccatttattgagctccttctatgtgtaagaaataccataggattaaggtttcaactatagggaaatatatgaaaggttcttttaatttccctttttctctatcctgatttaaatgtgtgattttttacattcacagacaaatagctt

SEQ ID NO: 2613 - DNA, 530 bp, Homo sapiens
attgccacacatacagtaggagccttttgcttctcctaaagccattttcatctgccccaaccctgactgtagttgtcagggagcattccaagttgtttgtcaccagtagtaaaactctaggagcatgtattcattcaggaaccatttattgagctccttctatgtgttagaaataccataggattaaagtttcaactatagggaaatatatgaaagttcttttaattttcctttttttctatcctgatttaaatttgtgattttttacaatcacagaacaaatagctttaggctttacaacttataaaaactatcctttgaggaattctatcatatcctggttatgaattttatttttgctgcaaagatgggagaagtttactgtgtttccttcctacattccctgctcctccttcctttttgagcactggcgggggaagatgcccttagacctcagggatccccaagcctgacttccagcagatatacttgtgacaaggcccaacctactggacagccactcccgtaat

SEQ ID NO: 2614 - DNA, 303 bp, Homo sapiens
gaaagtaggatagtggtttaccaggagtcaggaggaaagatggtgaggagttattgttttatgcatacagagtttcaattgggaatgctgaaaatttctggagataaacagtggtgatgattgtccacaattgtgaatgtactcagtgccactgaatttgtaaacttaacaccagttaaatggtgaagttgatgtcgcatatatttcacacgagtacttctagagcgcccgcgcgcccatcgattttccaccggggtggggtaccaggtaagtgtacccaattcgccctatagtgagtcgtat

SEQ ID NO: 2615 - DNA, 193 bp, Homo sapiens
catgatatgtctaaaaattttcaggaaaatggaatctttttttaaagttcaggtatgacaaagtatagaatttattcatttaacatattcacatttaggttatgtttctgatattgcagaaaaatgaaagtgtttgagttcagcctctcatttactccatttcaattaaaggctctggaaagggtaggttgtt

SEQ ID NO: 2616 - DNA, 269 bp, Homo sapiens
gacagctggtgcgcctgcccgggaacatcctcctggactcagtcatggcttgtggtctggtcgccagcaacctgaatctcaaacctggagagtgccttcgagtgcgaggcgaggtggctcctgacgttaagagcttcgtgctgaacctgggcaaagacagcaccaccctgtgcctgcatttaacctttcgtttaaacgccaacggggacgccaaacaccattcgtgtacacagcaggaccggcggcccttggggcccgcgcagcgggag

SEQ ID NO: 2617 - DNA, 145 bp, Homo sapiens
gaagaaacggtggcagagattaacgcaacaatgagtgtccatctcccattttgcagtgggttggcagcaccgaaggaggtgaaggatttggcaacaaggatggccaaaggcccaggcagttaccccttggggttgtgttccaggt

SEQ ID NO: 2618 - DNA, 188 bp, Homo sapiens
ggatgttgcagagtttcttgttaagtatattttgtacatgaattacttccaggaaaaggtcagttcaattgtttaaaggtttttcatacaaaataacttaaaccagacctcttagggatttgccaactcctaaccctggtaattataccctaagtctattggtaatcctctgctgtggtttaaaatat

SEQ ID NO: 2619 - DNA, 280 bp, Homo sapiens
ggatgttgcagagtttcttgttaagtatattttgtacatgaattacttccaggaaaaggtcagttcaatgtttaaagatttttcatacaaaataactaaaacagacctcttaggaattgcccactcctcacccctgttattaataccctaagtctatttgttaattctctgctgttgttttaaatatttacaaatttccctatccttttctgtgccgtttcaaaatataaacttagtttttcttaacctgaaaccttagatagtaaaaaaaaaaaaaaaa

SEQ ID NO: 2620 - DNA, 203 bp, Homo sapiens
gccccgcgccccgcgtcgggtcccatccggccatcgtgcgctgccccacggttcggtaccacacgaaggttgcgcgccggccggcggcttcaggcctggaaggagctcagggtggccggcaattcacaggagggtggcccgacccatcggcatttctgttggatccagaggcctaacagtccacgagtcctgcaagccaacgt

SEQ ID NO: 2621 - DNA, 187 bp, Homo sapiens
ctggggatttcataactcaaggaattcccctcaggacagctgtagtgggctccccattgtttaacttcagattatcccgatatagctttgtgttgtttgcaattcatgagccactaagagccatataagttacttcttggaaggttttacaaggaaccatgaggaactgacttgctggcatcgaaag

SEQ ID NO: 2622 - DNA, 590 bp, Homo sapiens
ctgggatttcataactcaaggaattcccctcaggacagctgtagtgggctccccattgtttaacttcagattatcctgatatagctttgtgttgtttgcaattcatgagccactaagagccattataagtactctttggagggttttacaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgacagggt

SEQ ID NO: 2623 - DNA, 283 bp, Homo sapiens
aaaaaggaaaaaataaaaaaaccatgtatatttgtacaaaaagtttttaaaagttaatactaacttaatattttcctatttaatgtccaggcgtggaccgctctgccacgaactagctcggttattggttatgccaaaggcactctccatctcccacatctggttattgacagtgttactttattttcatcgcggactcttggggaagggggtcactcacaagctgtagctgccattcatgcccatctagcttgcagtctcttcgcgctttcgctgtctctct

SEQ ID NO: 2624 - DNA, 207 bp, Homo sapiens
ctggtttctccataatatctacaagtgaagatgaagattacttctcaaaaagtatccatatttccagtgttccttttaataaaatatgccacttttaaataaaataattacaaaatgtaaaattataaaatttttaaatttaaataataagtgaccgtaaaatttttttgacaatatatatagtcactgtctcttgtaatttaaaca

SEQ ID NO: 2625 - DNA, 298 bp, Homo sapiens
ctggggccaaagccaggaccagcaggagaacacacacaataagagctagaagacctccttgctggtgggtttgtcctaaaagggagcaggcaggccggaagagaaacttctgcaagaaaccagaacaacatctttttgggctcaaggatcgggtgttgtcaagagagaggctctctttctatttatattttaaaatcacaaggtacacactcacatagagagacacatagtcacatatcaccctctgaggttttattttatggcacagcttctctctgctcctcttctcatagtcstg

SEQ ID NO: 2626 - DNA, 536 bp, Homo sapiens
ctggggccaaagccaggaccagcaggagaacacacacaataagagctagaagacctccttgctggtgggtttgtcctaaaagggagcaggcaggcgggaagagaaactcctgcaagaaaccagaacaccatctgtggggctcagggatcgggtgttgtcaggaaagaggctcttttctatttatttttaaaatcaaagttacacattcacatggagaaacaaatggtcaaataacacctaagaggctttatttcaggacacagctactctgtcccccttttctcattgtctgcccacaaaaccattttccattctatgacctgagtcacaaagaccttctgtgctgtctccctctgccaaggtgctggccaccccctccattacttgagcccttacagctatgcatgattgctgcattggtaatttgttgcaacaatttggtgataacaatttaacacttaacccagttttccacctgtataacatctcatagccgattaaatgagattttcactcaaaaaaaaaaaaaaaaaaaa

SEQ ID NO: 2627 - DNA, 110 bp, Homo sapiens
ggtatatctatgttaacctcaagatggactgagttctgtatggcagaactattgctgttctctccctttcttcatgccctgttgaactcttctaccagcttctcttctta

SEQ ID NO: 2628 - DNA, 117 bp, Homo sapiens
ggatggtgtggcttccaccgaggcccgcatcgtgttcatgaccaccaaccacgttgacaggctggaccctgccctgatacggccggggcgagttgaccttaaggagtacgttggctw

SEQ ID NO: 2629 - DNA, 126 bp, Homo sapiens
aagagccatttccttttggaacaatggtgccgtttgtttcactttttttttttgttattttttcccctaaatctttgttggaacaaatctttgccgaaactttttcagggcagcccaactttcctt

SEQ ID NO: 2630 - DNA, 560 bp, Homo sapiens
aagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttgggggataatgtgtggagcgaattgggtacaa

SEQ ID NO: 2631 - DNA, 169 bp, Homo sapiens
ctctactaaaaatacaaaaatttactgggcatggtggtgggcgctgtagtcccagctactcaggaggctgaggcagaagaatggcatgaacctaggaggcagagttttgcggtagcttagatcacggcacttcacttcagacttggttacagagttagacttcttctta

SEQ ID NO: 2632 - DNA, 221 bp, Homo sapiens
ctgggacaagggccactgggctggtctgtgtctgggcctgtcccatggctggggcagtgaggggggcccagtcagcctcttttgggcacctctctcagccaggcttggcccactgccatcacccagcaccccagatcaccgccaggccagcccccaatggtccccttacggacaggtcccagagatggacaagagcacccagggccccaaccgtccttctg

SEQ ID NO: 2633 - DNA, 344 bp, Homo sapiens
cggcacgagccaaggacaagaaacacgtctggctaggagaaactatcaatgctggcagccagtttgaatataatgtagaaggagtgacttccaaggaaatggctacccaacttgccttcatgcgcctgctggccaactatgcctctcagacatcacctaccactgcaaggacagcattgcatacatggatgaggagactggcaccctgaaaaaggctgtcattctacagggctctaatgatgttgaacttgttgctgagggcaacagcaggttcacttacactgttcttgtagatggctgctctaaaaagacaaatgaatggggaaagacattcattgattaca

SEQ ID NO: 2634 - DNA, 356 bp, Homo sapiens
gtcctctggaataagagcctgtggctgaagcagagggccttctcgggagagctctccaaggtcttggaggaagggtccccccagaaggagctccggggttagccccactgtgcccccctggactccaccagcttcatgcttctcagatgctacccaggggccggcccgggggagaccagggcaagatttctcccgcaccaggtctgtggagggtttggaggtctgttagagcagacactgtcccattgctgggcgctgggggaaagaatatctgagacgacgtttggggagcaatgctctttaccacgttcaccaagtcgtctggggcaggtttgtaagctgcagcagttgctggt

SEQ ID NO: 2635 - DNA, 187 bp, Homo sapiens
ctcattcagtaatcagacaggccctgcttgggcaggctcagaacagagactacacataccgaggagctgctgaatcgagtgttcaaccatcatgaggaacaaggcttccagatattggtgcttgggggagaacaggaaattttggtaattgaaacctccacaggtcgtccgattgggacccaagaaa

SEQ ID NO: 2636 - DNA, 216 bp, Homo sapiens
ctcgtgccaattcggcacgagcttacagttgccatcacctttctgtggtaatactactgatatttgcctttcctatataaggaaagtgtgcctagggctgtctggtattctttcaaggggttttccagtatgaatgttaatgtggtcagtgtatgtatgaatatgaaagtgccttggtttggttggttgctgtttttgtgtttatgtgtgtgttta

SEQ ID NO: 2637 - DNA, 306 bp, Homo sapiens
gtttcattccatgtaagcattaaaacagtgtatgtaggtttcaagagatttgtgatgattcttaaattttaactaccttcacttaatatgcttgacctgtcgccttactatgtaaggcatctagactaaaggccaaaatataataatgcctgccttctctaaaaacccaaattgtagtctctctattaaccctgaaatgtacactagcccagaacagtttaatgggtactcactgagctatagcatagctgctgagttgtttgtgagatttttgagtcaacacataatggaaacttctttcttcta

SEQ ID NO: 2638 - DNA, 211 bp, Homo sapiens
ctcgtgcgaattcggcacgagaggtaagccaagatgggtgcatacaagtacatccagggagctatggagaaagaagcagtctgatgccaatgcgctttcctctgaagggtcccgctgctggcagtaccgcaagctctctgctctccacaggctcccggcccaacccggcctgtataagcgcgccgactggcttacaaggccaagcaaggtt

SEQ ID NO: 2639 - DNA, 176 bp, Homo sapiens
gacagcgaggacctccaggagaagcaggtcccaaaggagatagaggggctgaaggtgctagaggaatttcctggtctccctgggcccaaaggaggacaacggtttgccaaggtgttggatggccgtattgggttccctggattgcctggaccaagggttgacccaggaaaccctgg

SEQ ID NO: 2640 - DNA, 231 bp, Homo sapiens
tggaggtggtggcctactcttccccaggacactcagacactgaccctgataactcgtccctgacagggacactcctacacaaaggttgttgcgggtctgaaatgggcctgtgaggaccccaatgcttggacaaggaaaggacccacattgacaaccaagccacagtaagtagcaggcttgtcattggcacacagtggcctcaaagggcaacgatttgattggaagtaacag

SEQ ID NO: 2641 - DNA, 206 bp, Homo sapiens
cggcacgagggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacaggggcatctcaggctgactgtgctgtcctgat

SEQ ID NO: 2642 - DNA, 206 bp, Homo sapiens
ggttacatatggtcagcttcagcaaccaacaacgggagcagccagtggtggatacattagacgcataacttatgatgccagagaagatgatatggaagagaacctgactcaagtgggcagtatcctgggatatctaaaagacatggccctgacacataggcatatgagattgatgctcaaaatccacaaatattagcgctatcaca

SEQ ID NO: 2643 - DNA, 211 bp, Homo sapiens
gcaaaacaacatagacatgaagtgtcctttgttattcataatctgccaataattgccaagatggctgccgtcagcaggccagtggacggtttgggcttcttcaaggacctcagctgatacctgttgggggattactgatttgtctgtcaagagaaacaggcggctcgcttttgttctgagatcatatactccaagtacggagagggtcacc

SEQ ID NO: 2644 - DNA, 171 bp, Homo sapiens
ttcagattcagcatttgttctttgccagtctcattttcatctccttccatggttccacagaagctttgtttcttgggcaagcagagaaattaaattgtacctattttgtatatgtgagatgtttaaataaattgtgaaaaacatgaaataaagcatgtttggtgttccaca

SEQ ID NO: 2645 - DNA, 142 bp, Homo sapiens
gtggaggccacaggagcagaaacatggaatgccagacgctggggatgctggtacaagttgtgggactgcatgctactgtctagagcttgtctcaatggatctagagcttcatcgccctctgatcgccgatcacctctgagac

SEQ ID NO: 2646 - DNA, 201 bp, Homo sapiens
taatgagagctcaattttgttgaggacaggaatgtcctgatgagagtgttggaacaccagttggttagaaaaataaaccagaaccaaggacttaggttaaaatagtaggtgggttcagttggctattttaactgggttttctttgagggtttaaaactaatgcatttcttagtgcccctctgtagctctagtgtaccagat

SEQ ID NO: 2647 - DNA, 240 bp, Homo sapiens
cgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactattggagctcaatgtgataaggcccacaaggagtttattctcttcccctcgggaagagaaagatacccggccgt

SEQ ID NO: 2648 - DNA, 123 bp, Homo sapiens
gggatttgatggcgtgatgtctcacagaaagttctccgctcccagaacatgggtccctcggcttcctgcctcggaagcgcagagcaggcatcgtgggaaggtgaagagcttccctaaggatga

SEQ ID NO: 2649 - DNA, 178 bp, Homo sapiens
cttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaggctta

SEQ ID NO: 2650 - DNA, 281 bp, Homo sapiens
cggtggtgctgaccaggaattctttgtggacatttgccagtctgtttcaagataaatgaactcaatctaaattaaaaaaggagagagattttgagatcactttctctttgcccatttcttcttcttccttttttaactaagcgctgaatccctccctttcttctgcacatctacttgcttgaattgtgggccaaagagaaaaagagggattgatcagagcattttgccaatacagtttcattaacctccttccccgttcccccagagtttgaatttttttt

SEQ ID NO: 2651 - DNA, 369 bp, Homo sapiens
ctccgcaagcggatgaacaccaacccttcccgaggccttaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttctgctgccctcaaggtcgtgcgtctgaagcctacaagaaagtttgcctatctcggggcgcctggctcacgaggttggcttggaagtaccacggcagtcacagccaccctggaggagaagaggaaagagaaagccaagatcccctaccggaggaagaacaactcatgcgcctcggaacaggc

SEQ ID NO: 2652 - DNA, 267 bp, Homo sapiens
gaggcgccatcatgggagtggacatccgccataacaaggaccgaaaggttcggcgcaaggagcccaagagccaggatatctacctgaggctgttggtcaagttatacaggttttctggccagaagaaccaacttcacattcaaccaggttgttttgaagaggttgtttatgagttgcaccaaccggccgccctctgttcctttcccggatgatccggaagatgaagcttctcttggccgggaaaacaagacggccttggttgtgggg

SEQ ID NO: 2653 - DNA, 224 bp, Homo sapiens
agaccgtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagttcccctgtggctggcgattaacctgaaacaaagacagaaatttcgcctactccctcca

SEQ ID NO: 2654 - DNA, 271 bp, Homo sapiens
gattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttcctgggtttctgcctaccccctaatt

SEQ ID NO: 2655 - DNA, 312 bp, Homo sapiens
ggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctgggggggacactagaagcaccgtggcctgggattccatctggagctgtccgcaggcaccagccccagccttccaccacgttcactgcctggcttggaaaggttaagaagccccttaagaagagaatcgaggcca

SEQ ID NO: 2656 - DNA, 200 bp, Homo sapiens
gccgtgtgtacgtcattaacaaggagatctgtgttcgtacagtgtgtgcccacgaggagctcctccgagctgacctctgtcggggacaagttctccaaatgtggcgtgatggccagcagcggcctgtgccaatccgtggcggcctcctgtgccaagagctgtgggagctgctaggggggggctggcatctcgaggctcgg

SEQ ID NO: 2657 - DNA, 190 bp, Homo sapiens
ctcgtgccaaattcggcacgagggccagacctgcccctgacaaactccacagtatggggaccctggagggctaggccaaggccttctttgcacctccacctagaagctgaatagtgacgccctcccccaagcccacccagccgcacacagggcctagaggtaaccaataaagtattagggaaaggtgaat

SEQ ID NO: 2658 - DNA, 280 bp, Homo sapiens
ctgcacatgtcacactgaccacatctgtagacatcttgagttgtagctgcagacggggaccagtggctcccattttcattttagccattttgtcgcctgcacccactcccttcatacaatctagtcagaatagcagttctagaggcacaggtctcagtctaagctatggaaagctcccttatccacgagagttaaaggaggtccttgggttttcgcgagctctttgtaccctaggctcttgggagggcccagctaagacatgcccagttagagacgcaca

SEQ ID NO: 2659 - DNA, 233 bp, Homo sapiens
tggggacagtcttataatcagataattttgatgcttccctgtgcatcacggagtttcacaccgttggtgagtagtatttgttatagtttgtcaatttataacttttcaaattaaggtttcatgtgtacattagtaccacgggtggtatttgggtttgtaaaaccttcaattatttgcaaattaatatttcaggggaggttttaggtaatttttctcagggcccaaaaaaaaaa

SEQ ID NO: 2660 - DNA, 142 bp, Homo sapiens
cggatcataacaaaagggaagcattctgtgcgtggggtttggctctttcagtatgtcattctgttctcatcttctgccacagtctctcagatagctcatgaagacaatcacctgcctcaccttctaggtgttttcctttttt

SEQ ID NO: 2661 - DNA, 257 bp, Homo sapiens
gagcgcccctggctgcccctcggccgccgactggacgcgcgggccttgccagcgagcaccctcatcgggctgtcgcctgacagcatacctcaaaaggccctagctaataagcctgttaggcccagcatttgagagagggtagggtgtttatatataaaagggtgtgtacaacttcccgggggtaaaaatattccagtacctgtttacatagcgtattgtgtgtaggctctgtgctctatcccatataaatgggatat

SEQ ID NO: 2662 - DNA, 250 bp, Homo sapiens
ccactgtggcctggcatcgcatcgtgggtgtgtcaatgccacaaaatcgtgtgtccgtggaaccagtcctagccgcgtgtgacagtctttgcattctggttgtctcgtgggggggaggtggacagtccctccggaatgtgtcttgtctcccatttgggtaaaagggacccacccacaaacaatgtgcatcacttggatttcccacccgtttgtgtgagcgtgtcggatgtgctagagaaaccctgtatcc

SEQ ID NO: 2663 - DNA, 208 bp, Homo sapiens
actagttcgagtttttttttttttaaaggaagaaacaaagtgccctcttcttaaatttgctaagaaacaatatagtgggattaagggacatgagatttgaaggctgaattttgatatcattgattattttatcgggggaaaaaaatctctttaaacccgtttccttatctgtaaaatgggaaggatagtgattttcaggggatttttt

SEQ ID NO: 2664 - DNA, 279 bp, Homo sapiens
ctcgtgccgatctgggacgaagcagctggcaacctcaagaagggccctgctcatccaggggctccaatgacggtggagatccgggcagagggcaatagcaggttcacggtacacttccctgaaggatggctgcacgaaacataccggtaagttgggcaagacttttatcgagtacccgtcacagaagacctcacggcttcccatcattgacatttcacccatggacatagggggggcccagcagggattcgtgtggacatagggccgtctgtttttgtg

SEQ ID NO: 2665 - DNA, 138 bp, Homo sapiens
ggtagatagaaataaatagctatatccatgtactgtagtttttcttcaacatcaatgttcattgtatgtactgatcatgcattgtgaaggtggcctgaattgtcctacaataacaagttttcccatgaaaaccgtttt

SEQ ID NO: 2666 - DNA, 113 bp, Homo sapiens
aaagtgaaagacatttcaaatctgtagcataggctagtgggcaggtccgcacagtcgaagccacacctgtctgtttctgtgcactgtaggcctttaggtgttcaccctttctt

SEQ ID NO: 2667 - DNA, 102 bp, Homo sapiens
ggatcctgctaaggtgcagacataaacgagtatcagccattattctgggaggttataagatatgcacttccaattaccctgcatcacaaccattattggtgg

SEQ ID NO: 2668 - DNA, 590 bp, Homo sapiens
ggatcctgctaaggtgcagacataaacgagtatcagccattattctggaggttataagatatgcaccttccccaattacccctgcaatcacaccattattgtagattggcccttagagtatcttttcaggttttttggcatgtctgacactcatggctctacttggacccaccaaccctgctcctatggctccacccagaagccattcagcctagaggacagctctgaccccccctgtgatttcatacaatcagcagcaagtaactgttacctcaccatccccaccccttctgccagactgcctttgaaaaacctctaacctgtgagcacgagatgattccagaacaaactctgtctcccatgtggcatgaccagccttgggtctcttaaactttttctccactataatgccatggtctttatgcagcaggcaggaagaattcaggtggttataattccgtatgtgctttttgaacatttttctactgggctattgctctcttcataatgatttctttaacttcccctctataaggaactgatttcatctgaaattgaagagacaatcagagaaaaacataggaccactc

SEQ ID NO: 2669 - DNA, 136 bp, Homo sapiens
ctcgtgccgaattcggcacgagtttttttttcctttttaagagacttttatttgagtggttcttacagatgttgcaatatgaagtcattttgtttgataagaaatatccaaggctgtctttgtcaaaccacacttg

SEQ ID NO: 2670 - DNA, 116 bp, Homo sapiens
aagaatcctctctctctacagcaagaatgaacatattgatcagagggacccaccattcaccaaggaggcagccttgcatcagatgagtgtacttcagggaaggaactttgaccccc

SEQ ID NO: 2671 - DNA, 580 bp, Homo sapiens
aagaatcctctctctctacagcaagaatgaacatattgatcagagggacccaccattcaccaaggaaggacagccttgcatccagatgagtgtactcaggaagcaacttgacccccataggcaagtcgaggtggggaccacagagacttttgttcactattatcccagtgttcttggaaaagggctgcccttgatagccatctgttgaatgactgaatgaatacactggtggttgaatgaatcaagggttgaatacttggatcacagcaataataaaaacctatctgttggccagacatggtggctcacgcctgtaatcccagcactttgggaggccaaggcaggcagatcacttgagcccaggaatttgagaccagcctgggcaacatggcaaaaccccatctctactaaaaatagaaaaattagctgggcattgtggcacgcgcctgtaatcccaggtacttgggaggctgagacacgagaatcacttaagcctgggaggcagaggttgcagtgagctgagatcgcaccactgcactccaggctgaatgacagcatgagactgtctcaaaaaaaaaca

SEQ ID NO: 2672 - DNA, 144 bp, Homo sapiens
tagtccattcttgcactgctataaaaaattcctgggctggactcagtggctcacacctgtaatccacactttaggaggtgaggtgggtggatcacctgaggtcaggagttcgagaccagcctggccaatatggtgaaaccccgt

SEQ ID NO: 2673 - DNA, 122 bp, Homo sapiens
tccgcttctcgcccaacagcagcaaccctatcatcgtctcctgtggctgggacaagctggtcaagtatggaacctggctactgcagcctgaagacccacccacaattgggccacacaaggct

SEQ ID NO: 2674 - DNA, 215 bp, Homo sapiens
gcacttttaggcattcccaaagtcctttataaatctaaaacaggaaagtacagctttcccacatacatatataagagctgtccatgcactgcaaaccaatcaacccttggtaagcagtcagacaggttttggatcagtaatgggtaaatacagctactcacttcagttcttcagtgtttgacaaaaatatttaacacatgacatatgtgatacrt

SEQ ID NO: 2675 - DNA, 590 bp, Homo sapiens
gcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctaatttatgcctctgtgtctcagctctgtgttagcctatgtgtttaggggagggttttttcctttagagctcccttttactctcctggtatc

SEQ ID NO: 2676 - DNA, 260 bp, Homo sapiens
ctcgtgccgaattcggcacgagttaaatctgtgcagagcttagcaaatcttgtggaatttggagctaaggagccctacatggaagggttcaatccattcatcagaagcaccagacatcgtatgatcatgtttttagatgaccttgggattgtacctgatcttcggacactacagagcattctagagcggacctgtcccgtgatttagcagcattgcatgagatttgcgtggctcattcagatgaacttcgagcgctcagt

SEQ ID NO: 2677 - DNA, 370 bp, Homo sapiens
gctcgccgtccccgccatgctgtctctagactttttggacgatgtgcggcggatgaacaagcggcagctctatttatcagtcctaaattttggaatgattgtctcatcggcactaatgatctggaaggggttaatggtaataactcggaagtgaaagtgccgattgtagtggtggctcagtggcagcattggaacctgcatttcatagaggagatcttctctttctaacaaatcgagttgaagatcccatacgagtggggagaaattgttgttttttaggatagaaggaagagagattcctatagttcaccgagtcttgaagattcatgaaaagcaaaatgggcatatcaagtttttgaccacaggagat

SEQ ID NO: 2678 - DNA, 138 bp, Homo sapiens
ctcgttgctgctctgtggcacatatcggaagcagtacagcgcgcggctctacacgcttgggtagcgggataagtcactgttttctttatttctttaaaaaaaaaaaggttcttttgcaaccgcctcctttgggattct

SEQ ID NO: 2679 - DNA, 235 bp, Homo sapiens
aggctggctgggtgtcaaggagcaggctccaggccaaggtcctggcccagccacggccattgcaagggctcagcctggcaggctttgtgggggacgccgccctctctgccgcagtggggtgcacggccgggcaccacagttggactcaggcccgggaaggtcatgttctcgaccagagctttgcttccagtccaggcggcttattcggaggcctccttgacttggacacagagat

SEQ ID NO: 2680 - DNA, 115 bp, Homo sapiens
tgaagtgccaagagagctgagaggagcagttgtgactctacccaggaacaaactgtgcctgaacctgaggtgcccaaccccaaataaacccaagatgctgtgtattttcagagga

SEQ ID NO: 2681 - DNA, 245 bp, Homo sapiens
gactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatggggggttgggaagccgagcatgttctagttcaatgttgacttttttttttttaaaggaaagcattaggcataaaatct

SEQ ID NO: 2682 - DNA, 274 bp, Homo sapiens
caacgctccgccgccgctgctgccgcgacccggactgcgcgccagcacccccctggccgaacagctccgtcactattggaggatatgaacgagtacagcgatatagaggaattcgcagagggatccaagatcaacgcgagcgagaatcagcaggatgacggtgaaatgtttattggaggcttgagctgggatacaagcgaaagagatctgacagagtacttgtctcgatttgggggagttgtagactgcacaattaagacagatccactcactc

SEQ ID NO: 2683 - DNA, 332 bp, Homo sapiens
gatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgagataaatttattccacccacata

SEQ ID NO: 2684 - DNA, 149 bp, Homo sapiens
cagcccctgctgctggttctgcccctgctgcagcagaggagaagaaagatgagaagaaggaggagtcttaagagtcagatgatgacatgggatttggcctttttgattaaattcctgcttccctgcaaataaagcctttttacacatca

SEQ ID NO: 2685 - DNA, 296 bp, Homo sapiens
cgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacacacggtagttttgtgtgttggctgctccactgtcctctgccagcctacaggaggaaaagcaagggcttacagaaggatgttccttcaggaggacgcagcactaaaagcactctgagtcaagatgagtggaa

SEQ ID NO: 2686 - DNA, 142 bp, Homo sapiens
caagactgttatcgagtacccgtcacagaagaacctcacggctcccccatcatttgacattgcaccatagacataggagggccgagcaaggaatttcgggtgttggacataaggggcccggtctctctctctttgtaaaaaa

SEQ ID NO: 2687 - DNA, 181 bp, Homo sapiens
caagactgttatcgagtaccggtcacagaagacctcacggctcccatcattgacattgcacccatggacataggaggcccgagcaggaattcggtgtggacatagggccgttctgctcctggtaaaaccttgaacccagaaccaccacattccgttgcaaacccaaaggacccaggtactt

SEQ ID NO: 2688 - DNA, 118 bp, Homo sapiens
ctcatttggtcacagtgtataatccttacatatattgctaaaaattggcttgctagtactttgttaagtatgtttgcattaataatcataagggatattggtttgtagttttcctctt

SEQ ID NO: 2689 - DNA, 172 bp, Homo sapiens
tttcaagtggctattatgtaatataaattcacagcacattgtgaatagagcctacatgacaccatacactttgttgcccactgacatgttaccagaggttgtaccatgatgttgttttgacccctgtgagctgatggccccggccctcttctgtacacatttctgtccgtgt

SEQ ID NO: 2690 - DNA, 230 bp, Homo sapiens
tgttggtggagcctgcatttacaaggtacttcatgcccaagagcaccatttaccgtggagagatgtgcttttttgattctgaggatcctgcaaattcccttcgtggaggagagcctaacttcctgcctgtgactaaggaggctgacattcgtgaggatgacaccattgcaatcattgatgtgccttccccagtttctctgatagtgaccctacagcaattatacatgact

SEQ ID NO: 2691 - DNA, 108 bp, Homo sapiens
ctcgtgccgaattcggcacgagctaaggggggtgtatattatcttctggtgcatgttcttttctggaaaatatggtagctcgccaacacaatctgctcatctgatatt

SEQ ID NO: 2692 - DNA, 255 bp, Homo sapiens
gatccatccatctccagggagcaagacagagacgcaggaatggaaagcggagttcctaacaggatgaaacttcccccatcagttcccccagtacctccaggcaagtagctttccacatttgtcacagaattcagaggagagatggtgttggggagccctttggagaccgccagtctcccaggccccctgcatctatcgagtttgcaatgtcacaccctctctgatctcgtgctcagcatgattctataatagagt

SEQ ID NO: 2693 - DNA, 165 bp, Homo sapiens
attcaagatactgcatatagtccgggtgtggtggctcacgctgtagtccagctattcgggaggctgaggcgggagagttgcttgaacctgggaaggcagaggttgcagtaagccgagatcatgcctctgtactccagcctggtgacagagcgagactccatctca

SEQ ID NO: 2694 - DNA, 160 bp, Homo sapiens
ctgcccatagcccagtgctcaggtcagcactcacagaccagactccaggccacaaccagtaccaggccattcccctgtaaacccaggcttaatacctgtaaggaaccaggccggccccatggacccagatccaggctatctttagggatacagttccctt

SEQ ID NO: 2695 - DNA, 337 bp, Homo sapiens
gctcttcaagcgcatctcggagcagttcactgccatgttccgccggaagcctttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttccttagccgtcttactcactgccctttcctctcctcagatttgtgttgctgcctctatctgttttggtttttctctgggggggtctagacagtcct

SEQ ID NO: 2696 - DNA, 320 bp, Homo sapiens
agggccacaaagtgaccaagaaccgtgagcaagcccaggcacagccgacgccgcgggcgtcttgaaccaaacacaccaagttcgtgcgggacatgattcgggaggtgtgttggctttgccccgtacgagcggcgggccatggagttactgaaggtctccagggacaaacgggccctcaaatttatcaaggaaagggttgggacgaacatccgcgccaagaggaagccggaggagcttagcaacgatctggccgccataaggaaagctgctgccaagaaagacttaagccctccctgcctctcctaaaataaggcaagctk

SEQ ID NO: 2697 - DNA, 349 bp, Homo sapiens
gggatcttggggaacccctcctaggagagctgcagtctcttccctcaggggaacatcccagaatgcatatcgatcagctctcagccaggcttcgacaatcttgcagcccccactaggtggacacattaatgatttggtttctcccctgggcagccaacctgccccagaggcaccagacctgggtctttcagctttgggaccaggctgcccaaaggtactcctatatacaccgggcaccttccacgagagatggtactcccaagcaagcccctatgatgtgccactatagatggaaccctgacttctgcccaatcctttcctcccaacctagacccaggccataaggtcg

SEQ ID NO: 2698 - DNA, 349 bp, Homo sapiens
aagaagcgcgaagagccgtttagtcatgccggtgtggtggcggcggcggagactgcgggcccgtagctgggctctgcgaggtgcaagaaagcctttgaggtgaagtgttatgaaagtcatcataacagatgttttccaaaaacttgtagaaagttgtgaaaaaactactaggatcacgcggcatgtattgagcatataggttgctgtagatgaagtgttcttagctgtcatgtttaaaaatacttctgcttcgatacctcaagtgtggcatgcagcattttgggagggaaaatttgagacgtgttcagaacacatgcacagacgcaattgatgaaaatgagcattttac

SEQ ID NO: 2699 - DNA, 278 bp, Homo sapiens
caccttccccgccagacccagacttgggccgttgctctgacatggacacagccaggacaagctgctcagacctacttccttgggagggggtgacggaaccagcactgttgtggagaccagcttcaaggagcggaaggctggcttgaggccacacagctggggcggggacttctgtctgcctgtgctccatggggggacggctccaccagcctgcgcactgtgttcttctctaagaggctccagagaaacggcacacattcattagagactgagcagag

SEQ ID NO: 2700 - DNA, 234 bp, Homo sapiens
cagaaacaaatatgcgcatctctttctctatttgatcaaatgaaaattttaactagaattgtctgatatttaagagaaacattcaggacctcatcattatgtaggggctttgttctccacagggccaggtaagatgatagccttctgaggctgccacatcagaaatcacgcaggcattcctgggtaggcggcctccagttttcctataagtcgcgaccgctgtacgtttggtca

SEQ ID NO: 2701 - DNA, 311 bp, Homo sapiens
ctcgtgccgaattcggcacgaggaaaattctcggatatgaccgctgtgatgcgggctggttggcggatggcagcgtccgctacccgatctctaggccaagaaggcgctgcagtcctactgaggctgcagttcgcttcgtgggtttccagataaaaagcataagctgtatggtgtctactgcttcagagcatacaactgaatgtgccttaggagcgcatcagttttaaaggtcattaggaccatgttaaagggtgtttttttttcccaatatgacctcaggcaggttcccaactctgtgataccctttctca

SEQ ID NO: 2702 - DNA, 224 bp, Homo sapiens
atttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgacatagacctttatatttttgcatatgtatagatagtaattatatt

SEQ ID NO: 2703 - DNA, 228 bp, Homo sapiens
tgaactatcctgcccgccatcatcctagtcctcatcgccctcccatccctacgcatcctttacataacagacgaggtcaacgatccctcccttaccatcaaatcaatttggccaccaatggtactgaacctacgagtacaccgactacggcggactaattcttcaacttcctacatacttcccccattattcctaggaaccaggcgacctgcgattccttgacggtgr

SEQ ID NO: 2704 - DNA, 218 bp, Homo sapiens
tttttttcaaagaccacaaagatttaatttaaaatcacagtgtctcagctggaatgccccgtccatagcgggcacccctgcaaattaaaagttcctcaagaggccccttccaagccccagcaacaaggggtgagcagggcccaactgggggtcttgccaagctttgcccctccacatgattttggagaggaggcccagatcttaggtctagatgggca

SEQ ID NO: 2705 - DNA, 179 bp, Homo sapiens
cagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcg

SEQ ID NO: 2706 - DNA, 213 bp, Homo sapiens
cctggctgcccctgacagtggggatatgcaaggggctctggccaggccacagtccaaatgggaagacaccagtcagtcacaaaagtcgggagcgccacacaaacctggctataaggcccaggaaccatataggagcctgagacaggttccctgcacattcatcattaaactttacaggatgaggctttacatgagttaattacaaaagggtca

SEQ ID NO: 2707 - DNA, 191 bp, Homo sapiens
tcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagtctgtaatcagggr

SEQ ID NO: 2708 - DNA, 233 bp, Homo sapiens
gcagtggtgctgtcatggcttactgtggccttgaccttctgggttcaagtggatcctcctaacctcagcttcccaagctgctgggggccataggcacataccaccatggcccggctaatttttctgtttcttgtagagacagggtttcaccatgttgcacaggctggtctcaaactcctgagctcaagcaatctgccttccttggcctcccaaagtgctgggattacaggagt

SEQ ID NO: 2709 - DNA, 300 bp, Homo sapiens
cagacgtgaacagcgtgggaaaatatttctcagtaataataaaaaatggtactttgttaaagtttacagcggcttgcagtcatgggtttgtaatctctcttgtccattctaaaagtaggtaggtggctttcaacagactcccttctcccattaatgttttgttctgctgaagaagcttggaattaaaggagctccgtgtgtggctattccgagacagagtttgagccttctgcaggctggacccaggcctgcaggctcttttttcccgagaagtgaagtatgatggagtccagatcttag

SEQ ID NO: 2710 - DNA, 125 bp, Homo sapiens
aaaaccttgaccaatttaaaagagtagacatcatataagtatgctctcaggccataatggcattaaagtaggaatctctaacagaaagatggctagaaagtcccaaaatacttgtatacaaaaca

SEQ ID NO: 2711 - DNA, 400 bp, Homo sapiens
  misc_feature 112, 209, 218: n = A,T,C or G
aaaaccttgaccaatttaaaagaatagacatcatataagtatgctctcaggccataatggcattaaagtaggaatctctaacagaaagatggctagaaaatcccaaaatacntgtatacaaaaaaagctctaagtaacacatgatcaaagaagtgtgaagagaaattaaaaaatatattgaactaaataaaaacattttcatttacaanccatcaaanttcgtgggatgcagcaaaagcagtgctcagaggcaaatttatagcattgagtgcatgtattagaaaagaatccaataaattaagcctccaccttgtagactaaaaaaaaggacaaattaaatccaaactaagcagaagaaaagaaatagtaaaaatcagatcagaaatagtgaaattaaaaa

SEQ ID NO: 2712 - DNA, 182 bp, Homo sapiens
cggcacgaggataaacctaatattcaatgaacttccatttgtattcaaatttgtgtcataccagaaagctctacatttgcagatgttcaaatattgtaaaactttggtgcattgttatttaatagctgtgatcagtgatttcaaacctcaaatatagtatattaacaaattaaaaaacaaaa

SEQ ID NO: 2713 - DNA, 234 bp, Homo sapiens
aagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcggttcttattctggcatttt

SEQ ID NO: 2714 - DNA, 281 bp, Homo sapiens
aacaagatttgctgcatttccggcaatgccctgtgcatgccatggtccctagacacctcagttcattgtggtccttgcggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagttttgtgatatatgagactttatgtggagtgaaaattgggcatgccattacaat

SEQ ID NO: 2715 - DNA, 159 bp, Homo sapiens
ctcggccatagaagacacgtgccatgcgccgccggctcaacaagcacgaggagaacctgaagaccaagaagcagcagcggaaggagcggctttacccgctgcggaagtacgcggtcaaggcctgaggggcgcattgtcaataaagcacagctggctgag

SEQ ID NO: 2716 - DNA, 304 bp, Homo sapiens
gaaaggtgtccacagccacaaaaagaagaagatccgcacgtcacccaccttccggcggccgaagacactgcgactccgggagacagcccaaatatcctcggaggagcgctcccaggagaaacaagcttgaccactatgctatcatcaggtttccgctgaccactgagtctgccatgaagaagatagaagacacaacacacttgtgttcattgtggatgttaaagccaacaggcaccagattaacaggctgtgagagctgtatgtcattgtgtggccaaggtcacacctgattcggcctgtggag

SEQ ID NO: 2717 - DNA, 279 bp, Homo sapiens
tattagtccgttttcacactgctgataaagacatacctaagactgggaaaaagaggtttagttagacctacagttccacatggctggggaggcctcagaatcatggcaggagttgaaagacacttcttacatggtggtggcaagagaaaatgaggaagaagcaaaagtggaaatcctgataaacccattgatctcataagacttaattactatcacaggaatagcacgggaaagactggcccccatgattcaaatatctccccctgggtccctcccaca

SEQ ID NO: 2718 - DNA, 300 bp, Homo sapiens
atctaaaaatgtggaagtgaatttggaactgggtaacaggcagaggttgaacagtttgcagggttcggaagaagacagaaaaatgtgaggaagtttggaacttcctagagacttgcagaatggttttgaggaaaatgctgatagtgacatggacaatggagtccaggctgaggtggtctcatatggagatgaagactcgttgggaactggagtaaaggtgactcttgctatgcaaagagactgacggcattttgccctcccttagaaatctgtggactttaaacttgagagacatagttt

SEQ ID NO: 2719 - DNA, 294 bp, Homo sapiens
gctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctccaggaatt

SEQ ID NO: 2720 - DNA, 303 bp, Homo sapiens
cacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggctccaggccctgaggcccacttgctgccttcaacct

SEQ ID NO: 2721 - DNA, 286 bp, Homo sapiens
tgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaaggagaaggacgagctggagcgtgtggccaagtccaaccg

SEQ ID NO: 2722 - DNA, 256 bp, Homo sapiens
catccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtcaaaaagttggaggtcctggtgcccgcgctcgctaccagaaatcctaccgataagcccatagtgactcaaa

SEQ ID NO: 2723 - DNA, 217 bp, Homo sapiens
ctcaggaggctgaggcatgagaatcacttgaacctgggagacagagattgcagtgagccaagattgcaccattgcactccagtctgggcaacagagtgagactctctccaaaaagaaagaagaaaaaaaaaagtatccaggcttggtggcatgcgcctgtggtctcagccctcctgagtagctggacctacagtcatgtccatcactgttgcctaac

SEQ ID NO: 2724 - DNA, 231 bp, Homo sapiens
ggaggttcaaaaggtgtgcaacatgtatgtctgcaaagccacaaaaggtagtgacaaatgagtacctgacacacagaaatcaggacagtatataataagtgttaattgtacagaaggaagtttgagaaactggaaggtagaggtcactgtggtcaaactcttcaggacccattatgggggtggtattacaattcctttggtcacaaattatataattctaaccttttagag

SEQ ID NO: 2725 - DNA, 470 bp, Homo sapiens
ggaggttcaaaaggtgtgcaacatgtatgtctgcaaagccacaaaaggtagtgacaaatgagtacctgacacacagaaaatcaggacagtatataataaagtgttaattgtacagaaaggaagtttgagaaactggaaaggtagaagtcactgtggtcaaactcttcaagaaccattatgggggttgtattacaattcctttggtcacaaattatataaatctaaaccatatagaagggggatttattggcttacatggctaaagtgtgggagaagtgaggtagttctcagggaagccagaacggggaactccacaccacctacactttctgtcttatatctctgtgcctctttttttgtgtcagttttctccacattttggggtgtggctgcagcaagccagagatcacccagaaagaatgtctgaccttcttcccttcatttaaaattttcaaaatccccggaatggg

SEQ ID NO: 2726 - DNA, 301 bp, Homo sapiens
cctggacatcagcatctgaaaagttctgaggagtcttcagtgacctcattttatcgaattgtttaatgtgctttccacttgttgttcgagcagttagtgttttgtattgaaattcgtgcctgttcacatcctacactgcttgtgtttgggtggaaaccacttggggagatgctgcttgatatacagatcctggctccatctgtgcatttgaattcataggcatctggagacagtggcatagaggcagtgggcgcaggaaagttcaactcagagtttacacgagaaaagtgaaacccacttg

SEQ ID NO: 2727 - DNA, 241 bp, Homo sapiens
aaaacatttgtgagaagattcaaaagaggcaatctgggtcttcgtggggaaggactaggacccagaatcagaggagcagctgattagttacctgattaaatgtaagtaataatcattcttggcctcaggtacctgatccgttaaaaaaaactttttttctacattacttcagaggtgctttaaatataggattttttaaaaggtaggcaaaaacttaaaggttatgagtatgatgaaaata

SEQ ID NO: 2728 - DNA, 226 bp, Homo sapiens
tccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaggatgcaaatttaggctttgattggcactttttgaaaattatgcacca

SEQ ID NO: 2729 - DNA, 298 bp, Homo sapiens
gttagtagcatgttgagccaggcctgggtctgtgtctcttttctctttctccttagtcttctcatagcattaactaatctattgggttcattattggaattaacctggtgctggatattttcaaattgtatctagtgcagctgattttacaataactactgtgttcctggcaatagtgtgtcctgattagagatgaccatattatactagaaaagatacgacttaattttcctggtagatagagaattaatagctataccatgtcctgtagtttctctcaacatcaatgtccattgta

SEQ ID NO: 2730 - DNA, 274 bp, Homo sapiens
ctcgtgccgaattcggcacgagagcaagagaagaagcagagactgttggcccgggccgagaagaaggctgctggcaaaggggacgtcccaacgaagagaccacctgtccttcgagcaggagttaacaccgtcaccaccttggtggagaccaagaaagctcagctggtggtgattgcacacgacgtggatccatcgagctggttgtcttctggcctgccttgtgtcgtaaaatgggggttcccttactgcattatcaagggaaagccaagattgg

SEQ ID NO: 2731 - DNA, 278 bp, Homo sapiens
aggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgttaagccgcaagctcgatcgacttgcctacattgcccaccccaggtttgggaggcgtgctcgtgccctatttggccaaggggctcaggctgtccggccaaaggcaagggccaaggccaagggccaggccaagg

SEQ ID NO: 2732 - DNA, 300 bp, Homo sapiens
caagcccatgtgtgttgagagcttctcagactatccacctttgggtcgctttgctgttcgtgatatgagacagacagttgcggtgggtgtcatcaaagcagtggacaagaaggctgctggagctggcaaggtcaccaggtctgcccagaaagctcagaaggctaaatgaatattatccctaatacctgccaccccactcttaatcagtggtggaagacggtctcagacctgtttgtttcaattggccatttagtttagtagtaaaagactggtaatgataacattgcatcgtaaaacctt

SEQ ID NO: 2733 - DNA, 244 bp, Homo sapiens
ctcgtgccgaattcggcacgaggtgaggaaacaaagagtcgcttcacggagtattcgatgacttcctcagtcatgaggagaaatgaacagctgaccctacatgatgagaggtttgagaagtttatgagcaatatgatgatgatgaaattggagctctggataatgcagaattggaaggttctattcaagtggacagcattcgcttacaggaagttttgattgactactataaagagagggcaga

SEQ ID NO: 2734 - DNA, 204 bp, Homo sapiens
gttttggtgttagagttgcactaaactcagaacaccagttggaacatgttccttctatctctaatctcacggtgtataaaaaaatatttttttcctgaagtatttggaggaattcatcaggaaagcattctgaggctgcagtaacatttgtttttttgtgtgtgtggaaagattttcaatacagattcattctcattaatagat

SEQ ID NO: 2735 - DNA, 103 bp, Homo sapiens
ggggaggccagccacctccttcctctgggactgtccagcctagtgtcgggggctttcagggtttcgtggggtttgcccggaaggcggctatcctccccctagg

SEQ ID NO: 2736 - DNA, 102 bp, Homo sapiens
ggccttgaggggcgcatctgacaccgagatctcatggtttgcgggtagggtaggggtccagagaggtgagttctcaggagctcttgccacctggaggcgtca

SEQ ID NO: 2737 - DNA, 610 bp, Homo sapiens
cggcacgaggggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccaacccagccagccaataagaggacacaaatgaggacacgtggcttttatacaaagtatctatatgagattcttctatattgtacagagtggggcaaaacacgcccccatctgctgccttttctaattgccctgcaacgtcccatctatacgaggtgttggagaaggtgaagaaccctcccaatcacgcccgcctaacaacaacaaacgtgcttttttcctccttgaaaaaaaaaaaaaaaa

SEQ ID NO: 2738 - DNA, 102 bp, Homo sapiens
cgaaaccagacgagctacctaagaacagctatagagcacacccgtctatgtagcaaaatagtgggaagattgttaggtagaggcgacaaaccttcccagcct

SEQ ID NO: 2739 - DNA, 154 bp, Homo sapiens
caaagacctggctttaagatgtttctgtggtttggcaatccgtggaggatagcttagggaaatagcctcagagcctgttgcaggagcactacttctacacggctgacttcaaggaccatcaaccagataggcaagaagttccaggagaagatct

SEQ ID NO: 2740 - DNA, 265 bp, Homo sapiens
aaaatgcacttcaggatcttgtcaatgaattgtttattaggttggtctttatcatcagtctggttatatctgtaaggttaggaaaatagcatagtgtcggttgtgaattattttcagagtgcttagcctttccagtagatgaagagtaacaacttttactaaattattgagatgtggattagggaattacatctggattggagttctatatctgtttcttgccaggtatgtgacctgggcaaattacttaatctttctaagccta

SEQ ID NO: 2741 - DNA, 450 bp, Homo sapiens
aaaaatggcacttccaggatcttggtcaaatgaattgtttattaggttggtctttatcatcagtctggttatatctgtaaggttaggaaaatagcatagtgtcggttgtgaattattttcagagtgcttagcctttccagtagatgaagagtaacagcttttactaaattattgagatgtggattagggaattacatctggattggagttctatatctgtttcttgccaggtatgtgaccttgggcaaattacttaatctttctaagcctcagtttttacatttgtaacataatataattgtacccattataaggttctgatgaggagtaaatgaaccaacatatataagttcttggtacagtgcttagcttatggtaaaggccagtaaaagttagttgctcctatcagcatcatctttaatataattagattatttcccctcttctctt

SEQ ID NO: 2742 - DNA, 270 bp, Homo sapiens
ccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgccgcagcccgaaggagcgggccggaaggagcttgccaggaagcacctgcttagcacgagcactttcagctgggttccgct

SEQ ID NO: 2743 - DNA, 270 bp, Homo sapiens
gtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttcagatggacagtacatctataaagggaaagtgatggcatctatatcataaatctcaaggggacctgggaggagcttcttctggcagctcgtgcaattgttgccattgaaaaccctcctgat

SEQ ID NO: 2744 - DNA, 290 bp, Homo sapiens
gtccttccgaggaagctaaggctgcgttggggtgaggccctcacttcatccggcgactagcaccgcgtccggcagcgcagccctacactcgcccgcgccatggcctctgtctccgagctcgcctgcatctactcggccctcattctgcacggcgataaggtgacagtcacggggggtaaggtcaattgccctcattaaagcagccggtgtaaatgttgagcctttttggcctggcttgtttgcaaggccctggcaacgataaattggggcctatcttcattgtggggccg

SEQ ID NO: 2745 - DNA, 275 bp, Homo sapiens
gctttgaacagggcccaggtggcagcattccctttcttgctggaaggctggggggtgaaagacggggccactgcagcccttttggagaccacacagctgttttcttggtaccaagtactttaagagacagcagcccatcccctcagcccacacccttgcgccctgtggacccgacaccacaaaggccaatgtttggagatttgcacaacctcccgttccccacatggagaggggagtaagttgaggcagccgtgggatggtggtaggctcctctt

SEQ ID NO: 2746 - DNA, 260 bp, Homo sapiens
tactgctgttgctgttctctgtacttggcccagggctggaggcttttcctgactgattactccacctgctcaccccgcaagctgagtcctttccgctcctttgccagcaccgagctcttccacttccatgttcctgaggacacattcctggctgtttggaacctcatcatcttcaaggagcaagggggcacttttgggcacactccccacacaaagtgtgactgctgtatctccggtccgggcacccctgtcatcaatcc

SEQ ID NO: 2747 - DNA, 305 bp, Homo sapiens
caagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagccatggttctgacaatattctagggtccttagatgagcacacttcctgtatctgcattatttttatagcattagtggggttgatcccaggctcacctttctcacaaatacatc

SEQ ID NO: 2748 - DNA, 192 bp, Homo sapiens
cttgattcccataacataaaagtgctacttgagagtgagggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgg

SEQ ID NO: 2749 - DNA, 317 bp, Homo sapiens
tgcttacctgctaaccagtttacccctggagtggtcctgtttgaccctcaccaggtgccctgagattgccctccaggataagccttgttttgcatggaccgaggggtgcaaggaattcctgtctcatatttgtggagggagtcatatgcacaggctagcaggatttctcctgttgcaccatcctctgcctactcaaccttctcagcagaaccctttgatcctggcgcttccctccaaacaatagcatcttcagggcttaacacaaaagaacagtggaccataaggacaggcctggctccaggccttccttcctcata

SEQ ID NO: 2750 - DNA, 280 bp, Homo sapiens
agaaagcatttggtttagacgtgttgggtgtgaggtgccatggaatagcagggtggagctggtgggggaagctggggggctgccctggggctctagcacatggaggccaaggagggagtcgtggggtggagggggcacagggctcccaaaggtcctgggtctgcctcagggccgctgctactccacacccttcctccatgcctgagcacccatggcagtaccagcagtgaccatcatacccaatggggatggagagaactgaggctggcctgagatgtcc

SEQ ID NO: 2751 - DNA, 527 bp, Homo sapiens
agaaagcatttggtttagacgtgttgggtgtgaggtgcccatggaatagcagggtggagctggtgggggaagctggggggctgccctggggctctagcacatggaggccaaggagggagtcgtggggtggagggggcacagggctccccaaggtcctgggtctgcctcagggccgctgctactccacacccctcctcccatgcctgagcacccatggcagtgaccagcagtgaccatcatcacccaatgaggatggagagaaactgaggctggcctgagatgtcctgaggaatgagctggcaccggagtcccacaggtgaagggtgagcatggatgggccgggagcatgctccctgtaattgtgcatggcgcagaaggtcaagaacggcctggtggccccgtgggagactggttactccaatctggtccagcagaaccccaggcagcctcgttggaacgttgggggaagtgtctaatgcttagcgatgtggcagatgccccggagtgccgttgagcctttataacag

SEQ ID NO: 2752 - DNA, 311 bp, Homo sapiens
ggaaatcagtttactcatcacagatgtattatatcctagaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgttccatgaaggaagctgcctgctcctaaggtgtgctactggagtaaagcactccggatcttgcaactgtgagtccgatttttacctcgctgccatttaaggctttccag

SEQ ID NO: 2753 - DNA, 214 bp, Homo sapiens
tctaagagccgtgttcttcatggaattttccaggccacttggcagcttgggtttaccgatgggatggggctagagatcttgtcggttcttgggaggtcacaagggaagattgaagagaacgcttgagcatccttgggcaacagcccaggtgggacctggatgaagctttgcactcaagtattgtcaagggaagcttcctgtgaaccaaagttct

SEQ ID NO: 2754 - DNA, 107 bp, Homo sapiens
agcaccattggcgggttggcaagaacaagcgccgtacgaaaggcggcaaaaaggggagccaagaaggaaaggggggtgagtccagtgttctgaagaaagaattggga

SEQ ID NO: 2755 - DNA, 205 bp, Homo sapiens
catcagacaagagatcattaaaatgtttgatgagagaatggcttactacacctccaggatgcagttccccatggagatggcggcagtcccgggacgaccagggcctccagggaaggatggtgctccgggcaggcaggtgctccagggtaactgggctcctggtaagattgcagagaaggacggcagggcttcaggagtaagagat

SEQ ID NO: 2756 - DNA, 218 bp, Homo sapiens
gtcacccgtaagattggcaatgcagtggaaccacgctgcttgaggctctggactgcatcctaccaccaactcgtccaactgacaagaccttgcgcctgcctcttcaggatgtctacaaaattggtggtattggtactgttactgttggacgagtggagactggtgttctcaaacccggtatggtgggcttcaatgtcaagaatgtgtctgtcaaggat

SEQ ID NO: 2757 - DNA, 259 bp, Homo sapiens
tgagtctccctgcagcccaagtggaagctttgctcctaacaagcacaagctgccaattgttaccttcttctgagagccttgctaaaaaagtaactctgggaaaactcttatagggttcctgaccatgaatccatcttttttattcccccaaaagttattcaactattagatcaatggataataactatgaggttttgggtgactatttagatggaggaaagtgtattaaggttggaaactaaatactatacttaatact

SEQ ID NO: 2758 - DNA, 105 bp, Homo sapiens
cggcacgagaaaaaaattgcataatcttgagcctaactaagaaaagcataaagaatattttgttttctgtgttcttcaagggcatctgggacaacaggattgtga

SEQ ID NO: 2759 - DNA, 530 bp, Homo sapiens
aaaaaatgcatatctgagcctactagaaaagcataagaatattttgttttctgtgttcttcaaggcatctggacaacaggattgtgatagttctatgtgcttttaagtaaacctccctaattcttgaggaggagaaaaaggtgaaattccttggagcatatagggtacaaacattgggaatttttgccaataattgttcttctgagacaaacacagacaaaatggtgaatataaaaacactgaaagtgctttctttaaacagaagactgagacaagaagatagataccaccactatttattaatggactagaaaaattgattaatgcaatttgaaaaggaaaatagatgaaggataggtaaagataattagtaaaactatcacattttgagggtgatataataatatcactttaaaactcgagagtacttctagagcggccgcgggcccatcgattttccacccgggtggggtaccaggtaagtgtaccaattcgccctatagtgagtcgtattacaattcactgggggc

SEQ ID NO: 2760 - DNA, 359 bp, Homo sapiens
cagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtagtatggagatgcacaacagattggccagtatatgcctaatggttggcagttcctgcatatggatgtatggccaggcatggacccagcgaggatttatcagacacagtcttctgcaccatggatgggcccaattatggagtgcaccgcctcaagggcaaaatggcagcatgttgcccaatcagcctctgggtatcgggtggcaggtatg

SEQ ID NO: 2761 - DNA, 368 bp, Homo sapiens
gagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgacatgagtgagattagaagcagccaaacctttctgtaacagagacggtcatgcagagagcagacagcagggctttcagctagtaggagctgagctttccagccgtg

SEQ ID NO: 2762 - DNA, 202 bp, Homo sapiens
ctaatgctgttttgagattctgagattaatgagaatacttatttcagagatgcatttaatgcttttcttcttgtgacagtgacgcagatcagcttgagttccatatgtccctgagttatttttatcatagaggccacagatgtattataacacggcaaattgtaatatatataattcctgaactcatgaccatgtctcggtt

SEQ ID NO: 2763 - DNA, 229 bp, Homo sapiens
gccggctacactgcgctgcactatgccagccgcaatgggcactacgctgtgtgccagttcctgctggaaagcggacgaaagtgtgatgcccagacccacgggggtgccactgctctgcaccgagccagctactgcgggcacactgaaatcgcgcggctcctgctatcacatggggtccaccccagggtggtggatgacgacggcatgaccagtctgcataaggctgctg

SEQ ID NO: 2764 - DNA, 121 bp, Homo sapiens
ccctgccctgacccagacctggcgggctccactcatgaggcatttcttcacatccgtgtcccgcccggccgctggggagccccgtttcatcgccgtggctacgtggacgacacgcagttcg

SEQ ID NO: 2765 - DNA, 113 bp, Homo sapiens
cctatcatatagttaaaccccagcccatgacccctaacaagggccctctcaagccctcctaattgaccctccggccctagccatagtgatttccacttcccactccataaacg

SEQ ID NO: 2766 - DNA, 120 bp, Homo sapiens
gcaacggggtcaaaatgacccacacgctgcagttacaagaagggcagagggcagtcatggggcccaggaccatgccactggccctgctcccccagccgaagcttgaaacctacaggtgct

SEQ ID NO: 2767 - DNA, 272 bp, Homo sapiens
gaccaagaagaaggaagggggtgccctccggcccagagagcctcatccaatgtcttctccaactttgagcagactcagatccaggagttcaaggaggcattcacactcatggatcagaacccgagatggcttcattgacaaggaggacctcaaggacacctatgcctccctgggcaagaccaacgtcaaggacgacgagctggacgccattctcaaagaggcctctgggcccatcaacttcaccatgtttctgacctgtttggggagaagct

SEQ ID NO: 2768 - DNA, 260 bp, Homo sapiens
cggacatctctggggaaaggaaggtggcacagaccatgttccctggttcctccctgccccttgccaggcttccttattccttactatgggaagaggtcatatcccttccctgcccctcgctgtctttagcaagcaggtttcacttcttcattagaggaggacaagtcaaaagtgaatcatttttcactacttaagggataaatcccagagctttccagagacttgcttcttcagcccctgggaatttcttttggatttac

SEQ ID NO: 2769 - DNA, 302 bp, Homo sapiens
ctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttctttttttacatatttgtatgcagtagagagcctgttgtagaaaacgctccctgtatcttgctgtactgttaaagaaagctgaattccacattgccaacaaaagcgtgaaaatgttcatgaccttcttcaggaaagccattcaggctga

SEQ ID NO: 2770 - DNA, 206 bp, Homo sapiens
aaaaaaaaaaggaaaaccaaacacctcccttgaacaaatttatactcctgttcccaggatcttgagctttagtgtgctatacctatgtgtcttatcgtgggccactgtgccaataaacaaaaacacctgtttggtttacctcagttgcagtagttatttctatttagaggttgttctcagattattgcttcagctactattagagg

SEQ ID NO: 2771 - DNA, 212 bp, Homo sapiens
cggcacgagcagcaacccagggttgtcctgaaacagacttttatacttgaacatggagactgcacatggactttaggggttgtgctgtgggataaacggagctacagtgagaacatagccagtcccaaagacaatttcaaagagaaatgacagtaaagattagctgggagtagtctttgacagtgcttattttgatactgtctctcagcagt

SEQ ID NO: 2772 - DNA, 406 bp, Homo sapiens
ctcgtgccaatttcggcagaggggcattaaggggcccctggtgctcttggtttgaggggacctaaaggtgacttgggagaaaagggggagcgtggccctccaggaagaggtcccaacggtttgcctggagctataggtctcccaggtgacccaggccctccagctatggcagaaatggccgagacggtgagcgaggcccccaggggtggcaggaattctggagtgcctgaccccgggacctcctggcttccggtttctgtagcagcctcctgcaccatgcaggctggtagcgagcatttaacaaagggccttaccttgaaaggcttactgctgcatggctgtctcataaccacggctggtgaggagcctggttagaacacatccaagctgggcaaagatgattacc

SEQ ID NO: 2773 - DNA, 278 bp, Homo sapiens
ccgtgctttatcagagctgtttttaatgatgttattctagaatgttttctttccagatgatgattcagaagctaattttaaaaaacggtgccaggtaccacaacagtaacagaactttgcaattttctgggggtttgttttttacctttttcccccttttttttaaatggggtgtgctggatgtctctataattttatacagatgactgcagaaccctggaaaggctgttgctgctattgatgcataacatactgctattgggcttgttatataaata

SEQ ID NO: 2774 - DNA, 349 bp, Homo sapiens
aggcaagccagtcttctgtcttcctttgctaacttagggttttgagcaggttggggtatggtgcctgtcatacccacctgccaccctgggaacctcactgttctctctttcagcctagacctgctgatccagggtgtgtgttagttgagggtgggtggaggggtttgcagtgtgggaatgtggcccttcagttgaccttagctgcttcacatggttgtccattctggggcttaaagaactgggaccagaccaagtagaggccttggtgcttgttggggttgggcctccagagtcttagttactgatttcattttcaataaatgtagggttgttacatgagtttcccata

SEQ ID NO: 2775 - DNA, 140 bp, Homo sapiens
cctgccgcctcggtccaccttgcggcccgtgtttgactcaactcagctcctttaacgctaatatttccggcaaaatcccatgcttgggttttgtctttaaccttgtaacgcttgcaatcccaataaagcattaaaagtca

SEQ ID NO: 2776 - DNA, 268 bp, Homo sapiens
cggcacgaggtaattagttgttatgatgaggtcattagggtgggccctaatccagtatgactggggtccatataaaaatgggaaacttgtgcacagacacacacacaggaagaatgtcatgcgaggatgaaggcaatgattggggtgaggcttctacaccccaaggcatgccagtgatcaccagcaaatgtccagaggccaaaggagaggccttggaacatccctcagaaggacccaaccctgcaaacaccttgatcttgggaattcc

SEQ ID NO: 2777 - DNA, 130 bp, Homo sapiens
gtttttttttttagttgaatttaactttctttaaggggaaagaaattttacttacccaccaatttatttcagacccttttcaatttgcttaggagaaagagataggctttgtattaagagaaccctaccg

SEQ ID NO: 2778 - DNA, 460 bp, Homo sapiens
  misc_feature 350: n = A,T,C or G
tttttttttttgagtggaatttaacttgctttaagtggaaagtaattttactcacccatcaattcattgcagaccctgtgcaattagctgaggagaaagagtaaggcttagtatcaagagaacctcaccgttttggattcaaaagttgaggattccattaatattttcacacgtgtaaaacattttttaaacaatcgttgaatatgcttatgtgtttttttcacatgtgtaatttttgttttgttttgttttttgtttttaggtggagttttgctcttgttgcctaggctggagtgcaatggtgtgatctcggccacgagagtgaaactctgtctcgggggaaaaaaaancaattaaaaacggtgtgggcacattggcgcgtgcccgcggtcccaggctctgtactctggaggctgaggtggaaggatcgctcgagagtacttctagagcggccgcgggc

SEQ ID NO: 2779 - DNA, 164 bp, Homo sapiens
ggaaaactgaggtaaataaaggagagccattaattaagtggcactttcttgggaaagtgtacatctgaggaaaaagtacgttatgcaatttttgtatgaaatttttcatgagccaccccacccggcctcccactcttaactattttaatgtggtccccccctct

SEQ ID NO: 2780 - DNA, 620 bp, Homo sapiens
ggaaaactgaggtaaataaaggagagccattaattaagtggcactttcttggaaagtgtacatctgaggaaaaagtacgttatgcattttttgtatgaaatttttcatgagccaccccacccggcctcccactcttaactattttaatgtggtccccccctctgagccctacatgattttgtggactactttagtgttatccttcagttatcatattttaagattaattatcctattatttgctttcctctatatgtgccactcatgcttgaaagttactttaggccgggtgcagcagctcatgcctataatcccagcactttgggaggtagaggcgggcaggtcacttggggtcaagagtttgagaccagcctggccggcatggcgaagccccgtctctactaaaaatacaaaaaattagcgagcgcaaattgctgtaaatgggtagtaatagcacctaagcatagcataaggctttgaattagtaggtacttgggaggctgaggcaggagaatcgcttgaacctgggaggcggagattgcagtgtgctgataccgcaacactgtactccagcctaagtgacggagcaagactccatctcaaaaaaaaaaaaaaaaaaa

SEQ ID NO: 2781 - DNA, 194 bp, Homo sapiens
atttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctctccccaggctctctgatagtgaccc

SEQ ID NO: 2782 - DNA, 254 bp, Homo sapiens
gaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccggaaactgtggcgtgatgcccgcggggctctccagaaccatcatccctgcctctactggcgctgcaaggctgtgggcaaggtcatccctca

SEQ ID NO: 2783 - DNA, 225 bp, Homo sapiens
ggaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggagaaactgtcactactatagaaattgatgaggaacatatgaggagat

SEQ ID NO: 2784 - DNA, 184 bp, Homo sapiens
ctcgtccgaattcggcagaggttttttttttttctatagacttttttcagataacatcttctgagtcataaccagcctggcagtatgatggcctagatgcagagaaaacagctccttggtgaattgataagtaaaggcagaaaagattatatgtcatacccccattggggaataagcataaccc

SEQ ID NO: 2785 - DNA, 147 bp, Homo sapiens
cggaggtgcaggtcctggtgcttgatggtcgaggccatctcctgggccgcctggcgcaatcgtggctaaacaggtactcctgggccggaaggtggtggtcgtacgctgttaaggcatcaacatttctggcaatttctacagaaacaa

SEQ ID NO: 2786 - DNA, 103 bp, Homo sapiens
gaagatgccgacattcagactgagcgtgctaccaaaaggaagcggacaattttaaaacaggaggaggtcctcttggagaaacttgcaagagaggttccgcggt

SEQ ID NO: 2787 - DNA, 111 bp, Homo sapiens
gcaggccatctcatggccatcacatccactggtgggctaggagcttaggatttcttgctgaaggtaagggacccagctaaacattggacccatctcacctgactcggggga

SEQ ID NO: 2788 - DNA, 520 bp, Homo sapiens
cagccatctcatgccatcacatccactgtggctagagcttagattctgctgaagtaaggaccagctaacattgaccatctcacctgactcgggagagaagaatctgttggaatttgatcacaagtgtgtgctgtcagatcgtcctagttcgggacacttttgtgtaaccagattttaaaaaccattttacattattcatgcccttgatctttcaagctgtggaacatcaatttcctcctcttcactttcaccactgttcacaaaagtaggtaaacggtggccccttttcccctcccagtttctttgattctgtggacttgtgctgatagccactagagggtgtaccaggggtctctggagtctgggtctcttacagatggatttgaaaagtcaaaagtcaatcattgcagagccctcagaggtgaagagccagactgcagtgcagatgcaggaacagaattttagagctggaattaatcaaggagaattaccacaagttgaaaaaaaaaaaaaaaaaaaa

SEQ ID NO: 2789 - DNA, 129 bp, Homo sapiens
cgtgagtgagtgcttgttaagtgctttgcagggtgcacccagttagcacttagacagtggtgctggtactattgttgttgtcattatgatttaagggcccttcagcactaaagaggtttagatttctgg

SEQ ID NO: 2790 - DNA, 430 bp, Homo sapiens
gttgggtgatttcgtgagtgagtgcttgttaagtgctttgcacaggtgcacccagtgagcactcagacagtggtgctggtactattgttgttgtcattatgattgaaggtcccttcagcactaaagagtttagatttctggactctaggtgggttgtatatttgacttggcactgtgtgctgggaatacagtaatgaacagcatcattacctgaggccttatgcagaagtgatagttacaatacaaagtgacagtgactgcgattggaatactgtggaattacacagacatatctcagtcatggagggtcagagtaggctccagagtaagagcccacggtatgagtaggcattgacaaatagaagggaaaagtaacccagagaacattccaaacaacaagaagagcatttgtaagcatggggcactgtaa

SEQ ID NO: 2791 - DNA, 194 bp, Homo sapiens
ggccacaaggggcgtccacccaggacaccgtctgggtcccactcaaggcccagtcccctcccagggccctggtctgagccccacacggccatctgcccagtccttgactcgtccatggagctgagggtcggaggaaccttccttgggggcagcagccttcccgggggcctacccagtgccccacagcagaaccc

SEQ ID NO: 2792 - DNA, 291 bp, Homo sapiens
aaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcta

SEQ ID NO: 2793 - DNA, 110 bp, Homo sapiens
tctcagaccacaccgtcggtttccttttcaacaatggtgctcacatgagcctccttccagacaaaaagtaagtgtatcaattaatgaattcctgtcagttctttagtctt

SEQ ID NO: 2794 - DNA, 205 bp, Homo sapiens
aattacaacaatcagtcttcaaattttggacccactgaagggaggaaattttggaggcagaagctcttgcccctatggcggtggaggccaatacttttcaaaaccacgaaaccaaggtggctatggcggttccagcagcagcagtagctatggcagtggcagaggattttatttaggaaacacagcttagcaggagaggagacca

SEQ ID NO: 2795 - DNA, 130 bp, Homo sapiens
ggtctacgccgagtgacagagacgctcaggctgtgttctcaggatgaccgagtgggagacagcagcaccagcgtggcagagaccccagacatcaagtctttgggaagtggagcaccgatgatgtgcagat

SEQ ID NO: 2796 - DNA, 101 bp, Homo sapiens
ttataaagcacacaaaaattcctcttgtgttctaacccctgggggttagctctagggttggtgtgtacaaggcatgtggatgatgatatgatgctgtggtg

SEQ ID NO: 2797 - DNA, 640 bp, Homo sapiens
tttataaagcacacaaaaattcctcttgtgttctaacccctggagattagctctaggattggtgtgtacagagcatgtagatatatatgtctgtgtgtaatttcatccggccatcactgaagctctgagggctgcttcttttagtttcaccttttcactccctctacctttctctcctggccattgtgtaaggatgcagatttggtgacctgataactgctctaactgattggtttattttttgcttcgtttcctgcttttcaacattctctactgatttgcttattttgcagcaagtacactctttttggagtttaccttttcaaaacaacattgtgctgaaaataaaaccactagagattatttgggtattgtaggatttttccccctccaaatgtacaagtaaatacagtataagaggcatgactcagtattttaagatatagaatgcaattttaaaaaattgtttgccattttatatatagatattagaggtgtaaaatgtgttcctacttttagcatttaagggggttcccttcctgttaaaaaaaggtaaaatttggctacgtaaccttttgggataacaagtttggggcaataatgaacccaaaaggtccattacaaaaaaaaaaaaaaaaaa

SEQ ID NO: 2798 - DNA, 140 bp, Homo sapiens
ggaacttaattcttttataatattgaaatgtccctcctttttaaggctaattttctacttttatactctatttatttccattttgacatctcacagacatttttttagcagtctttcttctaccacactttcttgttaga

SEQ ID NO: 2799 - DNA, 101 bp, Homo sapiens
cggcacgagcagaaaaataagttcaaggcagccttcgacatcttcggtgcttgggcgctgaggatggctgcatcagaaccaaggagctgggcaaggtaaat

SEQ ID NO: 2800 - DNA, 121 bp, Homo sapiens
gttgatatggttcctgggcaagcccatggtggtggttggaggaggcttctcaggactatccacctttggggtcggctttgctggttcggggatatggaggcagacaggttgcgggtggggg

SEQ ID NO: 2801 - DNA, 105 bp, Homo sapiens
cggcacgagagttatgagattgttactgttgggaaagaagaaagataaaggagaaaaaaatcttaggcaatacatgaacagtttttaagaacagatgtagcttgt

SEQ ID NO: 2802 - DNA, 297 bp, Homo sapiens
ccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaggagccaagatcctccgaatccag

SEQ ID NO: 2803 - DNA, 100 bp, Homo sapiens
agtacttctagagcggccgcgggcccatcgattttccacccgggtgggtaccaggtaagtgtacccaattcgccctatagtgagtcgtattacatttaac

SEQ ID NO: 2804 - DNA, 142 bp, Homo sapiens
gccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagat

SEQ ID NO: 2805 - DNA, 169 bp, Homo sapiens
gttcggtgcagtatctgtaatctcagcactttgggaggctgagatgggaggatcatgggaacccaggaatttgagacatgcctgggcaacatagtgagacttcatctctataaaaaacttaaaaaattagccaggcatggtggcacacactgtgtaccagctacttagg

SEQ ID NO: 2806 - DNA, 152 bp, Homo sapiens
ctgaccaggaattctttgtggacattggcccagtctgtttcaaataaatgaactcaatctaaattaaaaaagaaagaaatttgaaaaaactttctctttgccatttcttcttcttctgttttaactgaaagctgaatccctccatttcctct

SEQ ID NO: 2807 - DNA, 183 bp, Homo sapiens
gatgaatggaggtcattacacctactctgagaatcgtgtggaaaaagacggcctgattcttacaagccgggggcctgggaccagcttcgagtttgcgcttgcaattgttgaagcccttaatggcaaggaggtggcggctcaagtgaaggctccacttgttcttaaagaaatagaggagccaac

SEQ ID NO: 2808 - DNA, 127 bp, Homo sapiens
ggcgcctgtagttccagctactctggaggctgaggcaggggaatcacttgaactcgggaggcagaagttgcagtaagccgcgatcgggccactgcactccagcctggcgacagagcaagactgtcta

SEQ ID NO: 2809 - DNA, 198 bp, Homo sapiens
ctcacattgcatgcaagtttgctgagctgaaggaaaagattgatcgccgttctggtaaaaagctggaagatggccctaaattcttgaagtctggtgatgctgccattgttgatatggttcctggcaagcccatgttttttgagagcttctcagactatccacctttgggtcgcttttcttttcgtgatattagacaaa

SEQ ID NO: 2810 - DNA, 223 bp, Homo sapiens
aaatactttataatagacctattaatagaatatctcaatgcaaattcaatttgtagaagtcgaattctatttgttcatagacttataaatgaataaatactttatcttaatttctcattgattttcagttagttttattttttacactttggctatgaagtgtgggcccaaggtctctttcaaaaagttttaattatataaatgggcctaagtccaccccagg

SEQ ID NO: 2811 - DNA, 290 bp, Homo sapiens
aaatactttataatagacctattaatagaatatctcaatgcaaattcaatttgtagaagtcgaattctatttgttcatagacttataaatgaataaatactttatcttaatttctcattgattttcagttagttttattttttacactttggctatgaagtgtgggcccaaggtctctttcaaaaagttttaattatataaatgggcacttaagtgcaaccaaagaagcaaaatatctttgaaaaattttcaatatctccttttgtaaagcaaaaaaaaaaaaaaaaaaa

SEQ ID NO: 2812 - DNA, 209 bp, Homo sapiens
cggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgggggcgg

SEQ ID NO: 2813 - DNA, 309 bp, Homo sapiens
ggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgacttctgtagttcagaagaggtttggctttcagaggcagtgtagagctttatgctgaaaaggtggccactagaggtctgtgtgccatttcccaggcagagtctc

SEQ ID NO: 2814 - DNA, 232 bp, Homo sapiens
gtagtttatataaaggaagttaattgttagggaggattttctctgttactctgaaattgttttcaaatgtgatatagtctgagagtattacttgactcattctttttttttttggtgacaaagtctcgctctgtcacccagggtggagtgcaggggcaccatcttggcttactgcagcttctgcctcccaggttcaaatgattctcctgcctcaaccaccctagtacctggg

SEQ ID NO: 2815 - DNA, 293 bp, Homo sapiens
gtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatgggcctccaaggagtaagacccctggaccaccacccccagcaagagcacaagaggagagagagaccttacttcttgggagtcct

SEQ ID NO: 2816 - DNA, 110 bp, Homo sapiens
cctgaaggctaaagctttaccataaacagcgtcatgctgagagaatacaaatgaaaaaggactatcaaggattgcatgaaaaggggagccaccaaccaaaaggattgttg

SEQ ID NO: 2817 - DNA, 302 bp, Homo sapiens
cccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtccccctgcggtgaagaacttcgggatctggctgcgctatgactccggagcggcacccacaacatgtaccgggaataccgggacctgaccaccgcagcgctgtaacccagttctaccgagacatgggtgcccggcacgcgcccgagcccactccattaagataatga

SEQ ID NO: 2818 - DNA, 308 bp, Homo sapiens
acttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcaggttcggatgagaccaggtgttgcttgttcagtatctcagccca

SEQ ID NO: 2819 - DNA, 303 bp, Homo sapiens
ctcttgtcaaattttagtttaattggcattgcttgttttttgaaactgaaattacctgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtgcagcaattttaaaatttgaaatattttaaattgtttttgactttttgtgtaaatatatcagatctcacattgttggtttcttttgtttcca

SEQ ID NO: 2820 - DNA, 244 bp, Homo sapiens
ggatccagtgcgcaaaaaaccctacccggggcccttcccagaagcaataagttcctctgcggacccggggctggaagagagccccgctgccttggagccgccctcctgaagcttgaaaatggaggaatttagttttgttggttgaattgaaaatggcgacttgagaaacaactgtgccttcttttcttcctttcttttttttaaacctctacagacacattcctcacaccaaccaaaactcagt

SEQ ID NO: 2821 - DNA, 570 bp, Homo sapiens
ggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaattgtcccaactatgcaattt

SEQ ID NO: 2822 - DNA, 290 bp, Homo sapiens
ggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggcccccaagcagtacacttgctggtctaggtatt

SEQ ID NO: 2823 - DNA, 257 bp, Homo sapiens
ctcgtccaaatttcgggcagggttgcctctgacgattattggatgcatactttggttttaagaagaatgccattgaacacccagttcgaaccaatcagattccacgtcagattcctgaacagtcgttctacacgaggcccttgcctggtattatcatgggagggattttgccctttggctgcatctttatacaacttttcttcattctgaatagtatttgggtcacaccagatgtattacatgtttggcttccattt

SEQ ID NO: 2824 - DNA, 162 bp, Homo sapiens
ctcgtccattttcggccgggggaattgaagccagagacaggaaagccaagatgacagattttgatcgttttaaagttatgaaggcaaagaaaatgaggcacagaataatcaaggatgaagttaagaggcttcaaaaggcagctctcctgaaagcttctccca

SEQ ID NO: 2825 - DNA, 228 bp, Homo sapiens
ctcgtcccttttgaatggtttttcttttcttatttttaaagaaatgcacttgcctatgatactgtctctccagtgaaatgattactcctccattactctattgatacaatattgtgcatgctagtgttgtatttctatacagtagcttgaaattgattaacctatactgtaggggttatgtattcctatgacaaaaaaaaattaagtcttcaaattttttaaagggtt

SEQ ID NO: 2826 - DNA, 264 bp, Homo sapiens
ggactacaatggccacgtcggtctgggtgttaagtgctccaaggaggtggccaccgccatcccgtgggggccatcattctgtgccaagctctccatcgtccccgtgcgcagaggctactcggggaacaagatcggcaagcccacactgtcccttgcaaggtgacaggccgctgcggctctgtgctggtacgcctcatccctgcacccaggggcactggcatcgtctccggacctgtgcctaaagaggctgctcatgatggctgg

SEQ ID NO: 2827 - DNA, 165 bp, Homo sapiens
tgaaggtagaccccatctctcaccatacacaaaaattaaattaaatggattaaatacttaaaccaaagacctgaaagtataaaactactagagggtatcattagggaaaggctctcggatactggtttttgagagacattttgtgtaagactcaaagcacaggta

SEQ ID NO: 2828 - DNA, 192 bp, Homo sapiens
gccattttttagctttgcccattgtcttattggcacatgggtggacacggatcttctgggctcttcctttaaacacacattgcagcttcacctttctctttagtgttctgtttgaactaatacttaccgagtcagactttgtgttcatttcatttcaggggcttggctgcctgtggcgttcccaggtggcct

SEQ ID NO: 2829 - DNA, 235 bp, Homo sapiens
ctgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaaattgatttagcattcatattttccatcttattcccaattaaaagtatgcagattatttgcccaaatcttcttcagattcagcatttgtt

SEQ ID NO: 2830 - DNA, 190 bp, Homo sapiens
cgccattgctaaaacgaagctagggcctttcttaggatggaggacatgaaagaaaatgccacttccaaagctcaacactccatcagattgacaagttagctgggatcagataataatagccatttcatgtcttgattaagaacctcacacagactccacagaactgttgataaactagagcaaagggaat

SEQ ID NO: 2831 - DNA, 590 bp, Homo sapiens
cgccattgctaaaacgaagctagggcctttcttaggatggaggacatgaaagaaaatgccacttccaaagctcaacactccatcagattgacaagttagctgggatcagataataatagccatttcatgtcttgattaaaaacctcacacagactccacagaactgttgataaactagagcaaaaggaattcacagttccattcttcttataaaccaaactaaaatgctgactttcgaaatccttttttccgacctcctgatggaaagttttgacaagtgtagcactgaagcatttccccctctctgctagaggagaaatggcaatcttcaaagaccattgttttgttttattcgcttccaattcattcttagtaaacaattgcaggatttctaaaaagaccagaccatagtagttaccagacatgagatgctttctaaaagctactttgaatagaaatgttttctctgaatctgtcctccctcatgcagcaggaagaatgtctaaagctatgctacctcatatagaaacagcgtccacagtcagtcctcccagttgggtttatctgagcggtcctttagaggtggccgc

SEQ ID NO: 2832 - DNA, 207 bp, Homo sapiens
ccactccctgtgcctccagcgagtaccctgtgcggcggcgcaatgtgaagaagtggcccgggcgctgggcaaggaaagcctccgggaggtacaactggaagagctagaggctgccagggacctggtgagcaaagagggcttccggcgggccggcacgtggtgggggagattcggcgcacggcccagccagcggccccctgagacgtg

SEQ ID NO: 2833 - DNA, 275 bp, Homo sapiens
cgtcacagggatacccacccaccatcccagggtctacaacatccacagccggaccgtcacccgctatcctgccaactctatcgtggtcgtaggaggctgtcctgtcttcagggttggggtgctggaggacttcttcaccttcctgggcatcttcctggccatcatcctcttcccctttggttcatttgctgttttgccttaggaggcacggtgcccaactgtggggcaccttcggttaaagggacacaggccggctttctacaccaggtcttttt

SEQ ID NO: 2834 - DNA, 300 bp, Homo sapiens
atagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtaccccagagtctagtgcgctctctccgtggggaggagccggttcccagggaaagggacagggacccttgcggggaagcggtggttgttgcgccgccgcgccgcgccgcttcagtagcagcagcagctact

SEQ ID NO: 2835 - DNA, 185 bp, Homo sapiens
ccagctttgcaccagcgtggcggtgtttactggcgccttgatctatgccattcacgccgaggagatcctggagaagcacccgcgagggccaagcttcggatactgcttcgccctggcctgggtggcctgacccctcgccctggtcagcggcatcatctacatccacctacggaggcgggagtgag

SEQ ID NO: 2836 - DNA, 235 bp, Homo sapiens
acagtcctataacaaaaacactaatgacatttgtttttaacatttcctttagaatataatcatgggaattgaagagtgagttaaggtttagacctatgtctcttttcttccacttttatgactctgagatttaaaaaaaaaaccaaaacaaaactgtccctgataaagacctgaaaaaggtgcttttctctgactgcagttttctaaaaggggaggttaatgtcctaaaatgtat

SEQ ID NO: 2837 - DNA, 540 bp, Homo sapiens
acagtcctataacaaaaacactaatgacatttgtttttaacatttcctttagaatataatcatgggaattgaagagtgagttaaggtttagacctatgtctcttttcttccacttttatgactctgagatttaaaaaaaaaaacaaaacaaaactgtcctgataaagaactgaaaaagttgcttttctctgactgcagttttctaaaagtggaagttaatgttctaaaatgtatgtacacattgcaattgtgtgtagagctcaaaagcgtaaaaagcaaaatatattgaatttcaacatacttgttatcctgcattccagttgactgtagagaatctctagtcatgtctatctgtttttgatgcctctacagaataactgcccagcatcctctgcccaaccaatcagaatgtaggaaaatctacagatatgacggaatctactgtgaatctacctaccagaagtatgttgaaatccttgtgagtcttccctctggctcgtacatcagtgcttgtggttgccagctattcaaaaatatcct

SEQ ID NO: 2838 - DNA, 270 bp, Homo sapiens
tttgggtgaccctggactcgccactggtacccgcccttccgagcggcgcctaagcctttgccgtagcatgcacactgagaatgctaatggttgggttgattgtatgttgaggatctattactgaccgtatgatgaggccaactttttttccttgtggttagcaagactgcaagagatggaaaaaaggtagtttgaatgttttgtgtgtaaggagtataccatgagatggatgccccccaatcatttccttgggggaagggggtgtctcca

SEQ ID NO: 2839 - DNA, 290 bp, Homo sapiens
gggagaggaagctagaagggttatggttggagttctgtacagtgttgagtttccgacaggaaagaggattcctccaatgcgcctagagagaaagccttagcaggagatgatgcagcagaggggaagggccctttggtgccgccgcccttcctttagcctccgaaggtgatggaaatggagagtggggacccagcctccagctttttggcctcgcccttaaggcttaacaataagcccacctccctctctccttccagcattagcccttggttcctggcccagctgggggt

SEQ ID NO: 2840 - DNA, 194 bp, Homo sapiens
gggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagtt

SEQ ID NO: 2841 - DNA, 290 bp, Homo sapiens
ctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgagcccctcagcatactgggaatctcttcctgacaacgagtgtaaatttggtcaagtctactctccgctcattcaattatttgaggcatt

SEQ ID NO: 2842 - DNA, 193 bp, Homo sapiens
cgtccaatttcggcaggttggcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaattaaaagtgctgccgtaccc

SEQ ID NO: 2843 - DNA, 123 bp, Homo sapiens
gttcaatgctgatgaatttgaagacatggtggctgaaaagcggctcatcccagatggctgtggggtcaagtacatcccaatcgtggccctctggacaaggtggcgggccctgcactcatgagg

SEQ ID NO: 2844 - DNA, 133 bp, Homo sapiens
gggaaccccagcctgaatgtattggatgagaaggagccaggagggctacaccatctgtattagggaaaagcctttggggagaggggtgggttcctccctcctcccgaggggtaagccgccaggaggagagcca

SEQ ID NO: 2845 - DNA, 290 bp, Homo sapiens
tctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccaaccccgcccccgggaccgtgcaggcaccagggttccgtgcacctat

SEQ ID NO: 2846 - DNA, 105 bp, Homo sapiens
tagaaggaggtaacttccaaggaaatggctacccaacttgcctttgatgcgcctgctggccaactatgcctcttagaacataacctaccactgcaagacagcatt

SEQ ID NO: 2847 - DNA, 141 bp, Homo sapiens
tgcttcctgactcgctctactccgtgcgacgcacgcttcacaaaggcacgtcgggccgtcgccccgcttgggtcggcttgaaggaacttccggatcggaagcctccgaagaggcccttattgggcccaccatcccggaccc

SEQ ID NO: 2848 - DNA, 300 bp, Homo sapiens
ttccagagcaaaaactggcactcatagcaagccagaacccccatccccatcctcatgggtctgtggctgggtgcaggccatcaaaatggacaccacgagacagaagtggggactgcctggccacctagcgccttccactccttaagcaagcacacagaagatgaggcagagaattgtcagagctgaaagttcctttggttgctcacaactcaggtatgcaccatgtggcagccaggcagcggagcctactagactgccagtctcatgcacccagacctgtggccagattgtggcctctgg

SEQ ID NO: 2849 - DNA, 176 bp, Homo sapiens
ggacaccggggatctgcgacacctcagcctgccaaggagccgtgttaggaggggtcggggagaaatcaggctctcgaagctcataaaattcaacgtgaggaagcaagtcacaaggacgcccgaagcacagtggacggtcatgaaggagcgggggttttgcaggcgggtcacgtcca

SEQ ID NO: 2850 - DNA, 145 bp, Homo sapiens
ctcgtccaatttcggcagggggttacactggggcttcccgttacaagatgagggtctgtgtatgctcacttccccatcaacgttgttatccaggagaatgggtctcttgttgaaatccgaaatttcttgggtgaaaaatatatcc

SEQ ID NO: 2851 - DNA, 138 bp, Homo sapiens
tgaatgtagattgaagctaaacttgttaaggcttttgaaattcagggtttatatactactttgttctccagtatatttctaaatttcataaataacttgagaggcctactaacatcactttcttaacaaaagcagaga

SEQ ID NO: 2852 - DNA, 195 bp, Homo sapiens
ctctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcagggaatactgcctcg

SEQ ID NO: 2853 - DNA, 261 bp, Homo sapiens
ggcatgaaaaggcacttgctgctggaggagtagggtccattgttcgtgtcttgactgcaagaaaaactgtgtagtctggcaggaagtggattatcttcctcgggagtgggaattgctggtacaaagaccaaaacaaccaaatgccaccgctgccctgtgggtagcatctgtttctctcagctttgccttcttgctttttcatatctgtcagaaaaaaatacatatcagatgtcctttaatgaaaattgggatatatagaga

SEQ ID NO: 2854 - DNA, 213 bp, Homo sapiens
ttaggacgtatccgcctccatcctccccggccgggcttgcccgaggtttcgggattcctacttggggatggccgggcagaggcgaagggatcacggcctccgtggctcgtggttccaagaagcatcttaagcgggtggcagctccaaagcattggatgctggataaattgaccggtgtgtttgctcctcgtccatccaccggtccccacaagt

SEQ ID NO: 2855 - DNA, 166 bp, Homo sapiens
cgaggactccttccttttcaatattttgtaacagtttcagtaggattggtgtaagttcttctttgaatatctgacagaatttggctgtcaattctggcttttttggttgttgttgggagattttgttattactgattcaatctcggttaccattattggatctgtt

SEQ ID NO: 2856 - DNA, 205 bp, Homo sapiens
cagctgtggagttctacatgagcattttcccacttcctcctgatgctgcttttgtgtgttttgttcactgtaataattttttcaaagggaacttacataaatgtccagggcactatatttttctaatgttagtgtaaatacaccccaccagggtaaattaaaaggtgacattgcatttccttttataattaattggggttacaat

SEQ ID NO: 2857 - DNA, 505 bp, Homo sapiens
agctgtggagttctacatgagcattttcccacttcctcctgatgctgcttttgtgtgttttgttcactgtaataattttttcaaagggaacttacataaatgtccagggcactatatttttctaatgttagtgtaaatacaccccacaggataaattaaaaggtgacattgacatttcctttttataattaattggggttaacaatggcctaaagattagcacaccctcgtgccgaattcggcacgagtgacatttggggattatgggagctacaattcaagatgagatttgggtggggacacagccaaaccatatcattagaagaatgccacaaaagtgatgtcgtgcccttcttagtgtgtcctaacaagcggaacatgatggcgtgatttctactcacggtggtaacgtcgatcacccttttaaggtagggtctgttaggttttttgcgataatgttatgattttccctttgtaattaataagtacctgtcatttgttttta

SEQ ID NO: 2858 - DNA, 177 bp, Homo sapiens
acgtgctttcagaacccgttctgggggtgcggcgcacacctgggccccgtgcagggcttcagctcggcagcagctctgagggcagctcaatgaaaaagtgaatgcacacgcccttgttggcgtggcctggcatggctggtgctatcggcagccgctctccactccccgactgatact

SEQ ID NO: 2859 - DNA, 241 bp, Homo sapiens
actagtggatccaaagaattcggcacgagggctcttccatgtaacatagcagttatcgtgtaatttagtgccacttattgcaaagtgttaccaagggggaacatttcaaatgccttttgttttttctttggacatcaagataatttagtggacaacaaatattaaattttacattatgctttttaattgtggggaaatgcaaaacctcatgtcttaccacaactttccattggtattgcta

SEQ ID NO: 2860 - DNA, 218 bp, Homo sapiens
ctcgtgcgaattcggcagagaattttgttctttttcatgggtgaaaaatatttcattgtgtatatataccacattttctttatccattcatccattgatggacacttgggttgattccatatcttggctactgtgaatagtgctgcaataaacatgggaatacaaatatctctttgatatactgatttcctatcttttggacatatactcagcagtag

SEQ ID NO: 2861 - DNA, 222 bp, Homo sapiens
acttggtctggtctctctggtggctacaaccccagagttttaaggacttggaaaggaaagcacaatcagagaagaaaacagcccccgaaccagcaggagtggcctggcacatggaccggctgagcgatgtgcactccacccaagccaggctcccagggggcctgatttctctctcactgtctctttttttaaaatgggttgcacggctctgccccatggggg

SEQ ID NO: 2862 - DNA, 141 bp, Homo sapiens
cttttgcagatggaggatttcttgattaatgttgaaaaaaaacccttgattatactctgttggacaaaccgagtgcaatgaatgatgcttttctgaaaatgaaatataacaagtgggggaatgtggttatggccggaaagg

SEQ ID NO: 2863 - DNA, 192 bp, Homo sapiens
taaaatctcaccaaggcaaaaagaggaaaaacgctcagaacagaaccttgaaagtgccaaagttaagaggagaaagcagaaaaggagattgagaaggaagaattttagagctaggagaaattaggggagaatttaatttcatggaagctaaagggcaagataattgagttggtagttttcccaaatacttta

SEQ ID NO: 2864 - DNA, 209 bp, Homo sapiens
taaaatctcaccaaggcaaaaagaagaaaaaacgctcagaacagaaccttgaaagtgccaaagttaagaggagaaagcagaaaaggagattgagaaggaagaattttagagctaggagaaaataggggagaatttaatgtcatggaagctaaagggcaagataattgagtgggtagttgtcccaaatactttaaaaaaaaaaaaaaaaa

SEQ ID NO: 2865 - DNA, 307 bp, Homo sapiens
ccagccaattttttttgtatttttagtagagacagggtttcaccatgttggccaggatggtctcgatctcctgacctcgtgatctgcccgcctcagcctcccaaagtgctgggattacaggcttgagcacttcgcccggccggtcattcattcttgcaacaagcatttattgagcacctactgtgtgctcacagtaaagaaacgtgatcttatcccaatagaggtagatattcttaaaaaagaataattcttaaactccttaaacaaggggtcccacccccaggccacaaacagtaccagtccgtgg

SEQ ID NO: 2866 - DNA, 100 bp, Homo sapiens
ctcgtcccttcgtgccgaatcggccattccaaggatcccgtggtgagatcttcttcttccaaggaccgggttcatttggcggcctgtgcacgccaggtgc

SEQ ID NO: 2867 - DNA, 199 bp, Homo sapiens
atgatggccaaaaagcacctggagatcaaccctgaccaccccattgtggagacggtgcggcagaaggctgaggccgacaagaatgataaggcagttaaggacctggtggtgctgctgtttgaaaccgccctgctatcttctggcttttccttaaggatcccagaccactccaaccgcatctatgcatgatcaagctagg

SEQ ID NO: 2868 - DNA, 194 bp, Homo sapiens
ggcaaatcaagcacatgattaagtaccggtacatcccgttcacacatgggaagagaaggtacagaggcaaggaggatgccggcaaggctttcgccagctagaagcgggactgaggctgcctcacgtgttgcaagaacagttttgagccattgttaacaatgccttttttcttcacataaagtagttgattacga

SEQ ID NO: 2869 - DNA, 228 bp, Homo sapiens
aattaatgtgcgtattgagcacattaagcactctaagagccgagatagcttcctgaaacgtgtgaaggaaaatgatcagaaaaagaaagaagccaaagagaaaggtacctcggttcaactaaagcgccacctgctccacccagagaagcacactttgtgagaaccaatgggaaggagcctgagctgctggaacctattccctatgaattcatggcataataggtgtta

SEQ ID NO: 2870 - DNA, 134 bp, Homo sapiens
gccgaggttcttctcattcggcatcaacagcattttatatcagcgtggcatatatccatctgacacctttactcgagtgcagacatacggactcaccttgcttgtcctactgatcttgaggtcataaaatacct

SEQ ID NO: 2871 - DNA, 236 bp, Homo sapiens
aagaccccatcatcgggttccaccagatgttcctattaaagaatatcagtgaagcttgggtttgcaccaatgacatgttcaggcttgccctgctcacttcggctgacctcctctcagccaggcactcacactgtttcctcctcacacctcttcccaatactattcgtactcctccagatgctccaaatatcatacacaaatgagcagggccacgatgggagtttgcacagtgtctt

SEQ ID NO: 2872 - DNA, 220 bp, Homo sapiens
cgccatctcaggtctcttggctttgcagggcccaccggagaaaactgacgacccgtttctgtaatccttatgggagaccaaccttgtgcctccgggagatccactctcccacctggaaacgcacgggaagccaagcctccaaaaaagcgctgcctcctcgctccggtttgggattattccggaagaacttccaacggaggtagtaccactctaccctccg

SEQ ID NO: 2873 - DNA, 245 bp, Homo sapiens
ggaaagaaaagcaaacatgcattcaaggtaaaataaaataaaataaaataaagatgatggcaattagaaacagagaagtcaaaagaaagaaagaaaagaaggaagaagaaagagaaaaataagcaacatgcattcaggtaaataaataaataagatgatggcattaggacagagaagtcaaagatggctttgacactaattttacaaatcaaaaccctaaagtgacccgtgtgtttgtgcccttt

SEQ ID NO: 2874 - DNA, 240 bp, Homo sapiens
gtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatttttgccatgaattttgagaaga

SEQ ID NO: 2875 - DNA, 124 bp, Homo sapiens
gcttaacgtgcagaacaagaacagcagctactttgtggaatggatccccaacaatgttaagacagccgtctgtgacattccacctcgtggccttcaggatggcagtcaccttcattggcaattg

SEQ ID NO: 2876 - DNA, 120 bp, Homo sapiens
gttggaggagcgagcagccatggatgccgtttgtgccaaagtggacggtgccaacaggctttggagaccctcttgaggctttcccagtgttcaagaaatatgatagaaacgggttgaatg

SEQ ID NO: 2877 - DNA, 125 bp, Homo sapiens
gaaaataatgggggtatttttctgccttgttttactccattgtcttagtacatggctatggtggagagaataatggcccaccccaaacatgtccacattcggattccccagaacctgtgaatatt

SEQ ID NO: 2878 - DNA, 330 bp, Homo sapiens
gaaaataatggggtatttttctgccttgtttttactccattgtcttagtacatggctatggtggagagaataatggcccaccccaaacatgtccacattcgaatccccagaacctgtgaatatggcaaaagggattttaaatttcaaaagactttgaagatatgattaagttaactatcttgagatgggggatggattttcatggattatgtggggggcccagtgtagtcacaggggtctttactggagggaggagggtcagaatcagagaagtaaatgtgatgagggagggagagagttgacagccacgagccaatgaatgcaggcagc

SEQ ID NO: 2879 - DNA, 115 bp, Homo sapiens
tctggctcactgcaagctcacctccaggtcaagcattctgctcagctttctgagtagctgggactacaggtgcccaccaccacacccggctaatttttttatatttttagtagag

SEQ ID NO: 2880 - DNA, 125 bp, Homo sapiens
gcccacttccacagcctacagcaccgagggcggcctcttacatgatgtgtcggcagctttcttgccttctgtgaagggacagcgctgttcagatttgatatttcaacttacaacttgtttttaaa

SEQ ID NO: 2881 - DNA, 206 bp, Homo sapiens
caggaagctgaagtctcagctgcccaagggaccacaggaacagctccaggagccaggggcccggaaacaggtcaagacagttaggtttccagacccctggacgcttttcgttggttttgcaagcgccggagagccttttggcacaattccccggttgccaaccctgccccaagagagttccccagggcaggagaggccaaggacct

SEQ ID NO: 2882 - DNA, 250 bp, Homo sapiens
caggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccaaggcaggagaggccaggaacctcagggtgctgagggccgaggccagagcagaagctgagcatggagagcacg

SEQ ID NO: 2883 - DNA, 159 bp, Homo sapiens
ctcgtccaattcggcagtcttgtaaagacagaactacaaaaactcaagaataagctgattagccttttatttacaaatgtgaaccttatagttgaaaaccttcccacagagaaactcccaggcccagatgaccttagtggtgaattctaccaaacatta

SEQ ID NO: 2884 - DNA, 119 bp, Homo sapiens
tgctcatgatggctggtatcgatgactgctacacctcagcccggggctgcactgccaccctgggcaacttctggcaaggccacctttgatgccatttctaagccctacagctaccttca

SEQ ID NO: 2885 - DNA, 257 bp, Homo sapiens
gagatttccagcaagagccccgtgcggtgcagagccaaaggtcaacctgctgtattcccgcgaccattcggtggccgagagcctcaactacgtggcgtcctcgaacatgagcatgctgcagacccaagacctcgtgaagtcggtccaggccacgactgagaacaaggaactgaaaaccgtcaccttctccaagctctgagagccctcgcgttccaggccccagccaaggggccgggccttgttccggctcatccaca

SEQ ID NO: 2886 - DNA, 128 bp, Homo sapiens
  misc_feature 36: n = A,T,C or G
cgacgttccgttcccccctgcccgccttcttccgcnaacgccgccgcggctttccgcaggccggtttccaccgaggaaaaggaatcggtatcggtatgtccgctatccagaacctccactctttcgac

SEQ ID NO: 2887 - DNA, 202 bp, Homo sapiens
ggcaacctgaaaaaggctgtcattctacagggctctaatgatgttgaacttgttgctgagggcaacagcaggttcacttacactgttcttgtagatggctgctcctaaaagacaaatgaatggggaaagacaatcattgaaatacaaaacaaataagccatcacgcctgcccttccttgatattgcacctttggacatcggt

SEQ ID NO: 2888 - DNA, 127 bp, Homo sapiens
gaagagtggaaactttggtggtagcaggaacatggggggaccatatggtggaggaaactatggtccaggaggcagtggaggaagtaggggttatggtggaaggagccgatactgagcttctttccta

SEQ ID NO: 2889 - DNA, 144 bp, Homo sapiens
cagaatggtccagcgtttgacataccgacgtaggctttcctacaatacagcctctaacaaaactaggctgtcccgaacccctgggtaatagaattggtttacctttataaccaagaaggttgggaaaagcaccaaaattttgca

SEQ ID NO: 2890 - DNA, 181 bp, Homo sapiens
atcctgtggagcatccttttggaggtggcaaccaccagcacatcggcaagcccttcaccatccgcagagatgcccctgctggccgcaaagtgggtctcattgctgcccgccggacttgacgtcttccgggaaccaagacttttcaggagaaagagaactagttctgagggccttaataaag

SEQ ID NO: 2891 - DNA, 201 bp, Homo sapiens
cagtggatcactgtttcactttggaaaagctgctctctgtcagggttgtgaaccgctttattgtttagttcatataaaggtcagtagctctaaaaatacacactttaatgggtgatgtaatagacattttatatgtgttgcaggtactttccctcagtgggtgaaatgaatacccttttgtgccttctggagaaggtgtct

SEQ ID NO: 2892 - DNA, 397 bp, Homo sapiens
cagtggatcactgtttcactttggaaaagctgctctctgtcaggtttgtgaaccgctttattgtttagttcatataaaggtcagtagctctaaaaatacacactttaatgggtgatgtaatagacattttatatgtgttgcaggtactttccctcagtggttgaaatgaataccttttgtgccttctggagaaggtgtctgtatgtatggtgtgggaatatgtgtgtgtctgtgtatgtgcacatcttgtttgaaagccccagtcttacaaacttacaaactggattcttcaatctctttcttatgaaatatcaacatctactgtgaatctatcatatatcattggagttgacagacattttgactgtttaacttgcaaatacaggctttgggtcag

SEQ ID NO: 2893 - DNA, 285 bp, Homo sapiens
cagccttgaagatgcaaaaaaagagggaccatatgatgtggtggttctaccaggaggtaatctgggcgcacagaatttatcttagtcttctgctgttaaggagatacttaaggagcaggaaaaccggaagggccttatagccgccatcttttcaggtcctactgctcttttggctcatgaaatagggtttggaagtaaagttacaacacaccctctttgctaaagacaaaatgatgaatggaggtcattacacctcctctgagaatcgtgtggggaaagacggcc

SEQ ID NO: 2894 - DNA, 327 bp, Homo sapiens
ctggcctcccgaattcccgtgcagggcctgctccaccctgcgccacccagaggctgaggacccctcagcggaacaaccctggtgtgcctcggacatcttttaagccttggcagagaaacgtggttacaagacaaccaaggcggctcggaatgatgtgtacagagcagccaacagtctctttcggcttgcagttgacggccgcctcagcctgtgttttcatccccccaggctacagtgaacagaaaggcacctcgggagtcccatccagagaccacgggagcttgtggtttttcagggcaagggtggggcccaccaggtgtacgagga

SEQ ID NO: 2895 - DNA, 255 bp, Homo sapiens
gctggccgaagagcagaagcgtcgggagagggagcagcacatcgcagagtgcatggccaagatgccacaaatgattgtgaacttgcagcagcagcagcgggagaacttggagaaggcccaggctgacaaggagaggagggccccacttcaggcttaggcccaggagctccttggctaccaagtggacccaaggagttccccttccaggagcttctccaggacctagagaagaaggagcgcaaaccctcaaggagg

SEQ ID NO: 2896 - DNA, 170 bp, Homo sapiens
atcccatggttgttgttagggatagtactaagcatttcagttccaggagaataaaagaaattcctatttgaaatgaatttctcatttggaggaaaaaaagcatgcatttttaggcacaacaagatgaaattattggaatacaaaagtgggctccttccccatgtgcaagt

SEQ ID NO: 2897 - DNA, 126 bp, Homo sapiens
gtacaataccacttccgctgtcacggtaaagtccgccatcagaagacttaaggagtttaaagaccagtagacggttctctactctttgagacaatacttgcctattataaattggttaatttatgt

SEQ ID NO: 2898 - DNA, 165 bp, Homo sapiens
gtcaaggccgcctggggtaaggtcggcgcgcacgttggcgagtatggtgcggaggcccttggagaggatgttcctgtcctttcccaccaccaagatctactttcccgcaattcgaccttgagccaaaggctctttcccaagttaaagggccacaggcaagagggt

SEQ ID NO: 2899 - DNA, 232 bp, Homo sapiens
gttcgatgaagtagaaactaaggagagtcgtgaagcagtttagaaagaatttgagcctctgctgaattggatgaaagataaagcccttaaggacaagatttaaaaggctgtggtgtctcagcgccttacaaaatttccgtgtgctttggtggccaaccagtacggatggttttgcaacatggagagaatcatgaaagcacaagcgtaccaaacggggaaggacatatttaca

SEQ ID NO: 2900 - DNA, 131 bp, Homo sapiens
gagcagcagatagatctgctggcgagctcgagcagctcaagggccaagcaagtcgcgctgggactctacgagaggagatgcggactgcgccgcagtgacagctaccacgacaaagccgcgtcgaggtgagc

SEQ ID NO: 2901 - DNA, 174 bp, Homo sapiens
ggctcacacacctgtagcacttactggtaggaccaagcatcttgggggggtgccgctgagttgcagggacagagtcactttgtttcgtggggaggtctaatctagatatcgacttgttttgcacatgtttcccttagttctttgttcataggccagtagaccttgttacttcta

SEQ ID NO: 2902 - DNA, 124 bp, Homo sapiens
cctctactggaggggtgaagaacctcatcgttacaggcctggtactgtcgcgctccgtgaaattagacgttatcagagtccactgaacttctgattcggaaacttccttccagcgtctggtgcg

SEQ ID NO: 2903 - DNA, 150 bp, Homo sapiens
cagtaactctttacattcaagaaataaagaacatcaatcaaagcacaggagatatgacagtacagcaacgtctgctagcacaagattcgagagggaaacagggagagaaggagccaaggcagtacaaacgagggaattggaagtttaaat

SEQ ID NO: 2904 - DNA, 515 bp, Homo sapiens
tgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggcaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacata

SEQ ID NO: 2905 - DNA, 175 bp, Homo sapiens
tgcgtgccttatgctgttatagaaggagctgtgcggtctgttaaagaaacgcttaacagccagtttgtggaaaactgcaagggggtaattcagcggctgacacttcaggagcacaagatggtgtggatcgaaccacccacctttggaatgattgctcaaagatcattcatcaaag

SEQ ID NO: 2906 - DNA, 155 bp, Homo sapiens
aggcactagtggttcttaaaagtaggaagtaagccctggtgtgatggctcatgcctgtattcccagcactttgggaggccagggttggaggatcacttgagtctatagagttcgagaccagcctgggcaacatagttagacccatctctactacc

SEQ ID NO: 2907 - DNA, 137 bp, Homo sapiens
agagtggtgaacagccctacaagatggctggtcgatgccatgcttttgaaaaagaatggatagaatgtgcacatggattcggttatactcgggcagagaaagagtgcaagtagatattgatgatttccgtagagtgt

SEQ ID NO: 2908 - DNA, 270 bp, Homo sapiens
cagagaatgtgtctatatcctccttctaacagcaccttccccctgcagctactcttcagatctggctctctgtaccctaaaacctagtatctttttctcttctatggaaaattcgaaggtctaaacttgacttttttgaggtcttctcaacttgactacaggtgtgctcataattgtgcttgccttttccagctttaattattttaagggacacatgtgaactctcgggcttgggagagtggctcatatctcgtgattcccagcactctt

SEQ ID NO: 2909 - DNA, 255 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttgaggtccaaggctaaaagcggaataccaccggacttgtcgattaggcaccttaaattgtatatcccgagagtcacagatagggttccgtgaagggccac

SEQ ID NO: 2910 - DNA, 210 bp, Homo sapiens
tgcaatttatactgtatggcttctttttcatgtttcatctaggtttttagaagtgaagtatagtaaatttgggttcgttaaattgtgaaggcgctgggaattacatgaacataccaccctagtaaaggcaagttctgtaagcttacattgctatttggtaaagcgttgccttcacagcatttcagaatgctgtttggcttcatgtcccca

SEQ ID NO: 2911 - DNA, 240 bp, Homo sapiens
ctcggcctggctgcacaagctctaccaggagaaggatgcctttcaggaggagtactacaggacgggcaccttcccagagacgccatggtgcccccccggcggccctggaccctcgtgaactggcttttttgggcctcgttggtgctcttacccttttctccagttccttgtgaagcatgatcaagagcgggttttcctgtacgtctggcagattcatcctcgtgcttttttgtgctccgt

SEQ ID NO: 2912 - DNA, 125 bp, Homo sapiens
caagatgagattggcatggctttatttgttttttttgttttgttttggttttcttttttttttgggcttaactaaggattaaaacctggaacggtaaaggtaacagcaatcggttggaggcaagc

SEQ ID NO: 2913 - DNA, 155 bp, Homo sapiens
ggacacaccacggaaagagaaggcttcacgggaagagaagcagaagccccaggctgagcggaaggaggagaaaaaggcggcttgcccctactccttgaggaggagattggatgaattttaagcaggccttggctgctgagcccaaggccaaggac

SEQ ID NO: 2914 - DNA, 130 bp, Homo sapiens
cacaggtccatataagcatttgcggtctggacgtttcaaaggtattggccataattataataattatagtttggtcagaatgttcagtttgaagatcacccacattccctagactgctttattaacccag

SEQ ID NO: 2915 - DNA, 386 bp, Homo sapiens
cgaggcgccccaccctcgggctcctgaatatcagtcactgttcgtcactcaaatgaatttgctaaatacaacactgatactagattccacaggggaaatgggcagactgaaccagtccaggtggtgaattttccaaggaacatagtttaagttgattaaaaatgctttagaatgcaggagcctacttctagctgtatttgttgtatgcttaaataaaagtaaaggttcataaccaaagagaatccacattagcttgttagtaatgctctgaccaagcgagatgccattctcttagtgatggcggcttagggttttagagaaggaatttgctcacttcagttgagagggtgcagtcagacagctttacttcttttaattaccacggt

SEQ ID NO: 2916 - DNA, 320 bp, Homo sapiens
gagaacatgcctctcgcaaaggatctccttcatccctctccagaagaggagaagaggaaacacaagaagaaacgccttggtgcagagccccaatttcctacttcatggatgtgaaatgcccaggatgctataaaatcaccacggtctttagccatgcacaaacggtagttttgtgtgttggctgctcactgtcctctgcagctacaggaggaaagcaaggcttacagaaggatgttccttcaggaggaagcagcactaaaagcactctgagtcaagatgagtgggaaccatctcaataaacacattttggataaaaaaaa

SEQ ID NO: 2917 - DNA, 250 bp, Homo sapiens
ctttaaccctagaaggtgggacctagggggagggacagggcaggcgggcccatgaagaaagcccctcgttgcccagcactgtctgcgtcgctcttctgtgcccagggtggctgccagcccactgctcctgcctgggtgggctggccctcctggctgttgcgacgcgggcttctgagcttgtcaccattggacagtctccctgatggaccctcagtcttctcatgaataaattccttcaacgccaaaaaaa

SEQ ID NO: 2918 - DNA, 220 bp, Homo sapiens
ctgtggcaaaaccaagatgaagagacgagctgttgggatctgcactgtggttcttgcatgaagacagtggcttggcgggtgcctggacggtacaataccacttcgctgtcacggtaaagtccgccatcagaagactgtaaggagttgaaagaccagtagacgctcctctactctttgagacatcactggcctataataaacggggtaatttatgtaacaa

SEQ ID NO: 2919 - DNA, 255 bp, Homo sapiens
gaaaggtggagtctgggtctggcactagagaatcagtcctgtgtgggggtgtataaaagggaggctcatagtgggactaggagtccagacatttgcataagactcagatataaagcaggtctgtcaatatctcaggtaatgttataatgtaactcagacactgtgcagactgtattggacacccagacagtcaaaccacttctcagtactaattcatgtcttgccggcatcctctctccgccccttgacagcatt

SEQ ID NO: 2920 - DNA, 359 bp, Homo sapiens
  misc_feature 176: n = A,T,C or G
gaaaggtggagtctgggtctggcactagagaatcagtcctgtgtgggggtgtataaaagggaggctcatagtggaataggagtccagacatttgcataagactcagatataaagcaggtttgtaatattcaggtaatgttataatgtaactaagacactgtgcagaatgtattggnaacccagaaagtcaaaacaattcttagtactaattccatgttttgttgttatcctctctccgccccttgaaagcattttattatgaagttatcagtccactgtaggacactgtgtctgaaatattatctgtatataataatttttatataaatgaatacattgaaataatgagaacatgttca

SEQ ID NO: 2921 - DNA, 250 bp, Homo sapiens
atttcatggagcttttgaagtttgtgttataataattatataacttagtaatgatgtaaaaaaagtatttgatattaaaagtttaatattgataatgttgctgattgtaccatttccttagcttcagctgagtcataggccagacctgttgaaatgctgaaatgaagaaggctgttgcagcctcaaagtcagaggactcgtgcttcggacttcttatgcctctagtctctgtctttccagttcacagatg

SEQ ID NO: 2922 - DNA, 280 bp, Homo sapiens
gtgacttcacacgccataatggcactggtggcaagtccatctatggggagaaatttgaagatgagaacttcatctaaagcatacgggtcctggcatcttgtccatggcaaatgctggacccaacacaaatggttcccagtttttcattctgcactgccaagactgtagtggttggatggcaagcatgtgtgtttggcaaagtgaaagaaggcatgaatattgtggaggcatggagcctttgggttccaggaattgcaagacagcaaggagatcaccattt

SEQ ID NO: 2923 - DNA, 215 bp, Homo sapiens
gtctaaggccaaggtacaaggcttactggaccgctgccagaaggtgacagtggtcttcagggcatctggtctcaggtcacctgtgaagtcattcagcctttaccaatcttgtctgcaaaaaaacgagaagacatactgaaggcatgcaagcagatgcaggtgataatattctcgattactcggatggattggagaaatattttgttcctccattg

SEQ ID NO: 2924 - DNA, 225 bp, Homo sapiens
ggtcatacggcggttgtttgaattccgtcggaacttaagggaaactttcacaaatgtcggagccccttaatgtcctcaaaataaggaggaggaatgtcctaaggttccttcagcagatacccatctagggtggcaccattttgaacttccgatatgtaacacgtcacatcatataaaggaattgtaatggacatctatatcataatctacaagaggaccctgack

SEQ ID NO: 2925 - DNA, 143 bp, Homo sapiens
cggcagagggaaggtgctggaacgtactggaaagtgacgcgcatgacggggcccagctaggcgacaggacttgactacatacagaggacgagggacaaaatgatattgacacagggacattacatacataaaccaaaaacaaa

SEQ ID NO: 2926 - DNA, 273 bp, Homo sapiens
gcggaacgaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagttctttgttgactactgcaacaggcttttaaaggagcagttttttcacc

SEQ ID NO: 2927 - DNA, 141 bp, Homo sapiens
tgctttaaatttctccagtgtggcatgtagaaagattagcccttatacataaaggacagatgtttccagttcaaggctgattctcaagtgaaaattgaggaaatttcttctacctgagtggatttggcagtatttcttact

SEQ ID NO: 2928 - DNA, 230 bp, Homo sapiens
  misc_feature 143: n = A,T,C or G
gttgcacagatgctttaaaatttctccagtgtggcatgtagaaagattagcccttatacataaaagacagatgtttccagttcaagctgattctcaagtgaaaattgaagaaatttcttctacctgagtagatttagcagtanttcttactgtttctactcctgaggaatcttgctttctttccagagtgttgttcttactcattaatcagatttttgataaggatggta

SEQ ID NO: 2929 - DNA, 151 bp, Homo sapiens
cgtgcgaaattcggcagaggtctacccaactcaacgtcaagcgggccatcactattgctggcattccacaatccatcattgagtgtcatcaaacagatctgcgtggtcaaattggagaactctctcccagtcccccccgaaggcggtgacc

SEQ ID NO: 2930 - DNA, 128 bp, Homo sapiens
ctcgtgccgaaattcggcacgagccgctgcctgccacaatgtgtgcgcatgaatgtcctggcagaatgctctcaagaagtatcaacaatgctgaaaggggaggcaaacgccagtcgcttattaggccg

SEQ ID NO: 2931 - DNA, 106 bp, Homo sapiens
gctgaactcatgaagaccgattcactttcttggatctaaagagatgagcataggccttcatggatcgagaaaaaggattaaagacgctttgtggaaagcagaaaac

SEQ ID NO: 2932 - DNA, 723 bp, Homo sapiens
  misc_feature 43, 67, 86, 112, 126, 133, 136, 166, 182, 191, 315, 351,370, 381, 385, 388, 393, 429, 445, 464, 465, 475, 485, 499,501, 504, 511, 519, 520, 532, 554, 557, 558, 560, 564, 588,589, 590, 602, 605, 606, 607, 608, 614, 615, 616, 617: n = A,T,C or G
  misc_feature 618, 619, 623, 624, 625, 626, 627, 628, 629, 630, 631, 632,633, 634, 635, 636, 637, 638, 639, 640, 641, 642, 643, 644,645, 646, 647, 648, 650, 651, 652, 653, 654, 655, 656, 657,658, 659, 660, 661, 662, 663, 664, 665, 666, 667, 668: n = A,T,C or G
  misc_feature 669, 670, 671, 672, 673, 674, 675, 676, 677, 678, 679, 680,681, 682, 683, 684, 685, 686, 687, 688, 689, 690, 691, 692,693, 694, 695, 696, 697, 698, 699, 700, 701, 702, 703, 704,705, 706, 707, 708, 709, 710, 711, 712, 713, 714, 715: n = A,T,C or G
  misc_feature 716, 717, 718, 719, 720, 721: n = A,T,C or G
acaaaagctggagctcgcgcgcctgcaggtcgacactagtggntccaaagaattcggcacgaggctnaactcatgcagacgctccnatttcttggactctacacgagatgancatcaggattttanggatgancanaaacgactaaagaagcttcgtggaaagganaaaccaaagaaagganaagggaaangagcagcaaaaaggaaatagtgttggtccctcaagagggagactttcttcctcagtggcggacagaagaaagtgcatttattgtctttccacatattggaggaatgtcatcttcctaaatgaantttatttggaggaacacagtcatctccttggtgaantctaatccggttacattgnggctggtttcntgancanattcnaactgtgcaaaattatcttggccttggccgtgtaangtgaggtttacctggngtctccaaggacctaaatnnctaagttatnaaaagttatnaaaaaaaaccccgngngtnctccaanagcggccnngggcccaccggntttccacccggttggggcccanggnngntttnccaaattggcccaaaattgggccnnnttaaaattcccnttnnnngcgggnnnnnngggnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnntg

SEQ ID NO: 2933 - DNA, 184 bp, Homo sapiens
gttggtgtcttaatatatgtccaaaaagataaaagttgatgaatttgtgactcacaatctgtctttgatgaaatcaacaaagcctttgaactgatgcattctggaaagaggcatttcgaacctgttgtaaagatttaattcaaaagagaaaataatgtcccatcccctcgtgatgtataggggc

SEQ ID NO: 2934 - DNA, 144 bp, Homo sapiens
tggagaaactgaggcccaggccaaaaaatatctcactagagggctcaccgccatttcctggaaaaattggggacttggaactcaacggacgctcgtccagcagcagcgcggagctcccgaagtaaagggcgccccttgaccgag

SEQ ID NO: 2935 - DNA, 196 bp, Homo sapiens
ttgatttgtgtcaggcctctgctgtgtgctttacaaacattatctcagttaatccttgattacagtcctgagagttacttcttcttattgtccccagtttacagataagggaggcttagggamccagagaaattcaagtaacttgccccaggttcacacaagtggtaaggataagccagagttaatgtcatgaggt

SEQ ID NO: 2936 - DNA, 509 bp, Homo sapiens
ttgatttgtgtcaggcctctgctgtgtgctttacaaacattatctcagttaatcctgattacagtcctgagagttacttcttcttattgtccccagtttacagataaggaggctgaggaacagagaaattcaagtaacttgcccaagttcacacaagtagtaaagataaagccagagttaatgtcatgaagtacattgaacttaaccaagaacaaccccttcaatcttccaccacttagtcttctcatgccccacgtgcagtctctttaaattttaagatggaattagaacaggacatagtcttatttttgctaccccaagaacttgctagatgccagatgctccctcaagcaacagattaagaaaaagagaaaccagtaaagctcacacttgttaaatggcaattgggttagcacctcctaaaacagaatccacgagcttctatggataaagctacaaactcttacagcaaggttacttgaaacctgcatcagtagacgtcagtgctt

SEQ ID NO: 2937 - DNA, 315 bp, Homo sapiens
agcgagacttctcagaagccccctcattcacccagcccctggctgaaccacacctccacccctggctacagcacccagttgttctgcagtgtccgagcttcacccaagcccaagatcatctgtgatgaaaacaagatggagatccagggcaaccccaaataccgcgccctctctgagcaaggcgtgctgcaccctagagagtcccgaaacccagcccctttgattctcgggtctacaacctcaagggcataaatagtgctcgggggagggtactctggactctcccgtccgagggtaaaaactcaaacccgaaca

SEQ ID NO: 2938 - DNA, 270 bp, Homo sapiens
agctgctgaaacagctggacgacctgaaggtggagctgtcccagctgcgcgtcgccaaagtgacaggcggtccgacttccaagctctctaagatccgagtcgtccggaaatccattgcccgtgttctcacagttattaaccagactcagaaagaaaacctcaggagaattctacaagggcaagaagtacacagcccctggaactcgcggccttcaagaagacacggtgccatatcgccgccggctctaacacagcacgaggagaaccttt

SEQ ID NO: 2939 - DNA, 309 bp, Homo sapiens
aaaacttcctttctgagaagttagtgttaaggtcttggaatgtgaacacattgtttgtagtgctatccattcctctcctgagattttaacttactactggaaatccttaaccaattataatagcttttttccttattttcaaaatgatttcctttgctttgattagacactatgtgcttttttttttttaaccatagttcatcgaaatgcagctttttctgaaacttcaaagatagagatcccattttttaatgacctcgagtagcaaaatcatctttttcattctttaggggatagctctttccaaag

SEQ ID NO: 2940 - DNA, 325 bp, Homo sapiens
gaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtaatgctgggtctccacgtggtgtgtttcgtgggacaactgtggccttgggatggggcttactcctgtaacttcctcctcccaagggattttgggctttcttgaaaaaaagtccaagccctggataatgctttactttctgtgttgaagcactcttgggtgtttggtagtgactcatg

SEQ ID NO: 2941 - DNA, 210 bp, Homo sapiens
gctctgtcccctaggtatggaatcttgcggcatccacgagaacaccttcaactccatcatgaagtgtgacgtggacatccgcaaagacctgtacgccaacacggtgctgtcgggcggcaccaccatgttattccgggcattgccgacaagattgcagaaggagttcaccccccttgcgcccagaccattgaggtgcaagttcatcgcacc

SEQ ID NO: 2942 - DNA, 174 bp, Homo sapiens
  misc_feature 36: n = A,T,C or G
ctcgtccaattcggcaggggggtaaatcagtaagangtgttatttggaaccttgttttggacagtttaccagtaagccttttatcccaaagttgttgtaacctgctgtgatacgatgcttcaagagaaaatgcggttataaaaaatggttcagaattaaacttttaattcattc

SEQ ID NO: 2943 - DNA, 116 bp, Homo sapiens
gagttgctagatggataggtaggtgattggcagagttctggctggagccgcggcgccaatggtcccacaaggagaaggttaacttggattgattattgaggactattacatgtaga

SEQ ID NO: 2944 - DNA, 1034 bp, Homo sapiens
  misc_feature 36, 50, 54, 56, 58, 64, 67, 69, 71, 75, 78, 79, 87, 88, 102,103, 104, 106, 110, 112, 119, 121, 127, 133, 139, 144, 145,154, 155, 157, 158, 159, 165, 170, 173, 174, 175, 176, 179,187, 222, 225, 227, 229, 233, 241, 252, 255, 260: n = A,T,C or G
  misc_feature 262, 269, 279, 282, 285, 293, 301, 337, 339, 341, 344, 345,349, 351, 357, 369, 373, 382, 386, 399, 410, 411, 412, 425,444, 451, 452, 455, 461, 469, 480, 505, 507, 508, 510, 518,523, 531, 537, 546, 560, 564, 570, 589, 591, 593, 600: n = A,T,C or G
  misc_feature 611, 618, 625, 632, 640, 646, 652, 657, 673, 677, 686, 691,692, 695, 700, 708, 713, 714, 718, 737, 740, 741, 747, 748,749, 753, 763, 767, 773, 782, 783, 787, 790, 794, 806, 821,827, 835, 838, 842, 851, 852, 858, 866, 872, 879, 895: n = A,T,C or G
  misc_feature 911, 918, 919, 920, 923, 936, 948, 953, 955, 963, 974, 983,989, 993, 1000, 1004, 1012, 1014, 1020: n = A,T,C or G
tcgcgcgcctgcaggtcgacactagtggatccaaanaattcggcacgagnactncngnacaggnggnangnaggncanngccagganntgctccgctgaagnnncngagntncaatgtncnaaaggnagagtnacaacnggggnncaaacagcnngnnncttttngaagnacnnnncangttgcatnacataaacagtacaactggtacatcaattaaatanatngngnctcnaaccccgngggacaacggnganaaaancntcggacnctaaaaccanttntcnccgaattngtggatgnggcaatccggtcgaagtaatcccccggggtgaaccntngngannggcncncgttcncccctgaaaggnttcnggaagggantccnccttggaggtccntgggaaagggnnncccaagccttggnaatttggaaaccttatggnaaacccnntgngaaaanatgggganttttcccaaanccccttgggagggtggtccccaaantnncnaaaaaganacccnttttgggncccccnaaagggganttaaatttttaaangggntttacnggttgtaaattaaaaaggntntntttgccnatgcccccacntttaatnaaaacgnccaacantttcaccnggggtncctatnttttnccgttttttttttacnaaanttttttccnaaccnnagntcctncccaaagnggggnntttnccccaaaggggtatttccnaanntgcccnnnattngggccaaaangggnttttcnggggggccnnaaanggngggnaaaaccattttntgggccacccccccnaaagcnaaaccttntgngaanattctttannggggcnaaattccncccacnaaggggngggccccaaaattctnggggggttattttttnggggaannnccnccgggggaaaaanccaaaagggggnttttncncccaagtnttggcccaaanaattggggncccccngaantttttcngggnccccaaanangggggncaacccccccaatt

SEQ ID NO: 2945 - DNA, 262 bp, Homo sapiens
acctgtggtcacctggccctcctgtggtctgagtaccactcccctgccccaggagccactcccactccagctgcctgtttccagcaggttcccagtgtccccgacaagcccctgctggtgtctccatctcctgccaagcatcctccagtgcctcctcctgtgggcctggcctcagggctatggacagactcctgtcccatcccagagacccctcgtgatcgtgccctggcatgggcccgtgccgccctgggcggctgagaac

SEQ ID NO: 2946 - DNA, 170 bp, Homo sapiens
gatgctttggcaagatggcggggagcggcgtccccaaagctacttctaccgccagcaccttcgtgaagcccattttcagtcgggacatgaacgaggccaagcggagggtgtcgcgagctctaccgcgcctggtatcgggggtgccgaacactgtccaccaattccagctg

SEQ ID NO: 2947 - DNA, 130 bp, Homo sapiens
gcagaatacacatttttttcgtcagcacatgaaacattttctaggaaaaataaaggcaaacatacaatgtcaaagggaaagaaaagtaatgagaagtactgccaacccacatttatgaccatatgttgag

SEQ ID NO: 2948 - DNA, 180 bp, Homo sapiens
agaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggcttgattattggcgttttttacaaaa

SEQ ID NO: 2949 - DNA, 175 bp, Homo sapiens
gctgtggaggaaattcgtgatgttagtaaccttggcatctttatttaccaactttgcaataacagaaagtccttccgccttcgtcgcagagacctcttgctgggtttcaacaaacgtgccattgataaatgctgggagattagacacttccccacgaatttattgttgcagcacc

SEQ ID NO: 2950 - DNA, 180 bp, Homo sapiens
ctctcctgtcaacagtggccagccccccaactatgagatgctcaaggaggagcacgaggtggctgttctgggggcgcccaacaaccctgctcccccgacgtccaccgtgatccacatccgcagcgagacctccgtgcccgaccatgtcgtctggtccctgttcaacaccttctatatgac

SEQ ID NO: 2951 - DNA, 105 bp, Homo sapiens
attgtctctgtgtaagcacagtatacactattacatgcattaggtgtcaaatgcaaaaaaaggcattatttaaccactatatatgtttggtttagtcatctggca

SEQ ID NO: 2952 - DNA, 86 bp, Homo sapiens
ccaaaattgtcatactgttgttaagcaacagtataacaactatttacatagcattaaggttggtgcaaaaatgcaaaaaaaaaaaa

SEQ ID NO: 2953 - DNA, 175 bp, Homo sapiens
aggcaggttggagccgctgccgtcgccatgacccgcggtaaccagcgtgagtcgcccgccagaagaatatgaaaaggcagagcgacttaggttaagggaaagcgccgagatgacgggctttctttctgccggcccgcaagcagagggacttggagatcatgcagcagaggcagaa

SEQ ID NO: 2954 - DNA, 225 bp, Homo sapiens
gtggaagctcctatgagggaggaatatgcagacttcaaaccatttgagcgagtatgggagtgaaagatagtaaggaagatagtgatatgttggctgctggaggtaaaatcgagagcaacttggaaagtaaagtggataaaaaattgtttgcagatagccttgagcaaacttatcacggaaaagatagtgagagtagtaattatgatacttcttctcccagtacgc

SEQ ID NO: 2955 - DNA, 270 bp, Homo sapiens
gcgtaagtcgcttgtccgtggcttctctgagaagaaaagttgaaaaagggtaaagtttcaggaatattcgggctctctatttctaagcatagcgaggtgttcggttttctctctccaacagacatcgctattgcggttccgaggcagttgggagagatgccgcccctggacatcgtcgagctggcggaacccgaggaagttgaggtcttgagcccgaggaggatttcgagcagtttcttctcccggtcatcaacaaaattcccagacatc

SEQ ID NO: 2956 - DNA, 295 bp, Homo sapiens
gttccttgtcgggtgaccgtgctgtcggccaaagtcacgctccacagggtattccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccacctgctctacgtggcggttcccagtggccctccctcaacaaccatcttggcttctacaaacaaagtaaaagtgggggacgacatcagtttctc

SEQ ID NO: 2957 - DNA, 275 bp, Homo sapiens
atcaacgccctgtgcttcagccctaaccgctactggctgtgtgctgccacaggcccagcatcaagatctgggatttagagggaaagatcatttgtagatgaactgaagcaagaagttatcagtacccagcagcaaggcagaaccacccagtgcacctccctggcctggtctgctgatggccagactctgtttcctggctacacggacaacctggtgcgagtttggcaggtgaccattggcacacgctagaagtttttggcagactttacaaataa

SEQ ID NO: 2958 - DNA, 285 bp, Homo sapiens
gtttgacaaaataagaatccatgagtccagactgatataaattaatgagtgaataatgaataggtgatttgagaagaaagggaaagcttctctttcacaatagaatgcccaattaacaaatacaaaggggaccaatggggttaggaaagagttaggacactacccttttgcagcaattacaataataattaggttaggtgaagatcatgaatgggggatacatttacggggacttttttatgaggaactggatattacatagcctcacagtgtttctcataggca

SEQ ID NO: 2959 - DNA, 664 bp, Homo sapiens
  misc_feature 14, 40, 41, 47, 83, 93, 123, 197, 249, 274, 282, 296, 300,302, 322, 365, 385, 400, 403, 427, 455, 470, 475, 479, 490,493, 501, 504, 505, 548, 561, 565, 569, 572, 578, 579, 580,581, 582, 583, 584, 585, 587, 590, 597, 598, 601, 603: n = A,T,C or G
  misc_feature 604, 605, 606, 607, 608, 609, 610, 611, 612, 613, 614, 615,616, 617, 618, 619, 620, 621, 622, 623, 624, 625, 626, 627,628, 629, 630, 631, 632, 633, 634, 635, 636, 637, 638, 639,640, 641, 642, 643, 644, 645, 646, 647, 648, 649, 650: n = A,T,C or G
  misc_feature 651, 652, 653, 654, 655, 656, 657, 658, 659, 660, 661, 662,663, 664: n = A,T,C or G
gtttgacaaaatangaatccatgagtccaagactgatatnnattaangagtgaataaatgaataggtgattgagaagaaaggnaagcttctcntcacaatagaatgccaattaacagatacanaaggaacaatggagttagaaaagagttagaacactaccattttgcagcaattacaataataattagtttaggtnagaatcaggaatgggtgatacatttacggagactgtttgatgaggaactggntattacatagcctcacagtgtttcncaaaggcnatttccaattctanaggnanaataggaacttcacagtaanaagcatggtgggcaccaccttaaccaaatgattcaagttatcnataacaacgggacaatctgncatgtgtttcccaanatnccgatgaaaaagagcatagcatcncaattttcaacatttatccaagcaatcnaaacaaaaaaaaacnccggngtcntctaaaacggnccngggcccancgnntttccccccgggggggggcccaagggaagtgttcccaaattcncccaaaagggggnccgnttanaantccccnnnnnnnngncgnggggggnnggngnnnnnnnnnnnnnnnnnnnnnnnnnnnnnnnnnnnnnnnnnnnnnnnnnnnnnnnnnnnnnn

SEQ ID NO: 2960 - DNA, 195 bp, Homo sapiens
ctgaaacatacaatattgtatttagtttcagtagtccgattagtatatacagaggtcttgtgccctcctccccctgaaaaaaaaaaaagccccttttttgtgtctatttactgatctgctcttcccttgtaactccccaaacccctcaacctactgggtaatatggaaggagttcatttagcccaatctgtttat

SEQ ID NO: 2961 - DNA, 550 bp, Homo sapiens
ctgaaacatacaatattgtatttagtttcagtagtcctattagtatatacagaggtcttgtgccctcctccccctgaaaaaaaaaaagccacttattgtgtctattactgatctgctcttccttgtaactccccacccccctcacctactgagtaatatgaagaaattcatttagcccaattctgtttaatacttagtctatctaataatttaaccaggtctcaggataaaatgcttagcctctcttacttctactttctttctcttacttgaacacgcatcctcctcaggttggcatcatggtttatgggaggagaggtgtcccctttcacagtattgttgagttggtgaatgacctcatggtagcctggtgaagcctcttgagttcttgtcgtccctctagatctttgccatttgagctataaagtggctggtctggcaaatagcctgctatgactgacctggtaacctgggcattttgctggaaccattgctgacacctgcagttgatgaactaacctgtgatctctttgttggcttgacaagggtc

SEQ ID NO: 2962 - DNA, 191 bp, Homo sapiens
tggatccaaagaattcggcacgagtgaaagcacatgtttcagtgccactcacataagaagtgcccggtaagtgttagctattattgtctactttgagttactacctttctaaaagtatggttgaagtcttttttctggtaattgcagatttgttgatcttgcatttgagtattttctatattttgaggctg

SEQ ID NO: 2963 - DNA, 240 bp, Homo sapiens
gatctaagcagcgttcccacagccccctctagattcttggagttccgcagagcttactatacgcggtctgtcctaatcttttgtgggtgttcgctatctcttgtgtcaaatctggtgaacgctacgcttacaaatattgtctttgtgctgctgtgtgacaaacgcaatgcaaaaccaatcctctttctctctcttaatgcatgatacagaataataataagggtttcatctttaaatgaa

SEQ ID NO: 2964 - DNA, 125 bp, Homo sapiens
ygcacggtagccagtggcgtgcagcacggctgaggttgcacgcagcgagaatgtcatggagttgaggcggcacgctacttgctcgagatgattttatgaagctgccgagtaagagtcgtccttca

SEQ ID NO: 2965 - DNA, 323 bp, Homo sapiens
tgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttaaaaaaaaaaaaaaaaaaa

SEQ ID NO: 2966 - DNA, 140 bp, Homo sapiens
acgcaagcatggttaacgtccctaaaacccgccggacttcctgtaagaagtgtggcaagcaccaaccccttaaagtgccacagtacacgaggggcaaggatttctctttccgcccagggcaaagcggcgttatgacagga

SEQ ID NO: 2967 - DNA, 100 bp, Homo sapiens
tgacttaggaaggagctacgccagagactggcttctctccggaggccaaaccaagagggtttgcaaagtaagctaaggagacctttccctcctaacctgg

SEQ ID NO: 2968 - DNA, 306 bp, Homo sapiens
gtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaaaaaaaaaaaaaaa

SEQ ID NO: 2969 - DNA, 120 bp, Homo sapiens
cagccgctgaaccgtagagcatttctttggcttggacctggttggccgggttctaagaaaagccctttgtttacgtatatacgctttcccactcaggagccgtttccaagcctcggtaca

SEQ ID NO: 2970 - DNA, 480 bp, Homo sapiens
ggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttg

SEQ ID NO: 2971 - DNA, 130 bp, Homo sapiens
acataattatgtagatattcaccctacccaagatcctgacacttaccatgtctattttcccgatcctcagtcccacattgtgcttggaattgaggtacttggaaggggctgagttaggaggggccagcac

SEQ ID NO: 2972 - DNA, 490 bp, Homo sapiens
cctgcctacatcaatttatgttagattattcccacccctaccccaagatccctgacaacttacccatgtgctattttccccgaatcctcagttccccacactgtgcttggcaatgaggtacttggaaaggggctgagtgaggaggggccagcacttccagtccaagggtctccacttctccctggcatgctggaagagaccagagctcactgtcccacccaggttctatgagactaggcatggggcaatgggctaggccatcagcctccaactatgtggctctgcaatgagcagaaatcccagccctggaagcgcacccacgaagcccatgctctgtgtccgaaaagacactcccagcaggcacggcgcctgcgcaatgcctgcagccagctgcctgtggtcccgggaatggctctgttgactaatttctgtacataattccacccaggatgagtcaacagtcagggcaagcaggactcctcacaggctg

SEQ ID NO: 2973 - DNA, 110 bp, Homo sapiens
gacataggagggcccgacaggaattcggtgtgacataggccggcttcttttgtaaaacctgacccagaacacacaatcgtgcaacccaaggcccaagtctttccaattta

SEQ ID NO: 2974 - DNA, 121 bp, Homo sapiens
ggaggcatcctcctgaccagcagaggttgatctttgctgggaaacagctggaggatggacgcaccctgtctgactacaccatccagagagagtccaccctgccacctggtgctgccgtctt

SEQ ID NO: 2975 - DNA, 114 bp, Homo sapiens
gagcctccagaacctgctttcctatgtttacccaggggacctcctttcagatgacctcgggaggagatgaaatgttttttcatatttaaataaataagggccattaaaaggcaa

SEQ ID NO: 2976 - DNA, 107 bp, Homo sapiens
aaggaggttgtattttctcctttcttaagagtcctcacagcgttttgcatgacagtaaatcaagagagattactcattgagggttgattgagtagatgccctaaaaa

SEQ ID NO: 2977 - DNA, 117 bp, Homo sapiens
gtttgaaactactttattttactaatttaaactattttgtactgatgtagccctgggtaggttcaatgaaaatggctgtggcactcattccatgggataaatgttggggaggctgga

SEQ ID NO: 2978 - DNA, 122 bp, Homo sapiens
gattttttggccttagctacaggagagaaaggattttgcctacaaaaaacagcaaattccatcgtgtaatcaagggccttcatgatccagggcggagacttacaccaggggagattggcaca

SEQ ID NO: 2979 - DNA, 225 bp, Homo sapiens
ccttatttaaaactcacctcccaatcaccccaaacaaatggaagagaagagaaaggacatggcgtattttgtatttaaaagtaattgtattaattatttaaagttgtggaaagcaaaataacaaaaaagagaaacgccaacaaaaattcagcagatttttgaagacaggggtttcgggggtgggcttccggcacccacatcctggagtcaggactttctcagtta

SEQ ID NO: 2980 - DNA, 104 bp, Homo sapiens
gagattgtaaatgaaaaaaatatagaaactatttagttttggtagattttttttcctgacaatgtgaccagactgaatttcctcataaagaaaaaatggcgtgc

SEQ ID NO: 2981 - DNA, 320 bp, Homo sapiens
actgctctcttccaaaacaaaactcagcatgatactttgagattgtgttctgagagatgatatgactacataaaatacaattaaaaatgttataatataatgaaaatgtagtaatttaagagaacaccagatgagttaggaataaacctataacatttacaaaaagagcaaaactaagtgatagaaaatatttcacacatgttcttatagatcatgtatcacttgcaagttttaggagttcatatcctatatcatttcaaattaggtccataataaggtaaatttttgaaatgaccactttgggttttttcccaagttta

SEQ ID NO: 2982 - DNA, 181 bp, Homo sapiens
cccgttccacggaggccgcggggtgggggcttgggggggggccgccgaccgttccgctcttccggccaggtgcttttctgtcaatttctatggaatgcaaaaggaggtttttgttttattttgtttttttgtaaagcttaagaaaaaaatctacatctttatacttgagcctcccatactt

SEQ ID NO: 2983 - DNA, 275 bp, Homo sapiens
gtggagtgatcccacaacgtaagacggccgtttcgacaatccgccccggcccttaagatgtcggccaccttaatggcaacagcacggccatccaggagctgttaagcgcattccgagcagttcacggccatgttccggcgcaaggccttcctgcactggtacacgggccagggcatggacgagatggagttcaccgaggccgagagcaacatgaacggccttggtgtccgagtaccacagtaccaggacggcaggccgacgacaaggggagttcg

SEQ ID NO: 2984 - DNA, 235 bp, Homo sapiens
agtttcgtcagattctccaggggttccaagggcgaaagaaccttaagcctaggccttttgagattggaagacttcactaatactaggcacactgtgattcttcactctacacaacaacttactcttggacatccggcatttctttctttgtgtgtcttctcggtcttgtttcagggatcttgagagaagcaaacgtaactttcttcatgcctacatatttcctttcggttggctt

SEQ ID NO: 2985 - DNA, 217 bp, Homo sapiens
aagaaatgtaggtggataaattaatatgtaattaaaggtgaaaaggcagaagatatgtaaacacaaacatacttcatagacctaggaattttgaaggagtaactcgtgctgtaaggagggaggttaaggtttcatcctctgaaacctctttcaaatttagcaggctataactctcaccctcacttttaggtcaatattggagaatatctcgctagga

SEQ ID NO: 2986 - DNA, 288 bp, Homo sapiens
ccagcactactggaaaatcagccaatcttaacccagatggccatgaattcctgtatgtgaagacggtcttaagggtgttttgtttgtttaatcaagcctcttgttttgagattttggcatacaattctgttttctagggaatttctgtgtcctatgggaggaggtctaataaggattggatgcttccatttctgataggaggaccaataggattattggaggctacaaaggcttttggtgagacacctcgtggtagtgtactatctggactctgagctgcattataac

SEQ ID NO: 2987 - DNA, 265 bp, Homo sapiens
cttttactaaatatacaagatttactactagaaatttcgagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgatatatatgagttacttgaatatacacaatgaattttgtttgatagatttatattgtacctt

SEQ ID NO: 2988 - DNA, 130 bp, Homo sapiens
gttcaggattcctggtcccccaggaaagccagttatatacaatgtgacttctgatgggcatgtcactaacttgggatggctccaggtttatgatgggtggttcagaggttactgggattgccatgtttga

SEQ ID NO: 2989 - DNA, 280 bp, Homo sapiens
gacaaagccaaggcacccctagagagcttctccgagagccgggcagagaagatgggccagaatctcaaccggtattccatacaaggacacattctggagggggaccacccgcactcggccccgaaatggaacctgaacaacactctggcattgacttcaaacagcttaacttcctgacgagctcaacgagaatcactctggagagctatggagggccgctgcagggcaatgacattgtcgtaggtcctgaaggttcgagctggagtacaaggaagagcag

SEQ ID NO: 2990 - DNA, 290 bp, Homo sapiens
ctagaagtcccactcctaaacacatccgtattactcgcatcaggagtatcaatcacctgagctcaccatagtctaatagaaaacaaccgcaaccaaattatttcaagcactgcttattacaattttactgggtctctattttacctcctacagcctcagagtacttcgagtctcccttcaccatttcgacggcatctacggctcaacattttttgtagccacagcttccacggacttcacgcattattggctcaactttcctcactatctgcttcatccgccaactaata

SEQ ID NO: 2991 - DNA, 305 bp, Homo sapiens
gagaaacaaatatttacttagagtggaaggactgattgagaatgttccaatccaaatgaatgcatcacaaccttacaatgctgctcattgttgtgagtactatgagattcaaatttttctaacatatggaaagccttttgtcctccaaagatgagtactagggatcatgtgtttaaaaaaggaaaggctacgatgactgggcaagagaaagatgggaaactgataaagcagttgatcagcatcattgggacatggggacgagttacggcaggaggaccacgaggaatacctcaaaactaacttgt

SEQ ID NO: 2992 - DNA, 190 bp, Homo sapiens
  misc_feature 38: n = A,T,C or G
cttctcagatactggaaactttggttttgggatccagnacacatcgatctgggtatcaaatatgacccaagcattggtatctacggcctggacttctatgtcgtgctgggtaggcaggtttcagcatcgagacaagaagcgcaggacaggctgcatttgggcaaacacagaatcagcaaagaggaggcat

SEQ ID NO: 2993 - DNA, 190 bp, Homo sapiens
gtgagtcagcatttacattcccaccagatgtgttccaggttcttgtcatactgcgttcttgccagcgctttggtgctgtcagtcttcttagtttccatttagagattcagtttttaaacttttgaacgtcttgggttacaccttggttgagaaagtaagaaaagggcctgctttctattggccattttga

SEQ ID NO: 2994 - DNA, 245 bp, Homo sapiens
cggcggcgtcggcagcagtttcgacggcagccgcggcggcgggtgggaaattgcggagtatcttggcctccatcttcggcacccagaaagacaaagtcaactgttcattttatttcaaaattggagcatgtcgtcatggagacaggtgctctcggttgcacaataaaccgacgtttagccagacattgcctcttgaacatttacgtaacctcaaactcttccagtctctgacggtttgcgctgtg

SEQ ID NO: 2995 - DNA, 205 bp, Homo sapiens
aaataattttattctatataagtgtaaattattgataccagattcactggacagtttcacctgataatttatgacaaagacatacctctaatattgaaattaaaaggtgaaatttgtcataaagatttcttttatttttgaaatcgagtttgtaaatgtcctttaagagggagatatgaatccataaataactcaagctttgcta

SEQ ID NO: 2996 - DNA, 105 bp, Homo sapiens
ccagtatattattttggaggagttaagttaattcatgtaccactagaacgcaggcaacacagagttatatctcctacctttaaaggcctcatagattcatctcca

SEQ ID NO: 2997 - DNA, 325 bp, Homo sapiens
ccagtgcgtctgtcgcacgtccccgggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaagaaaatgacattattttgaatggtactttgtggaaagaggggagaataaagttatgctgtgtacatcacttgcagatcaccaaaaccactcgctgcccgtgaccgcgggggtgtgtcccgctcccgtcgtccgccaacctaaacc

SEQ ID NO: 2998 - DNA, 180 bp, Homo sapiens
cgcacgagctttgcccgggtgccagtgcaacctacaccactctgacaacccttccgctagagagcgcagtttagccggcagtatgccacatttatgccaaccgcctcatccaaatgagacccttcctggagagccgggcccagcagcactggggcagtggagtggagttaagagctgttt

SEQ ID NO: 2999 - DNA, 305 bp, Homo sapiens
caaggatgcactatggatgctatcaaagtatactgtgatttctctactggcgaaacctgtatccgggcccaacctgaaaacatcccagccaagaactggtataggagctccaaggacaagaaacaagtctggctaggagaaactatcaatgctggcagccagtttgaatatatagtagaaggagtgactcccaaggaaatggctacccaactcgccttcatgcgcctctggccaactatgctctcagacatcacctacactgcagacagcattgcatacatggtgagggactggcacctgaaaag

SEQ ID NO: 3000 - DNA, 269 bp, Homo sapiens
gttttacatggctaattcaaagtacagcttattgatttaaggataaaacatcatacctgttaaacaatgtagcttggcacccatttgacttaggagaaatctaattcaatacagccaaatgttttatatatacaaaggaaagtactaagacactacgatgaagattaacaagtagtttttaaggctacattgcagacatgtttacatcactaagtatgttttgcttaaagtgttctagatttcctgagttattaaaatatataacccaa

SEQ ID NO: 3001 - DNA, 279 bp, Homo sapiens
acgtgcgtgcatgagtgggagagcacagcgagatgcctattctactgacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcacgaggctgggttttgggggccaagtcgcttgttcattccagcatctaacatcataaaggtgggccc

SEQ ID NO: 3002 - DNA, 139 bp, Homo sapiens
gagtccttgccatcctaaagccacccacttctctctaaggagaatgccagtcctctccaagtccacacaggggaggtgatagcattgctttcgtgtaaattatgtaatgcaaaatttttttaatcttcgcctcaatact

SEQ ID NO: 3003 - DNA, 102 bp, Homo sapiens
ggcggaggtgcaggttcttgtgcttgatggtcgaggccatcttcttggccgctgcgattcgttgctaaacaggtactgcttggccggaaggttgttgttcgt

SEQ ID NO: 3004 - DNA, 126 bp, Homo sapiens
gtaataatgtaatacatttttagattttagcagtacagaaaactccttcatataaggtcatgtttgagtcttataatacctcatatgttgaggcaggccgaaatttttctgatattatagacaagg

SEQ ID NO: 3005 - DNA, 130 bp, Homo sapiens
ctagctatatccagcactttggagccagcagcagatcatttaggtcaggttagacagctgccaacatgtgaactgaacccacttacaaaaataaaaattagcagtttgtgtgcatgcttagtccagctac

SEQ ID NO: 3006 - DNA, 170 bp, Homo sapiens
cttgagcgagctgaaggttgccgggcatgaaagggaagaagagcaggcaaattaggtgcatggggaaccttgggtgagaggtcttaggggcggaggagctctggggggatttcagaaggcaagggaaggagctagtcctccccccaggaaagcagcaaggaggagcccct

SEQ ID NO: 3007 - DNA, 135 bp, Homo sapiens
gtaacttagcagatggttctaggacgtccgctgaccaccgcgttacgccgcatattggtcccgggaaagcatttgcaaatatgacgaattaaggggacaattgttccacagagcggccccagaccccaactttgt

SEQ ID NO: 3008 - DNA, 169 bp, Homo sapiens
ctcgccaatttgggggagggaaaaagggttccagtccccgaaggcctgggacctggacgcctgggatacaatgaggccactctcggacagcgagtacagagggacggagaggcccagggcttctttccacggaggaggaggcaggcggctgtcccaagagacccagccc

SEQ ID NO: 3009 - DNA, 200 bp, Homo sapiens
tcaacccggccatgtctgaccccaatcggccaccatgtcgcaagaatgatgatgacagcagctttgtagatggaaccaccaacgggtggcttttggtacagcgtacctgggagggatgcaagacttcaattaccttagcagcaactgttttgagatcaccgtggagcttagctgtgagatgttcccacctgaagagactc

SEQ ID NO: 3010 - DNA, 270 bp, Homo sapiens
cgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatcccgagatctcagccatattggagatgctgttgtaatttcctgtgcaaaagacggagtgaaattttctgcaggtggagacttggaatggaacattaattttca

SEQ ID NO: 3011 - DNA, 165 bp, Homo sapiens
atggtttaaagcttgcagtaaaaatgccaaacactgtagtaccttggaacccaggtttattcttggtgctaagcagaactgtaaaatagttaaaatgtcttatcaagtaattcggcgattacaaagacaccattttgttttttattcaattctctgttttaactc

SEQ ID NO: 3012 - DNA, 290 bp, Homo sapiens
aggtcgacactagtggatccaaagaattcggcacgagaagctatggaataccctgggtgtktgcaaatacactktccaggatgagagccactcagagtgggtgtcttgtgtccgcttctcgcccaacagcagcaaccctatcatcgtctcctgtggctgggacaagctggtcaaggtatggaacctcggctaactgcaagctgaagaccacccacattggccacacaggctatctgaacacggtgactgtctctccagatggacccctctgtgcttctggaggcaaggat

SEQ ID NO: 3013 - DNA, 175 bp, Homo sapiens
cggacattcagactgagcgtgcctaccaaaagcagccgaccatctttcaaaacaagaagagggtcctcctgggagaaactggcaaggagaagctcccgcggtactacaagaacatcggtctgggcttcaagacacccaaggagcgctattgagggcacctacatttgaaagaaat

SEQ ID NO: 3014 - DNA, 395 bp, Homo sapiens
tgtttatcttgtcatattgccacaaactcaaggaactagagagaaagagaaaccagaagagccacctcaaaggagatagcagggcagtgaagaaaatgtttgagggtcttgaaaacaaaccatctggttacccagaatagaacataaggatattactgtccacatggctcattttagtttttgaacactgaggtdacagagataaaatataaaggaaaattgggaaatatacatcacaggcacaggtttgtgttcttactatgatacaagtattttgatcttagattagttgttctctagctatcaaagaaagctttgctttcagaccaggtcactatgcagtgagtcaatgttcttttacattataatttatggcctcctttgaaaagcttctg

SEQ ID NO: 3015 - DNA, 292 bp, Homo sapiens
gtcggggaaaatttagtgttatccaatgtatgatgaaatattcagctctcacaaaaactggatgtttggctattttaaaatggctgttcttcacaataaaactacaaacagacactgtcgaataaattgagtgataagtatgtctatttactaacatgagccaatttgaactttagttttgagatctaaaaatattttaatccacatgcatttagtgactaagaaattgaaggcagtgtccttttgacaaccaagcttattgaaaactttggcattaatgtccacaaccatg

SEQ ID NO: 3016 - DNA, 257 bp, Homo sapiens
taatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacacttgaccaaaatttgtcacagaattttgagaccattaaaaaggtaaatgag

SEQ ID NO: 3017 - DNA, 372 bp, Homo sapiens
atttcggcagggaaggacatgaggcttccctgaagcaaggatttcagccagatgccatagaccctcagatcttgacctggaagtccagacactgaacgcaggcctcaaaactgctgcggccttccaactcctggtatctgcatcggcgaatggcccttcttgccttgatccacagggatggggaagggaatgtcattaatgttttgttaatactgattctttcatgcaatgatgtgtattttccattctggaggctgtgggagatgacaagacaatgaatgggaggtctgacacagaccaaatcagcggttcttaaagctttggggatctcagactcctttgagattattggaaatggccccctatacttgg

SEQ ID NO: 3018 - DNA, 210 bp, Homo sapiens
gaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacactcaaaaaggataaaatttaatcactgttttgtttgtg

SEQ ID NO: 3019 - DNA, 333 bp, Homo sapiens
tgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgactgtcttaaggatttgtttaaccagctaagttacttgattaaattatgataaattgt

SEQ ID NO: 3020 - DNA, 290 bp, Homo sapiens
atggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaacctgtgtagtctggcaggaagtggattatctgcctcgggagtgggaattgctggtacaaagaccaaaacacccaaatgccaccgttgccctgtgggtaggatctgtttctctcactttgccttcttgcttttccatatctgtaa

SEQ ID NO: 3021 - DNA, 103 bp, Homo sapiens
  misc_feature 96: n = A,T,C or G
gtacttctagagcggccgcgggcccatcgattttccacccgggtggggtaccaggtaagtgtacccaattcgccctatagtgagtcgtattacaanacacttg

SEQ ID NO: 3022 - DNA, 272 bp, Homo sapiens
ccttgtctgtggagacggattacaccttcccacttgctgaaaaggtcaagggccttcttggctgatccatctgcctttgtggctgctgcccctgtggctgctgcaccacagctgctcctgctgctgctgcagccccagctaaggttgaagccaaggaagagtcggaggagtcggacgaggatatgggatttggtctctttgactaatcaccaaaaggcaaccaacttagccagttttatttgcaaaccaaggaaataaaggcttacttcttt

SEQ ID NO: 3023 - DNA, 420 bp, Homo sapiens
ctcgtccaaattcggcacggaaaacttttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaacatcacagcttgcctgtggggaccatcagcctgtgggtggtgatcgcctttctcgccagcatccctcgcttcatctcagctgtggtc

SEQ ID NO: 3024 - DNA, 318 bp, Homo sapiens
gcagtcatcttcatcaacacccggagaaggtggactggctcaccgagaagatgcatgctcgagatttcactgtatccgccatgcatggagatatggaccaaaaggaacgagacgtgattatgagggagtttcgttctggctctagcagagttttgattaccacttacctcctggccagaggaatttatgttcagcaggtttctttagtcatcaactattaccttccaccaacagggaaaactattatcacagaatcggtcgaggtggacgttttgccgtaaaggtgttgcttttacatggtgacagaggagacagagg

SEQ ID NO: 3025 - DNA, 290 bp, Homo sapiens
ctgtattctccaggaacttgtccttctggaatcatattgaatgatatttctatatcgaagtgaggtaggtgcggtattaaagtgaaagggaaggtgatgcatttattctgggttatgcttgcaagtgttagatggctaagtattaaaattatccaaattaaatccttagcagtcagaacacttgcttcactagagtatgccacctgccactcatgttggactgagctaatttgttcctctttctgaaactattaaggtaaataattaacaataaaaatctcttataaagg

SEQ ID NO: 3026 - DNA, 168 bp, Homo sapiens
gcacgagcagaggtggaggtgggctgatggcctggctgcctggtggttgatggttttgctccccctaccttttttttttgagtttattctgattgattttttttcttggtttctggataaaccaccctctgggacaggataataaaacatgtaatatttttaagaggg

SEQ ID NO: 3027 - DNA, 220 bp, Homo sapiens
cctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgggctgaat

SEQ ID NO: 3028 - DNA, 105 bp, Homo sapiens
gtcggggaaatttgatgtttccatgtatgatgaaatattcggctctcacaaaactggatgattggctatattaaatggctgttcttccaataaaactccaaccgg

SEQ ID NO: 3029 - DNA, 220 bp, Homo sapiens
ttgaccctttggccacaggagaacgtgcccagtttttcttaaagaccacgtgggaactcagcagcccatgattgtaggttcctytttccctcatagagtggccttcaagggcaggttcttgttatctgcgtttcagagaccaaagggacacaggcatttctgctcctgggaatttgcggactttgaatcttgagctcagattttggtctctgttggttgc

SEQ ID NO: 3030 - DNA, 200 bp, Homo sapiens
gttcattattctttataacatttgagagaatcagatgtagtgatatgacagggcttgggcaagaacaggggcactagctgccttattagctaatttagtgccctccgtgttcagcttagcctttgaccctttccttttgatccacaaattacattaaaactctgaattcacatacaatgctaattttaaggccaatagat

SEQ ID NO: 3031 - DNA, 130 bp, Homo sapiens
aaacttaccttttgttattgagcaggcctatctctttcagatagttttatgattcacacaggtttgaggatgctggggagagggggagggggctgttggtggtgttctgttggttacaagaaagttatac

SEQ ID NO: 3032 - DNA, 179 bp, Homo sapiens
aaaggaggaggtgggcgtagaggtgaagctgcgctccgatgagaagcacagaagatgtctgctactccatcgggctcattatgaagcataagaggtatggctataactgtgtgatctacggctgggaccccacctgccatgatgggacacgagtggatccggaacatgaacgtccacag

SEQ ID NO: 3033 - DNA, 250 bp, Homo sapiens
caggaggagcggcttgctcgctggccttgcggcgctcctcagggagctgggcgccacgagagatcctcacccgggtctctcctcagggatgacatcatccgttcacctccttgtcttcaaggaccacctcctctccattcttagctgctgccaaggggcctcctgccatctcacttacgagggcactaggagcacggttcctggatccaccacattcaaagcagccacttacttacccccaggaccagga

SEQ ID NO: 3034 - DNA, 100 bp, Homo sapiens
  misc_feature 70: n = A,T,C or G
ccactgtgggcctctccaagcgtcctgcacgtgtcccccgtagctttaccatttagtgagggagcagccnagcggtcggagggggtcttgtcttgggtct

SEQ ID NO: 3035 - DNA, 120 bp, Homo sapiens
gtgacctacggagcagttgtgagctctctgaccagaattcaaaatagcagttttacagagactcagggatcaacaaggacacagaattcaccttctgaaatttatcagagaaatttaaca

SEQ ID NO: 3036 - DNA, 159 bp, Homo sapiens
ttttcatttcatcttcagacaccacaagctttattatcaaggagtcttgtggctcctacttgagtcttaccccataccaggaagagtttaagaacccagggtcttagtccaaatttggggccaggctgggtgcagttgcttattgcctataatcccacc

SEQ ID NO: 3037 - DNA, 160 bp, Homo sapiens
gaacctagtctcgagttgtttttaatcttgtaaaacatgcttggtggttgtgccagtatacgtgaatatttgtatggtgtttggtgatttgtattctaggggtgcaggttggttaaatacatgagccattttcccattggcattcaaggtacttttgaca

SEQ ID NO: 3038 - DNA, 433 bp, Homo sapiens
gtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaa

SEQ ID NO: 3039 - DNA, 145 bp, Homo sapiens
gtcaaatgaaggtgaattcaaggctgaagggaaatagcaaattcacctacacagttctggaggatggttccacgaaccacactgggggattggagccaaaccagtctttgattatcgacacacgcaaggtctgtaaagactccct

SEQ ID NO: 3040 - DNA, 121 bp, Homo sapiens
ggagaaaagtatggcatccccgagccgccagagcccaagaggaggaggtacgccggcatatccacagcctcttttaggacttccgagccagccttacttcgggaacgggcttggccaattm

SEQ ID NO: 3041 - DNA, 121 bp, Homo sapiens
caccagccgtgtgcagcctatcaagctggccagggtcaccaaggttcttggcaggacggttctcagggacagttcacggaggttccgcgttggattcattggaccgcaaggaacgattcct

SEQ ID NO: 3042 - DNA, 127 bp, Homo sapiens
tctaaacttctgggaacaaacaggacacattggagcttgagaacccctcgctgacattcaccccagttttcaggcaggaggttgttgtcaacacacacaattcaacctggacaagacaaccctgtca

SEQ ID NO: 3043 - DNA, 164 bp, Homo sapiens
ctgacctgacctgatgtccattcattccaccctctcacagtttggacttttcttccctctctttctaagagacctgaactgtggcagagatgcaaaattaaaaatctcggtgtgtctctattatattatatgtgctcttcccgtaaagagcccctcgcggtcam

SEQ ID NO: 3044 - DNA, 128 bp, Homo sapiens
gttcgacagtcagccgcatcttctttttgcgtcgccagccgagccacatcgctcagacaacatggggaaggttaaggtcggagtcaacggattttggcggattgggcgcgcttggtcacacacaggct

SEQ ID NO: 3045 - DNA, 102 bp, Homo sapiens
ctcaggagggaggatggtgcaaggcaggggttaggagcgcacgggcggcgagcggaggcacttggcttcaagaggcccttggcaaggcgggccttggggccg

SEQ ID NO: 3046 - DNA, 252 bp, Homo sapiens
catttatattgcccatctccttgttgtcttcaaagggtgttgagagcttgagggaattattgttgttccctattgggaacttatgttttgaagtatgttgcaggttttcaacaattttgggcacatgaaagccttgacaagttttttaagagggcagaagcttttatttttttgcacaggaaaacatgtttttttaaattcacatgtttgtattgagtacttttgcgagaggggcatgcactgctagggttt

SEQ ID NO: 3047 - DNA, 316 bp, Homo sapiens
cttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacaatacggaggataagatcaatgccctaattaaagcagccggtgtaaatgttgagcctttttggcctggcttgttttcaaaggccctggccaacggtaacattgggggccttaacttcaattagggggccgggggacccttcctcaagcagctgg

SEQ ID NO: 3048 - DNA, 250 bp, Homo sapiens
aaatttaactgttagtccaaagaggaacagctctttggacactaggaaaaaacctttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccttatagaggatctaatgttagtataagtaacatggaaccaattttcctc

SEQ ID NO: 3049 - DNA, 145 bp, Homo sapiens
cgaccagctgctggacatgtcctacgagcagctgatgcagctgtacagtgcgcgccagcggcggcgggcttgaaccggggcctgcggcggaagaagcacttcctgctgagggactgcggaaggccaggaaggaggcgccgcccat

SEQ ID NO: 3050 - DNA, 210 bp, Homo sapiens
acaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtggaaccctgtctctacttaaggttgcaattagccaggtgtggcggctaatcccagctgggcctgtg

SEQ ID NO: 3051 - DNA, 200 bp, Homo sapiens
ctcatcttgtgcccactgatggcagccgtgacctacatcgacgagaagcgggacttccgcacataccgcctgagtctcctggacggagtacggctgctgcaaggagctggccagccggctccgctacgcccgcactatggtggacaagctgctgcagctcaaggtcggccagcaaccgtctcaaggcctcctaatagctg

SEQ ID NO: 3052 - DNA, 155 bp, Homo sapiens
cgggtcgcattggcgctcctacgtcagccagcctagcatggatgccctggatcaggcatgctctcgtggcatctccacaagtctccgcaggaggtgcaagcacacctgagcaagaggagctgaaggagctgatcagaggagctaccatgctcgag

SEQ ID NO: 3053 - DNA, 78 bp, Homo sapiens
atgtgatctcagatacgtgaagctgcatacagaggggcccatccactcctaaacgggtctccaggaggcttggtttga

SEQ ID NO: 3054 - DNA, 215 bp, Homo sapiens
cctcaatctcccttcaaacaagatgctgatttgtagggtacttggcaggttaaattaaaccagaggaggtgacttaataaaaagggaatgacatttagggtataacgatctcataagaaatgtaatatgtaaattatatctgctttatgttgtaaaatatacattgtttgcgctagaatagaatgattcttttcaataaaaaggagagggctctc

SEQ ID NO: 3055 - DNA, 240 bp, Homo sapiens
gcgcggtgaggttgtctagtccacgctcggagccatgccgtccaagggtccgctgcagtcggtgcaggtcttcggacgcaagaagacagccacactttggcgcactgcaaacgcggcaattggtctcatcaaggtgaacggcgccctgagatgatttagccgcgcaccgtacaatacaagctgcttgagccagtctctcttcttcggcaaggagcatttcggttgagcaatccgtttcca

SEQ ID NO: 3056 - DNA, 280 bp, Homo sapiens
ggcacgaggaagaggccaaggcaccttccagaggctttgtggtgcgggacgcacccttggaccgccagcagcagttagaaggctcctgacatgagcagctctgaggaatttcccagctttggggctcaggtggctccaagacctcccttggggccccaaacgataatgatcaaaaagaacagaaccctctcagcctgctgaccaaacaacaaaaatggtttgtctaaatctgaccagcggtgggacctgcgtaaattgttgaggtttcacgcttgcgagg

SEQ ID NO: 3057 - DNA, 205 bp, Homo sapiens
ctttacaagaggttctgaagactgccctcatccacgatggcctagcacgtggaattcgcgaagtgccaaagccttagacaagcgccaagcccatctttgtgtgcttcatccaactgtgatgagcctatgtatgtcaagttggtggaggcctttgtgctgaacaccaaatcaacctaattaaggttgatgacacaaggaacctagg

SEQ ID NO: 3058 - DNA, 325 bp, Homo sapiens
tacacgatatgaatttcagcaatgaggacatgataagagaatttgacaatatggctaaggtgcaggatgagaagagaaaaagcaaacagaaattggggcgtttttgtggatgcaaagaaatttacaggaccccttctaccctagaggtccaagggaattcaggggtggctgcaggcccacgaaggacatttaagacattccttatgtttagtgtcctgcaggcatttaccaggccatgtgctttaacgttacggtaatactttactttaggcatcctcctttactagcagcctttgactatctcaatcagttccttgagtaggaa

SEQ ID NO: 3059 - DNA, 210 bp, Homo sapiens
ctcgtgccgggagcggagctcaaggctgcggaggcggaggtggagctgagcgcaagacgacttcgggcgtggggggcccgggtgcaggcccaaggccacaccctgcaggtagccgggctgagaggccctgtggctgcgctcggagccgctgggtgtgctggctgtggtgtgtccggacgagtggccctgcttgcttcgtgtccgtgctgg

SEQ ID NO: 3060 - DNA, 215 bp, Homo sapiens
gcctccgcaaagactgggagtaccatggagtaccgggggggaaatatggagtactgccgaggaacgtgggagccacagagagaggcgccgcactggtgagggcagggaccgcagccctcccacgcgccccagcaagtacagtgttccagcgaagtggagtaactgagccgggggaacaccaggagagagaacgatgcgggattggatgcaattga

SEQ ID NO: 3061 - DNA, 201 bp, Homo sapiens
ctggaattgaccgctacccccgcaaagtgacagctgccatgggcaagaagaagatcgccaagagatcaaagataaaatcttttgtgaaagtgtataactacattcacctaatgcccacagggtactctgtggatattcccttggacaaactgtcgtcattagggatgtcttcagagattcttgctctttaacgcagggccg

SEQ ID NO: 3062 - DNA, 216 bp, Homo sapiens
cccactctgtcaagtggaatccttccctttccaactctacctccctcactcagctcctttcccctgatcagagaaagggatcaagggggttgggaggggggaaagagaccagccttggtccctaaggctccagaaacgttcttcttaatccccacctttttcttacttccaaaaaaggattgaacaccttgattttggagtgtgtatactgcacat

SEQ ID NO: 3063 - DNA, 238 bp, Homo sapiens
ggaaaatgcaaggaaatactgagttaaaatacctgacatcacccttgtgacccaaggctagttacctgtgtttctatggaccattgactcaaatattttaatagatggcacccactgatctgatagttcgaaacatggtttcaggggtatatttaattactagatgtcttctgcttactgaaaaccattttgggctgggcacggaggctcacgcctgtaatcccaacactttggggag

SEQ ID NO: 3064 - DNA, 197 bp, Homo sapiens
ggacgctgcagtgcagttgtgagggcagttagcagccgcctcttctgcatcctgtcaactctgattagttagagtttaggctcaaaagagttggtggacttagattgaaatttggttgtgacaagaagaaaggaaaggagacacttagtaccaccagtttcagcaataaagaagggtcattttgtatttaaaattgt

SEQ ID NO: 3065 - DNA, 131 bp, Homo sapiens
cttgttccgaatttggcacgaggccagcttaagatgtagttgggtataaccccagacgccatgtaagctgtcatgtgccctttgagaaagatgctgttaccaggcccttttttgatcttctatgctcttgt

SEQ ID NO: 3066 - DNA, 118 bp, Homo sapiens
aagacttggaagttgaaaccaaggaagaatgttaaaaatatggcaaagttggaaaatgttttatatttgaaattcctggtgcccctaatgatgaagcagtacggatatttttagaatt

SEQ ID NO: 3067 - DNA, 192 bp, Homo sapiens
atgtgatctcagatacgtgaagctgcatacagaggggcccatccactcctaaacgggtctccaggaggcttggtttgatctactagatttggtgcctcttaaagggaagcaatacagcttttctgctgtgggttggtttgccactaggggaagattcatttctattccagccataaattagaccaaagagag

SEQ ID NO: 3068 - DNA, 260 bp, Homo sapiens
  misc_feature 215: n = A,T,C or G
atgtgatctcagatacgtgaagctgcatacagaggggcccatccactcctaaacgggtctccaggaggcttggtttgatccactagatttggtgcctcttaaagggaagcaatacagcttttctgctgtgggttgtttgccactaggggaagattcatttctattccagccataaattagaccaaagagagggatttgggttattgcgagtgcanaagtttaaaaccatcttcctttcccgagtgggctctcaaatagat

SEQ ID NO: 3069 - DNA, 355 bp, Homo sapiens
caatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctgtaaggatggtttagaaatggaaaatgttaacaaatgtggcaattattttggatctatcacctgtcatcataactggcttctgcttgtcatccacacacaccaggccttgagacaaatgggcctgatgtcatcttgagctcttcatttattttgactgtg

SEQ ID NO: 3070 - DNA, 102 bp, Homo sapiens
agttttaagttattagtttttaaaatcagtactttttaatggaaacaacttgaccaaaaatttgtcacagaattttgagacccattaaaaaagttaaatgag

SEQ ID NO: 3071 - DNA, 354 bp, Homo sapiens
ctcgtgccgaattcggcacgagaggccatgtacaagaggaagtactcagccgctaaatccaaggttgaaaagaaaaagaaggaggtcaggttctcgcaactgttacaatcaccagttggtggtgacaggaacggcggtacccgggtggttaaccttcgcaaaatgcctagatattatcctactgaagatgtgcctcgaaagctgttgagccacggcaaaatacccttcagtcagcacgtgagatactgcgagccagcattcccccggggccattctgatcatcctcactgggcgccaccggggcacgggggtggttttctgggcggctggctgtggctcattctgtggctggcm

SEQ ID NO: 3072 - DNA, 369 bp, Homo sapiens
tcgacttcagcttactgccccagccacctcaagagaaggctcacgatgcgtggccgcatactaccgggctgatgatgccaatttggttcgtgaccgtgacctcgaggtggacaccaccctcaagagccttagccagcagatcgagaacatccggagcccagagggcagccgcaaagaaccccgaccgcatcctgcagttacctcaagcatgtgtccactcttactggaagagatggagagtactggattgaccccaaccaaggctgcaacctggatgccatcaaagtcttctgcaacatggagactggtgagacctgcgtgtaccccactcagcccaggtgtggtccagaaggaactggtacatgagac

SEQ ID NO: 3073 - DNA, 214 bp, Homo sapiens
ctttggtggggagtgtggaggattgcatgaatctccctgaagccagtccctagtgcatggtttagtattctcgttgtctagggatctgtgagggctttgatttgggggcagtacctttctttttacatccccattttatttttgtgagaacttggggagcctgaactccatccataccactgaatagagattttgagtaatgatacctgttttc

SEQ ID NO: 3074 - DNA, 250 bp, Homo sapiens
cttcagagtacttaactaagcagaataactatcattgtcaataatttaaaattatgatttatgaacatgttctacaataataaaatgtttgtagaatttgatatgccaaaatatcagaaaatattttgaaccatccattgtgctacatagcaagtatgctatttataatttttggtgaataataagcatcctgccatatacctatgttggcagttaggacctctagggtgggcccaatggtcgcttccct

SEQ ID NO: 3075 - DNA, 476 bp, Homo sapiens
  misc_feature 145: n = A,T,C or G
cttcagagtacttaactaagcagaataactatcattgtcaataatttaaaattatgatttatgaacatgttctacaataataaaatgtttgtagaatttaatatgccaaaatatcagaaaatattttaaaccatccattgtgccnacatagaaagtatgctatttataatttttgtgaataataagcatctttcatatacctatgtggcagttagaactctaggatggaccacatgatcgcttcctcctgatatacacactctgtgtaatcctatcccagtaatagtgggtggacccaggaatgtgatgaagtatcactcccatggttatgttacattgtttgtcaaaagggattttgtagacataattaaggttcataaacagttgacactgtgtgtattagtctgttttcacattgctgataaagacatacctgagactgggtaaatttatgaagaaaaagacgtttaatggac

SEQ ID NO: 3076 - DNA, 130 bp, Homo sapiens
caaggattcaaaagataatttattagtctgagaagaggagtcacatactatacccagtaatacgcttgcsttgtattcttgtgcctttatcttaaaaactatattcgaccaacaacaaaggataatattc

SEQ ID NO: 3077 - DNA, 295 bp, Homo sapiens
gggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcccagcaaggaagggaaaagttgcccattgtaaattaagattgatgagcttgtgccattcattggcccggacagacctaaggaaggattcgggacttaccaactagcctccaaagatgccaagaaacagcttactgttt

SEQ ID NO: 3078 - DNA, 190 bp, Homo sapiens
ctcgtgccgaattcggcacgagcatggttaatgttgtgcgtatgtttgtatgtttttaaaggaaacttgcattttcaatagttgatcctaaatttcatatactgcacttctttactctggtaaagctgatgttttagttgcttattgtgaattgccgtaggacctctggatatgtctacacatttattta

SEQ ID NO: 3079 - DNA, 270 bp, Homo sapiens
ctcgtgccgaattcggcacgaggggaaagtcagtattttatatagctaaaatatgaacctcaaactggaatcctctaaagggcccatagcaatgaagtagacattggtgggaacatttacacccagtcagcttgaagagtttcaaatggaccctaccactgagaaatcaagatggcagtctactatggggaaattgaaggaaaaatgggattaataacaaggagttctgtgataatatacaaccaggacagggttctcttcacatggagt

SEQ ID NO: 3080 - DNA, 190 bp, Homo sapiens
ctttggtatccatggaggattggtttcaggactccagagaataccaaaatccatggatgcccaagtctcttttataaaatagtatataatatttgcatataacctaagcatattctcatatatttaacattatctctagagttactgagaatacctaatacaatagacatagttgttatactgtgtctta

SEQ ID NO: 3081 - DNA, 504 bp, Homo sapiens
  misc_feature 121: n = A,T,C or G
ctttggtatccatggaggattggtttcaggactccagagaataccaaaatccatggatgcccaagtctcttttataaaatagtatataatatttgcatataacctaagcatattctcatanatttaaaattatctctagattacttagaatacctaatacaatagaaatagttgttatactgtgtcttaaaatttttgttttttaaattgctgtgttatttttaaaattattttccccaaatattttccgtctaccgttggttgaacctgtggatatgtaactggtgaatactgaaggctgagtgtatattacattatgactaagtggaatttatcatagagatacgtggtaggttttacatttggaaattagctagtgtagtttaagatatcagtataataaaagagaaaaatcataggattatcccagtagttggagaaaaagcatttaataacatttaacatccatcgatgataaaaacggtcagcacactaaactaaaaa

SEQ ID NO: 3082 - DNA, 310 bp, Homo sapiens
ccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttcacaggtccaacaaccgcagcgaggagtttctcattgctggaaaactgcagggtggactttggcacatcactacctacagtttcggggcttcctgggacagccttaagttagg

SEQ ID NO: 3083 - DNA, 238 bp, Homo sapiens
cagcagcaagcattatacggtcatcttgaatgatccctttgaaattttttttttgtttgtttgtttaaatcaagcctgaggctggtgaacagtagctacacacccatattgtgtgttctgtgaatgctagctttcttgaatttggatattggttattttttatagagtgtaaaccaagttttatattctgcaatgcgaacaggtacctatctgtttctaaataaaactgtttacattc

SEQ ID NO: 3084 - DNA, 189 bp, Homo sapiens
aattcctcaccctcacccttccaccgttgttagtatcatggtgtttttgtttttgtttttgttttaagaacctgcagtttgactcttcatcgttcatctaggggaagacatctgatgttgtttccctatggaaatatatatctattatatatatattccccgcaaatctcacaaggtgcggcagcccag

SEQ ID NO: 3085 - DNA, 221 bp, Homo sapiens
ggtctggccaccaaccagcccttcttctgggaagcacaggccccggtgagcaccgtggagcagctggaccagcgctacctgctggtgcctgagaaggtcaaggacgcctacctggtccacctgatccagcgcgttccaggatgagcacgaggactggtccattatcatcttcaccaacacgtgcaagacctgccagattctgtgcatgaatgctgcggaaa

SEQ ID NO: 3086 - DNA, 246 bp, Homo sapiens
ctcgtgccgcagcactttgggaggccgaggcgggcggatcacgaggtcaggagttcgagaccacggtgaaaccctgtctctactaaaaaatacaaaaaattagccgggcgttgtggcgggcgcctttagtcccagctactcggagaggcttaaggcaggagaatggcgttaaccccggaggtggagctttcaggttagccgaggtcgagccacttcagcctgggtaacaaagccggactccctctc

SEQ ID NO: 3087 - DNA, 220 bp, Homo sapiens
ccacttactaatataactaccttgttttaaagaaaggaaaagcagaattgacatttagcaactactctgtgacagttaccatgctaggtgactcaaataacttagtgcttatatcagccctttgctgtagggaggatcttcattttacagatgaggaagtgagtttcattgcttatgtaacttacccaaggcacacacaggtaggttggaggcaggattc

SEQ ID NO: 3088 - DNA, 520 bp, Homo sapiens
accacttactaatataactaccttgttttaaagaaaggaaaagcagaattgacatttagcaactactctgtgacagttaccatgctaggtgactcaaataacttagtgcttatatcagccctttgctgtaggtagtatcttcattttacagatgaagaaagtgagtgtcattgcttatgtaacttacccaaggtcacacaacaggtaagtattgaagccaggattcaaacatacatctgaatgatgccacacaccccccacccctgactgtatcatactacttcatgtggacctgatccagtataataacttctgcattcctgtaatttctattttttctgctttttgtacacctttaaagaacaaccaatcagaaaaagattttggaaaatcctttgaaaatacatagtttttagatataatgattttgtaagttgaatgctcattttaaatttaactcgagtaatcttcaaaaatgcactgtgattgtgccagcatgtagatgtgctaatgcatagac

SEQ ID NO: 3089 - DNA, 135 bp, Homo sapiens
tgatgtgtcctcggtaggctaagaggaccttggaatttcctgggcagggaagagttgagccaatctttttttgagttcctcctaggttccaagtactgggaggggcgctcagcatcgctgattctgttatttcta

SEQ ID NO: 3090 - DNA, 260 bp, Homo sapiens
gtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctagagtagggaggtacataatgagagggctttaaaattgccaccaagtagtaccagggctgcagtggtattacgagactatcctagctatagg

SEQ ID NO: 3091 - DNA, 340 bp, Homo sapiens
gactctgcactgaatggctgacctgacctgatgtccattcatcccaccctctcacagttcggacttttctccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtacttcccccagcccaggccagaggacctccttaaggtgccgggcgcaggacctgtgtgtgtcctaacaatggtgctatctgtgtaaaacacttgtattttttaaaccatcattggtattagagtgggagg

SEQ ID NO: 3092 - DNA, 175 bp, Homo sapiens
aaagaaaagaataaataaaagaatgaatccctagtctttcctagaataaactttcattcagtaatgaggttgctgcatggctcttggcatgtacaaagataaagtgataaagagaaaaataaacacttgttgtacttaagcataggaaagtgatcaaatgagataattgcacatg

SEQ ID NO: 3093 - DNA, 74 bp, Homo sapiens
taaagaaaagaataaataaaagaatgaatccctagtctttcctagaataaactttcattcagtaatgaggttgc

SEQ ID NO: 3094 - DNA, 125 bp, Homo sapiens
gtaactgatgttattcgtcttgtatggcttttagtatgtttatcaagtggctaacaaatgcattctgaaaatgtatttaacatagctgttttaacaaatgaaaaagagcggagaaaaatgtttag

SEQ ID NO: 3095 - DNA, 250 bp, Homo sapiens
aaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttgagagtgaggcaatgtttttaaggaaaacaagtcatgtagggtgtctaaaaataaaatgcatttacactcaattgagagaagtccctaaggttacgcacat

SEQ ID NO: 3096 - DNA, 210 bp, Homo sapiens
gccgcgttcgcaccaaaaccgtgaagaaggcggcccgggtcatcatagaaaagtactacacgcgcctgggcaacgacttccacacgaacaagcgcgttccaggagatcgccattatccccagcaaaaagctccgcaacaagatagcaggttatgtcacgcatctatgaagcaattcagaaggcccagtaagagtatctccatcaagctca

SEQ ID NO: 3097 - DNA, 250 bp, Homo sapiens
ggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttgtttgctttagtttatattttctcagtagtttgttattgctggtattatacggacggaga

SEQ ID NO: 3098 - DNA, 215 bp, Homo sapiens
caaggttcggctttttcagctgatatgtctggtgatgcagtgttgctgaagcagtggataatgtgcttttcatgtgtcttgtcgctcatattaacaaagcttcctaggccctatgctatagttagatggtgccagttttttagtatagataccataatgcaacttgatgcttggtcagcctgataagagtgctattgagtctaagctttctggtg

SEQ ID NO: 3099 - DNA, 191 bp, Homo sapiens
ctacattgacaagaaatgccccttcactggtaatgtgtccattcgagggcggatcctctctggcgtggtgaccaagatgaagatgcagaggaccaatgtcaaccgccgagactatctgtcactacaaccgcaagtacaaccgcttcgagagcgccacaagaacatgtctgtacaactgttcccctgcttca

SEQ ID NO: 3100 - DNA, 146 bp, Homo sapiens
gattaagacactatgtcactttagtagttctttcaataaagccagaagggattaaaacctagagcttttttaatcattgcccatgacattagtaatagacttccaatcctacccctatcacaatgatttctttcacagaaatgtgt

SEQ ID NO: 3101 - DNA, 447 bp, Homo sapiens
gattaagacactatgtcactttagtagttctttcaataaagccagaagggattaaaactagagcttttttaatcattgcccatgacattagtaatagacttccaatcctaccctatcacaatgaattctttcacagaaaaatttcccatactgctttcagcaatctaagtgagctggtcagcacttaggacaactgacagattctattataaaaattaatacacatttttcttagtagcagaagaaaaggaaactgatttccattttataaaacctaattgatcaaacatagctatattttgaacataaaacagcttctcgtttcaggtctactggttttaacaatagctataaagctgtgtgactttgaaatggtgtttatggtattttgaatatgctgcttgctttaaacatgtcctgtgataaaatgcgtaaataatccagtga

SEQ ID NO: 3102 - DNA, 120 bp, Homo sapiens
ctgatatttatggaaaagtactttcaagtacaaggtcaatacataagccagagtgaatgatactacaagttgagcatctctaattcaaaaatctgagatccagaggctcaaaatcttgaa

SEQ ID NO: 3103 - DNA, 234 bp, Homo sapiens
gcgagctggacgccactgtggggctctgagagtcctgaattcttactgggttggtgaagattccacatacaaattttttgaggttatcctcattgatccattccataaagctatcagaagaaatcctgacaccagtggatcaccaaaccagttcacaagcacagggagatgcgatgggctgacatcttcaggccgaaaggagcgttggcctttggaaggggcccaagttccccc

SEQ ID NO: 3104 - DNA, 234 bp, Homo sapiens
gaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttcccaagattggcaccagacatttgagatcttctcaagagagacagaccagtgatctctattcctagaaaactaaa

SEQ ID NO: 3105 - DNA, 145 bp, Homo sapiens
tcttgcctccccaccccggaagctgaacctgagggagacaacggcagagggagttagcaggggagaaatagcagaggggcttggagggtcacataggtagatggtaaagagaatcaggagaaaaggagaaaagggaaaccagaaa

SEQ ID NO: 3106 - DNA, 257 bp, Homo sapiens
gccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggagttgaagtcgttaacttcttttaaagaatgtactattagaaaa

SEQ ID NO: 3107 - DNA, 110 bp, Homo sapiens
ggttggggcgtccgcatctaggcaggaagattgtgccgcaaagaagacgaaaaagttgcatgagatgaataacatgtggcatcaacactgataataaaagaaggaagatc

SEQ ID NO: 3108 - DNA, 480 bp, Homo sapiens
ggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccaagaacagactggtgaaaagtaaaccttttcacctacaaaatttcacctgcaaaccttaaacctgcaaaattttcctttaataaaatttgcttgttttaaaaacaaaaaaaaaaaaaaaaa

SEQ ID NO: 3109 - DNA, 285 bp, Homo sapiens
aaagaacactcgtggcagtagaacggcctctggatgacatcattgctcagctcccaccacccattaaaaaggaggaatttggaacctaaacagggcactgtctgtgtccttccttgaactgtctaccctgttggctttttacaaatcatggtaataaaacaggttattcttgaggactagtcattataaatgttttctcccaaattatggacagtcatttccttcattgattgaattgattggaattccactggggtatttgtattggggatatgtgctcagtag

SEQ ID NO: 3110 - DNA, 265 bp, Homo sapiens
ctgctgtagtactaaagtgtacttaatgttactaagcttaatgcctggccattttccatttatatatatttgtgaggaggctagagtgcttttagccttttttaaaaactccatttatattacatttgtaaccatgatactttaatcagaggcttagccttgaaattgtgaactcttggaattgttatagtgaggtcgcactaactaacctgtaaattatgatgattgtatcaacgattagtgaaattacccattctgtcccctg

SEQ ID NO: 3111 - DNA, 415 bp, Homo sapiens
ttgattccttctatttgcacaagtcaccttggactgcagggagctgttttgcaaaagcagtttagtaggcttagatctcaaattcatcttgagaacatttttttgaggtagtaatttcctcagaaggctctttgtgttttgttttgggttttttttctgagctactcggacttccttattaggacattcaatcattttcctttgggcctccaatttttggcttttctgcagcaccttgtgtggtgagattatatgtgtgtgtgtaacacagggcgtgcgtgtgtatgtcgcgccagggccaggttgtgggttgtgtgtgtgtgggtaacctcagctgttctctcttatgtgtgtgagctctctctctgcgttcccgggtgcgcatgcctgctgataggcttgctgcttacgcggc

SEQ ID NO: 3112 - DNA, 199 bp, Homo sapiens
ctcgtatccccaagattcagaagcttctccaagacttcttcaatggaaaagaactgaataagagcatcaaccctgatgaagctgttgcttatggtgcagctgtccaggcagccatcttgtctggagacaagtcttagaattgtccaagatttcctcctctgggatgtaactcctctctccttgggaatgaacctcctgg

SEQ ID NO: 3113 - DNA, 369 bp, Homo sapiens
ccatcatgggtcgcatgcatgctcccgggaagggcctgtcccagtcggctttaccctatcgacggagcgtccccacttggttgaggttgacatctgaggacgtgaaggagcagatttacaaactggccaaggagggccttactccttcacagatcggtgtaatcctgagagattcacatggtgtcgcacaggtacgttttgtgacaggcattatattttgagatttctaggtctaggggtctcgctcctgatctccctgagatctctaccatttattgagaagcagttgctgttcgaaggcatcttgagagcacacagggataggatgctaaattccgtctgattctatagagagccggattcaccgtt

SEQ ID NO: 3114 - DNA, 229 bp, Homo sapiens
gatgaccacgtcttaacccccaaatctaccatcaaataaattggacgtgataaacatgcatgtgagattcttaaattcggatgccattctcagcctatcttatgcctgcttggtgcaagaaacatgagtcttagggtcaagtgaacaggggctggaatcctggctctccccttatttacttacaggtctggtccaagtcactccccctctttgtctcagcctctcaatt

SEQ ID NO: 3115 - DNA, 337 bp, Homo sapiens
cgccgccggaggttactggaactgcagaaatccaagcggctggattatgtgaaccatgccagaagactggctgaaggatgactggacagggatggagagttaggaagaaaataagaaagatgatgaggaaatggacattgacactgtcaggagttaccaaaccactatgctaatcaattgatgctttctgagtggttaattgacgtccttcagatttggggcaggatggattgtggtcgtgtccctgtggaaaaagacccttatcgtggctcaggggttctaccagtcctacacaagagtcgctactgtgtcacaggttttcttcacttctgcgagg

SEQ ID NO: 3116 - DNA, 229 bp, Homo sapiens
tccaccttactaccagacaaccttagccaaaccatttacccaaataaagtataggcgatagaaattgaaacctggcgcaatagatatagtaccgcaagggaaagatgaaaatttataaccaggcataatatagcaaggactaacccctatacctcctgcataatgatttaactagaaatactttccaaggagagccaagctaagcccccgaaccagacgactcctagag

SEQ ID NO: 3117 - DNA, 317 bp, Homo sapiens
agatcgccatcatgacgacaccgtaactatccgcactagaaagttcatgaccaaccgactacttcagaggaaacaaatggtcattgatgtccttcaccccgggaaggcgacagtgcctaagacagaaattcggggaaaactagccaaattgtacagaccacaccggatgtcatctttgtttttggattcagacctcattttggtggtggccagacaactgtcttggcatgatttatgatccctggattatgcaaggaaaatgacccaacatggcttccagacatggcctttttagagaaagccctcaggaggcacga

SEQ ID NO: 3118 - DNA, 255 bp, Homo sapiens
aagagatcacctgtcacccagaagcgtattctctcctgggtgtaatttggggcaacagggacagggcaccagagggagatgttatagtgcggagttcttgctaacatctttctgacaatagcatctgatttgcctattgctaaattcaatcctctccttataggtggttaattaaatataaactaagatgcctgttggaccatacccattatgcataagaaacaatccgcattcaatggatttaaacgctgtatt

SEQ ID NO: 3119 - DNA, 579 bp, Homo sapiens
aaagagatcacctgtcacccagaagcgattctctcctggtgtaatttgggcaacaggacaggccaccagaggagatgttatagtgcggagttcttgctaacatctttctgacaatagcatctgatttgcctatgcctaaattcaatcctcctcttataggtagttaattaaattataaactaaaatgcttgtggaccagtacctattattgcataagaaacatccccgaattcaatggattaaaacgatgtattatcatgtctcatagttggacttgtttaagctcatctgggtggtcctcacttggggtcattcatgaagtcgtagtcagactgctgctgggcctggagtcatctaaagacttccggtcttagtctatttgtgttgctgtacaagaatacctgaggctgagtaatttgtaaagaataaaggtttagccgggcgctgtggcttacgcctgtatccccagcactttgggaggctgaggtagccagatcacaaggtcaagagttcgagaccagcctgggcaacatggtgaaaccccgtctctactaaaaatgcaaaatttagccaggcgtg

SEQ ID NO: 3120 - DNA, 115 bp, Homo sapiens
ctttagtggttggaattttgtaattcttcgggagagacgctattgaaaggccagactagcattgtgcagaccatatttggtctgtggacatgtttactttgactacattaaaaaa

SEQ ID NO: 3121 - DNA, 125 bp, Homo sapiens
ctttagtggttggaattttgtaattcttcgggagagacgctattgaaaggccagactagcattgtgcagaccatatttggtctgtggacatgtttactttgactacattaaaaaaaaaaaaaaaa

SEQ ID NO: 3122 - DNA, 215 bp, Homo sapiens
gtcaaccttgtggagccatcgcgagttagagggtgaaagatggcagaaaaaaaagtcttgtgtgttaagttttttttttgagtttgcatcaatcttaatgtctcttcataatacttttatattacattgaggcctcttgtctacatatttggagagaatatgactttactaggcagagaaatacaatatatctgtctactggactttaaatattt

SEQ ID NO: 3123 - DNA, 190 bp, Homo sapiens
cctggggtgggagttttctagttactagaccatctccatttttagcacttggcagcctcatgatccttttataatgtgagattaacaggagagcagcaatacgattttgccaatggaataacagatttgccggcattcacttaaagaggcagattattgggtccttgttacttcaacttacttttccaat

SEQ ID NO: 3124 - DNA, 240 bp, Homo sapiens
ctcatcccaggtattgttgtgggtgggcagaagtctgtttgcttcatggttttctgacctttgcctctcccctcaggaaatcctgacttttaacccacacagcgaatctctcctttcgagctctgccagcactcttatctacataaggatgaggtaatccggagtagcaatggagtgctgccatggaaggaggaaagctgccatttcccttcttggcacttaaggcaatctttgccttat

SEQ ID NO: 3125 - DNA, 155 bp, Homo sapiens
gtgtgcttcttaggggctctagggactgcaggctcctttagtaggcaggtaaataagagtagatgtagaaagttgtaaaatagacaaagtggagttgtgaatgcttctcctttgttacatttgatgattgttatagcctttaggatgtttttcct

SEQ ID NO: 3126 - DNA, 315 bp, Homo sapiens
ggcagccatcaggtaagccaagatgggtgcatacaagtacatccaggagctatggagaaagaagcagtctgatgtcatgcgctttcttctgagggtccgctgctggcagtaccgccagctctctgctctccacagggctcccgcccacccggcctgataaagcgcgccgactgggctacaaggccaagcaaggttacgttatatataggattcgtgttcgccgtggtggccgaaaacgccagttcctaagggtgccacttacggcaaggcctgtgcatcatggtgttaaccagctaaagtttgctcgcaggcctt

SEQ ID NO: 3127 - DNA, 330 bp, Homo sapiens
gaggagacagtctcgagtgcaatgtagtggaatggaatgctgtggaatggaatggagtggagtggaatggaatggaatggaatggaatggaatggaatggagtggaatggagaggagtggagttgagttgaattgaatctaatggactataaacggttgcaatgattggaatggagtggagtggaatgactcaaatggaatggactggaaaagaatggactcgaattgaatggagtcgaatgatgaatcaaaaggaatggagtcaaatgcaatgcacaggtgggattggatcgctcgctccgagattcgcacgaggggcctacacgccgc

SEQ ID NO: 3128 - DNA, 105 bp, Homo sapiens
caaaggaggaagtaaggcgaattctggggctgctggatgcttacttgaagacgaggacttttctggtgggcgaacgagtaacattggctgacatcacagttgtct

SEQ ID NO: 3129 - DNA, 147 bp, Homo sapiens
ccggccgcggcttcagcctggaggagctcaggggtggcccggcattcacaggaagggtggcccggaccatcggcatttctgtggatccgaggaggcggaacaagtccacggagtccctgcaaggccaacgttcagcgccttaaggag

SEQ ID NO: 3130 - DNA, 167 bp, Homo sapiens
cgcacacgagaacaatgcctctcgcaaaggatctccttcatctcctcttccagaaagaggagaagagggaaacaacaagaagaaaccgccttggtgcagagcccccaatttcctactttcatggatgttaaattgccccaggattgctataaaattcaccacggtct

SEQ ID NO: 3131 - DNA, 107 bp, Homo sapiens
ttaatgcaaggtcatttatatttgttaagaggaataatcaagatcactcatatccacctgaatcttgaggtttataaatccctcaaccggttccttgagccttgatt

SEQ ID NO: 3132 - DNA, 122 bp, Homo sapiens
ataatagctcttttggtttaaggcatctccagacatggtcctcctggtaggaaccaggtattagttagcttattgaggccaaaattggattgggaccctgggcctccacctttccattccat

SEQ ID NO: 3133 - DNA, 543 bp, Homo sapiens
caaaaatcctgtccatccattaccctgatgtgaagcctgtttatatagctctttttggtttaaggcatctccagacatggtcctctggtaggaaacaggtatgagtagactaatgaaggacaaaatgggatgagggacctggagcctccacccttgcattccaataccacccttaccccacaaaaggagggtattgacccacacagtagtgctgacctgtggccagggctggggaggtccaatttctaatctgtgctttgtcccatctccactgttccccacccctaggttttcgtaacaccccaaggcctgtaaggtttggtgtttccctttcaagatgccactttcagactttattctggctctgaaggacaatccctactttggggctggatttgggctggtgggtgtgggcacagccctgggcctggcccggaagggtgtccaactgggcctggtggcattccggcgccattacatgatcacactgggaagtccctgctcgagacaggagctatgcctggtttgcttagctggctcacc

SEQ ID NO: 3134 - DNA, 120 bp, Homo sapiens
tgcgctatctggcatcctaaccggcgttagaagtacattgcctcctcagggaagggctggcaacgcgaccatcaaaagtagcaaggaggtgacgcatgaagtccaaggttagggtctcac

SEQ ID NO: 3135 - DNA, 550 bp, Homo sapiens
agaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgagggaaatt

SEQ ID NO: 3136 - DNA, 107 bp, Homo sapiens
gacaagcgcgattctgacatactctgcgttcgtttctcgacaagatggccctgtaaccgttggccacacctccttatagctgggtgcataccatcagtcgcggaccg

SEQ ID NO: 3137 - DNA, 525 bp, Homo sapiens
gtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtac

SEQ ID NO: 3138 - DNA, 270 bp, Homo sapiens
gttcaagcctcccatgatcaaattcacaaccaagatctaccaccccaacgtggacgagaacggacagatttgcctgcccatcatcagcagttgtaactggaagccttgcaccaagacttgccaagtcctggaggccctcaatgtgctggtgaatagaccgaatattagggagccccttcggattgaccttgctgaccttctgacacagaattcggagctgttcagaaagaattccgaagagttcaccttcgattcggagttgaccggccc

SEQ ID NO: 3139 - DNA, 155 bp, Homo sapiens
aattagaaatgcacgtttacagcaagaggttggagatcatgctccaggacatatttggagaagactgtgtaagtataaagggtggactctattcttagcgtcacagtggaccgggaaaactgccaaccttaacctttgaggacacggcctgtgga

SEQ ID NO: 3140 - DNA, 285 bp, Homo sapiens
gctcagcggcggccgcggcgcgtgcgtctgtgcctctgcgcgggtctcctggtccttctgccatcatgccgatgttcatcgtaaacaccaacgtgccccgcgcctccgtgccggacgggttcctcttccgagctcacccagcagctgtgcgcaggccaccggcaagcccccccaagtacatcgcggtgcacgtggtcccggaccagctcatggccttcggcggctccagcgagccgtgcgcgctctgcagcctgcacagcatcggcaagatcggcggcgcgcaga

SEQ ID NO: 3141 - DNA, 315 bp, Homo sapiens
tgcctctcccgtgagtctccagcctgcccagcaccagcagctgtggagcacgtggatgctgcctaccccggcgcccgcgtcttccacgggcacaggtgttggaggccgtggtcggaccctggtgtcctggttactgctgcccgggtgtctttttttttgagtaactgctctctgagttttgacacgaagttgccctcatctgtctggagatcgataaggaaggcacaagacgttcttctctgccccgtgaggagcttccccgcagccgcttggcccagactggggcacgttctgcgagggatgtgtctctctcgc

SEQ ID NO: 3142 - DNA, 255 bp, Homo sapiens
caacatggtgttcaggcgcttcgtggaggttggccgggtggcctatgtctcctttggacctcatgccggaaaattggtcgcgattgtagatgttattgatcagaacagggctttggtcgatggaccttgcactcaagttaggagacaggccatgctttcaagttcattcagctcacttatttcatcctcaagtttccgcacagttcccaccagaagtgtttctccacaaggcttgcagaagtcagacatctattc

SEQ ID NO: 3143 - DNA, 166 bp, Homo sapiens
aaaaagggagccaagaagaaagtggttgatccattttctaagaaagattggtatgatgtaaaagcaccttctatgttcaatataagaatattggatagacgttcgtcaccagggcccaaggagcccaaagttgcatcttattggtctcaaggttcgtctcgtttaa

SEQ ID NO: 3144 - DNA, 180 bp, Homo sapiens
ctcgtgccgaattcggcacgagatgccacactcaagtccctcaacaaccagattgagagcatccgcagccccgagggctcccgcaagtaccctgctctgcaccttcagagacctgtaaactcttccacccttgagtggagagagttggagacttcttggatttaccccaaacaaaggctg

SEQ ID NO: 3145 - DNA, 100 bp, Homo sapiens
ccttagcctcccaggttataagctccctgcaggctcctcctctccagagccaggatggagaggcactgggctttcccaaagcaggcttggattgtcccac

SEQ ID NO: 3146 - DNA, 132 bp, Homo sapiens
tcatccgccgagactatcttcactacatccgcaagtacaaccgcttcgagaagcggccacaagaacatgtctgtacacctgtccccctgcttcagggacgtccagatcggtgacatcgtcaaagtaggcgag

SEQ ID NO: 3147 - DNA, 117 bp, Homo sapiens
gtttcatcatgtgggtgttattcataacagacactgtgtggtctagaagtgtaaggcaggtctatgaagtccatgattccagatgattgggcctattcatgacttccgagtgtccca

SEQ ID NO: 3148 - DNA, 322 bp, Homo sapiens
aataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaccacccatcatgtggctgctgtcacccttgaccagctgtggtggtggttactccatctgtggttggagcgcctctttggattcacttcaaggtcttgtgccta

SEQ ID NO: 3149 - DNA, 320 bp, Homo sapiens
accagtcagtggcctggcaggacgcagccacgggcagctacgacaaggccctccgcttcctgggctccaacgacgaggagatgtcctatgacaacaacccctacatccgcgccctggtggacggctgtctaccaagaaaggctaccagaagacggttctggagatcgacaccccaaagtggagcaggtacccatcgtggacatcatgttcaatgacttcggttaagcgtcacagaaatttggatttgaagttgggccggcttgcttcatgggctaggagccgccgagcccggctcccgagacaacctgttgacctaagca

SEQ ID NO: 3150 - DNA, 168 bp, Homo sapiens
aggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaagtcatac

SEQ ID NO: 3151 - DNA, 310 bp, Homo sapiens
cggcacgagggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggacttaagtacacagatccttatctctccccatcccctagcctcacaaaacacagttgagagcttttaaggacctcagctctcgaaggtacccagaacttaactagacttccctaccttagactg

SEQ ID NO: 3152 - DNA, 230 bp, Homo sapiens
gaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaaggttcttgagttctgcttgttaacacccagcttttaacttagtgtttgctcctgatgggttaggggattttcatgtt

SEQ ID NO: 3153 - DNA, 230 bp, Homo sapiens
  misc_feature 73: n = A,T,C or G
gtcatgaaggagcgggggtttggcaggcgggtgacgtccaggagagggagcgccccttgctgcccctcggccnccgacttgacgcgcgggccttgccagcaagcgaccctcatcgggctgtcgcctgacaacatacctcaaaaggccctagctaataaaccctgtaagcccagcatttgagaaaaggtagggtgtgtatatataaaaggttgtgtacaactccacgaggt

SEQ ID NO: 3154 - DNA, 260 bp, Homo sapiens
agaaatctctctataaaatgaataaaatgtttaagaaaagagaaagagaaaggaattaattcagttaaggatgattttgctcctagttttggagtttgaatttctgccaggattgaattattttgaaatctcctgtctttttaaactttttcaaaataggtctctaagggaaaccagcagaacattagcctgtgcaaaaccatctgtttggggagcacactcttccattatgcttggcacatagatctcctgtgggggga

SEQ ID NO: 3155 - DNA, 310 bp, Homo sapiens
ggaaaatggtgaagaaaattgaaatcagccagcacgccaagtacacttgctctttctgtggcaaaaccaagatgaagagacgagctgtggggatctggcactgtggttcctgcatgaagacagtggcttgcggtgctggacgtacaataccacttccgctgtcacggtaaagtccgccatcagaagacttaaggagttgaaagaccagtagacgctcctctactctttgagacatcactggcctataataaatgggttaatttatgtaacaaaaaaaagtacttcttgggcggccggggccatcgatttt

SEQ ID NO: 3156 - DNA, 310 bp, Homo sapiens
cccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatggtgattattattaaatttatgttttgcaccttaggaaccagctacagtattggccacttaataaa

SEQ ID NO: 3157 - DNA, 310 bp, Homo sapiens
aggtcgacactagtggatccaaagaattcggcacgaggtctcgagtttttttgtttttttttttacaaattgaaggtttktggcaaccttbcctmaagcamatytwttggksccatttttccaacagcatgtsctcactttgtgtctctgtgtcacataatattcaataattttgcaatatttaaatttgttcatcattattatatctggtatagtgctttgtgatcaatgatctttgatgttactatggtaattgttttggggksctgatatggtttggctgtgtcccccccaaatctmaacttggact

SEQ ID NO: 3158 - DNA, 295 bp, Homo sapiens
gcagcgcggaggccgcacgatgcctggagttactgtaaaagacgtgaaccagcaggagttcgtcagagctctggcagccttcctcaaaaagtccgggaagctgaaagtccccgaatggttggataccgtcaagctggccaagcacaaagagcttgctccctacgatgagaactggttctacacgcgagctgcttccacagcgcggcacctgtacctccggggtggcgctggggttggctccatgaccaagatctattgggggccgtcagaaaaccggcgttatgcccagccactt

SEQ ID NO: 3159 - DNA, 347 bp, Homo sapiens
cgcagtgaagtggacatgttgaaaattaggtctaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtcccgtggccatcctgtgaggtgacgttagcattaccccaacctcattttagttgcctaagcattgcctggcttcctgtctaggctctctgtagccaaagaattgacattcaaggggttggagtaa

SEQ ID NO: 3160 - DNA, 320 bp, Homo sapiens
catggctgcgtccagtaccaagagttggtgggagacgggtgaagtacaggctcagtctgcggccaagactccatcctgcaagatattgtggctggagacatgagcaagaaaagcctcttggagcagaagggaggctccaagacctcatcaacaattaagactctttggcagttgcactgggtactggctgagttctggaaaccaggaatgtgagcagagtgctgcagatctccttgtcaggagcacctaagaactggcatgactctacacctctctccttctgcaatgacctcgtgtcagatggcagactccagagatga

SEQ ID NO: 3161 - DNA, 325 bp, Homo sapiens
gcctggtggaacgtcctgggcttggatgtggcaccggagccttgactggattctgttccactactgggcttcctgggcatctaccttggacctagcgtggagtctcacgttcaagttgtcttgcctgaagaagacagctagtgggcctgccttgggtctctgttgaacaattaaaggagcaccgagatcccctctgttgaataattaaagaagggagagagagaccctcgctgcaggacgccttgcattgtaacctcttggaagcataagccctgctcgctataaatgagaatgtcacttccacatctctctgagcatattggtc

SEQ ID NO: 3162 - DNA, 562 bp, Homo sapiens
gcctggtggaacgtcctgggcttggatgtggcaccggagccttgactggattctgttccactactgggcttcctgggcatctaccttggacctagcgtggagtctcacgttcaagttgtcttgcctgaagaagacagctagtgggcctgccttgggtctctgttgaacaattaaaggagcaccgagatcccctctgttgaataattaaagaagggagagagagacccctgctgcaggacgccttgcattgtaacctctgggaagcataagccctgctcgctataaatgagaatgtcacttccacatctcctctgagcatattggtccagaaaactacctcccacattaattttcatatggctatcagacatgggagatttatcagagagaaggaaaagtgtaaggatcaaacacgtgagtttgggagaatacaggaactaatactaatgcaaaattagaacgggatttagggaaattcagtgcagcagcacagagtactacaaaataaaagaagctttgttcctctcgaaggtaatctgtgtgttggttccctaattttaaa

SEQ ID NO: 3163 - DNA, 323 bp, Homo sapiens
gtgatatgagacagacagttgcggtgggtgtcatcaaagcagtggacaagaaggctgctggagctggcaaggtcaccaagtctgccagaaagctcagaaggctaaatgaatattatccctaatacctgccaccccactcttaatcagtggtggagacggtctcagactgtttgtttcattggccatttagtttagtagtaaagactggttaatgatacaatgcatcgtaaaccttcagagggaaggagatgtttgtgacactttgtttctttttgcgtgtgcagtttaggtatagttttaaatcagtacttttatggaacact

SEQ ID NO: 3164 - DNA, 104 bp, Homo sapiens
tgaaacagttgtgctgacttgagtggcatgaaggggttgttcaaggcaatgacatagaagggggactgttttcaggaatcacctcagtgatagatttaacatcc

SEQ ID NO: 3165 - DNA, 143 bp, Homo sapiens
ctcacacgttggctttggacaaccaggccccaacttggtcccttgccctagggaccttccagcctggtgcccagtgctcaggccacctcctggtccagtcaccacctgcagcctcggcagggcaggtacaggggccacctcgg

SEQ ID NO: 3166 - DNA, 139 bp, Homo sapiens
cttgaggaccaatgactgaggtctatgccagttcctgatcccatctcactctctggacctaccaggtgactgctgctgggtgacttccctgaggcggctatacccttaagccagccccactacttccttccctgccttc

SEQ ID NO: 3167 - DNA, 186 bp, Homo sapiens
gagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaacccaactttaatctctgtcattagtcacttt

SEQ ID NO: 3168 - DNA, 203 bp, Homo sapiens
gagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaaacccaactttaatctctgtcattagtcactttcttttttttttttttt

SEQ ID NO: 3169 - DNA, 110 bp, Homo sapiens
ctcgtccaatttcggcacggggccacgggatgatcatgagttcatccaacaccagccatttccaccatgccatcgaggaaaaggttaattaaattatttatcccattttt

SEQ ID NO: 3170 - DNA, 622 bp, Homo sapiens
ctcgtgccgaattcggcacgagcggcacgagatgaatctgagttcatacaacaccagccatctccaccatgccatcgaagaaaaaagttaaataaaataattaatccaatattctgccttaggaaactagaaaaagaagagcaaattaaatccaaataagcagaataaaataaatgaaaattatagcagaaatcaatgaaactggaagcagaaaaccaatagagaaaaataacacgaccaaaatctagtttaaaaaaaatcaatatagttgataaacctctagccaggcttactaagaaaaagagaagacacaattactaatatcagaagtgaaagagaagcatcactacagatcccatggacactaaaagaataataaaggaatattattaataactctatgtccacacatttgataacctacttaaagacacaatctgccaaaattaacacaaaaagaaatcaatacttttaataaacatatattgatttaaaaaattgggttaataactaataaacttccaaaacagaaatcaccagactcacatggattcattagtgaattcatcaaacatttagggagaaattatacaatcctatacaatctgttccagaagacaga

SEQ ID NO: 3171 - DNA, 130 bp, Homo sapiens
atcacttcgtcatatgtaaggagatgctagttttggcagccatgaaagttacacatacacaccacatacaggcagccttacctttacatacgtgcacacacacatccattttcatccacattcatccaca

SEQ ID NO: 3172 - DNA, 370 bp, Homo sapiens
aatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggccttggttc

SEQ ID NO: 3173 - DNA, 105 bp, Homo sapiens
cgagtttgacctctggtgtcctgagttaccagtgtgatttgtaagttttcacgtcatgcttgccactatagtgacagactccagcatgcatcacgtggatgccag

SEQ ID NO: 3174 - DNA, 504 bp, Homo sapiens
gaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttgggatgtgaccgtctgtccttcaggagaggacacca

SEQ ID NO: 3175 - DNA, 125 bp, Homo sapiens
caggtatgacttcatagacagccttttctgatctgaccttcatacttgcctctgctttgcctttatctccacctctctacactagtgcttctgccctgttggacttttttaaaacttttaatcat

SEQ ID NO: 3176 - DNA, 180 bp, Homo sapiens
gttcagttgtggcggttcctggtcagtaacagccaagatgctgcggaatctgctggctctccgtcagattgggccagaggacgtaagacatgctttcccgcagcattttaaaaataaagttccggagagcaaaaacttttccagggggttgtgaattcccctgatttaaagggtggggta

SEQ ID NO: 3177 - DNA, 110 bp, Homo sapiens
agtggcatcaattcagagggagtttcctgatgcactcaagctgactgatgagttctactcggagctggctgaagatggctactctggagttgaggtgcgagttaaccacc

SEQ ID NO: 3178 - DNA, 140 bp, Homo sapiens
gccaaatcccgtactccttgccaccggctttcctagagcagcgtagacagctggtaaacttaaggagcacaactatattcttatgagggaatttgtacctttgggggtattattttgtggccccttaccctggttattgt

SEQ ID NO: 3179 - DNA, 255 bp, Homo sapiens
agcctcttcccccagttctggtctgacccaacagaggggctctatgatattaagaaggggcccttcctgctctgtgcctcaacctattctccataatagggagtctaatcctattcctcccctgcctcgatgaggatggtgtaaggatgaggaggccggcatctcatttggggctttttggcagtgggcctcattttaatcctccagggctgcctccaagtggatctatccagctgcttccttgtggcaagaatt

SEQ ID NO: 3180 - DNA, 230 bp, Homo sapiens
catggatgtaaccacaacctccaccaggattggcaagtttgaggccaggttcttccatttggcctttgaggaagagtttggaagagtcaagggtcactttgggaccatcaacagtgttgccttccatcctgatggcaagagctacagcagcggcggcgaagatggttacgtccgtattccattacttcgacccacagtacttcgattttgagtttaggcttaagaagctg

SEQ ID NO: 3181 - DNA, 120 bp, Homo sapiens
gccagtgtggccagagactggtacatcagcaagacccccaggacaaggggcatgtctggttcggcgagacattgaccgatggattccagttcgagtatggcggccaggcttccgaccctc

SEQ ID NO: 3182 - DNA, 104 bp, Homo sapiens
cattgcctgaggcctgggctcgccttggaccacaagtttgaacctgaatgtatgccaagcgtgcctttgtttaacttgtmacgttggtgaggggatgggaggca

SEQ ID NO: 3183 - DNA, 301 bp, Homo sapiens
tcaagattcacagcatctcagacgcagcctaggccgcaccaggatgtcggacaccgaggagcaggaatatgaggaggagcagccggaggaggaggctgcggaggaggaggaggaagaagaggaacgccccaaaccaagccgccccgtggtgcctcctttgatccgccaaagatccagaaggggagcgcgttgacttcgatgacatccaccgcaagcccatggagaaagacctctggagcttcagacactcatcgatgtacatttcgagcagcggaagaaggaggagaggagctggttgcct

SEQ ID NO: 3184 - DNA, 160 bp, Homo sapiens
aaaatgacagattattctggaggagatgacctccatttatggttatgtgtgtgtgtctgtgtgtctttggaaaaatatatataatttcctcacataggaagccaacatatcaagtgatgagttacagtatgctgcagcatatatattctacacctacaac

SEQ ID NO: 3185 - DNA, 228 bp, Homo sapiens
gttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtcgggacctcagccatcactattcctgcttcaagttacactggtgctctcactagcact

SEQ ID NO: 3186 - DNA, 470 bp, Homo sapiens
  misc_feature 32: n = A,T,C or G
gttgagagaagttgcaaaaagaattagtcaanagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatgggagttatatactaagttacttatactaaggcattagtagctcatatctgaggagcaattgtatttttagttcagctaaattaatgcctctttttta

SEQ ID NO: 3187 - DNA, 122 bp, Homo sapiens
ggatgtgttcaggtgacctcatgaacacaggtgcatcaagcctaatgttctggctgcagttagagggcaatctcttcagaaccagtgagggacctgatatttagtcatttctgtgcacccct

SEQ ID NO: 3188 - DNA, 490 bp, Homo sapiens
ggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaagggcaggccaacaacgccgggcctaccgcaggcgaaggtccc

SEQ ID NO: 3189 - DNA, 182 bp, Homo sapiens
gaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaa

SEQ ID NO: 3190 - DNA, 121 bp, Homo sapiens
taatactggaaaataatgtctttcagaaaaaggtttctttggtttttgtttctaagacagaggaggccaattggatttcaagttatatgatgacattctgaattaatgacactggaaaact

SEQ ID NO: 3191 - DNA, 152 bp, Homo sapiens
cggcacgagagacagggcaggatccacgtgcccattgtggaggcagagaaaagagaaagtgttttatatacggtacttatttaatatccctttttaattagaaattaaaacagttaatttaattagagagtagggttttttttcagtattct

SEQ ID NO: 3192 - DNA, 160 bp, Homo sapiens
ctcgccttttcggggcgagtaaacttggcgaaacctgkatccgggcccaacctgaaaacatcccagccaagaactggtataggagctccaaggacaagaaacacgtctggctaggagaaactatcaatgctggcagccagtttgaatataatgtagacgg

SEQ ID NO: 3193 - DNA, 153 bp, Homo sapiens
tttggcaaaagtgatatattatgaataagcaataatgatccaacacattccagttaaaaatatacttgtaaaaattgttcaggatgcacttaaatttcattgaccggtgcaataggttgttggaatgattaggccgcttttaccagctctata

SEQ ID NO: 3194 - DNA, 119 bp, Homo sapiens
agtaagccaagtaccactgcactctagcctgggcagcagagtcagactctgtcacacataaataaataaataataaatatcagatctttttgctttctccttccttcctgcttgcctcc

SEQ ID NO: 3195 - DNA, 134 bp, Homo sapiens
gtaaacaccagagtagctattacaagggaacacaaataagaatggtttagaaatggatatgatgaattgacatgtaagggtccatgtaaatcctgtttggctctctaaaagaatgtttacctaaagctattcat

SEQ ID NO: 3196 - DNA, 171 bp, Homo sapiens
gcggatctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccatttcacatttgag

SEQ ID NO: 3197 - DNA, 161 bp, Homo sapiens
aggaggctgaggcgagaggatggcttgagctcaggaagtcaaggctacagtgagctgtggtagtgccactgcactccctcatggttgacagagcaagaccctgtctcaaaagattctaatatagatactctttttatgcatatgtaatttatatatatcac

SEQ ID NO: 3198 - DNA, 160 bp, Homo sapiens
ggcctctggtgggtttcaagttgaggttgatcttgatctacaattgttgggaaaaggaagcaatgcagacacgagaaggagggctcagccttgctgagaacactttcttttgtgtttacatcatgccaggggttcattcagggtgtctgtgctctgactg

SEQ ID NO: 3199 - DNA, 245 bp, Homo sapiens
ctggctcctccgtagacccctgttcttttcaacctctgcccacccgtgcatgtcatcacaaacatttgctcttaagttacaagagaccacatccacccagggattagggttcaaggtagcagcttgctaacccttgaaccagcccttgtgggactcccaacacaagacaaagctcaggatgctggtaatgctaggaaggatgtccctccctcacttccccaaattctccagtggctctaccagcc

SEQ ID NO: 3200 - DNA, 155 bp, Homo sapiens
gtgactgccagtgccgagggctaccattcagtgacacggaactgtcgggtcacctttgaagagggccccttcccctgcaatttcgtgctcaccaagactcccaaacagaggctgcgcgagttcctgggcagtggggcccaaggtgcccccggacc

SEQ ID NO: 3201 - DNA, 125 bp, Homo sapiens
atgaaggagatgggtgggtcaaaaagggatatcaaatgaagtgataggggtcacaatggggaaattgaagtggtgcataacattgccaaaatagtgtgccactagaaattgggtaaaggctgtct

SEQ ID NO: 3202 - DNA, 110 bp, Homo sapiens
ggacgaatggcttcaaggttacttcgcggcgtggaacgctagccgcgcagccctgaaggctccgccggcccagtggcgcggccgaattggcttccatggcatcttgaggt

SEQ ID NO: 3203 - DNA, 170 bp, Homo sapiens
cggacttgggattggagagaaacaggaactgagcattctcctggtgtgcagcctgcagatgtgaaggaagttgttgagaaggggtgtacagactcttgtgattggcccagggatgagtgaggcctttaaggggccttcatcaactgtggagtacctcaagagacatggca

SEQ ID NO: 3204 - DNA, 195 bp, Homo sapiens
gggcatctctcgggacaactggcacaagcgccgcaaaaccgggggcaagagaaagccctaccacaagaagcggaagtatgagttggggcgcccagctgccaacaccaagattggcccccgccgcatccacacagtccctgttccggggaggtaacaagaaataccgtgccctcagggttggacgtggggaatttt

SEQ ID NO: 3205 - DNA, 140 bp, Homo sapiens
tggcatctacttcgtgggtcttcaaaaatgttttatcaaaactcagattaaagtgattcctgaattttctgaaccagaagaggaaatagatgagaattgaagaatttaccacaacttttttttgaacagtcagtgttttg

SEQ ID NO: 3206 - DNA, 203 bp, Homo sapiens
gcaagttttcttacagttaaggcctgcttagtttactgattctcagggagccctctgtggccttttgctttgcgtgctgtttcccttgtaccagagggcggcaccctggaaattctgttttccctgtagcatattgtgttggagttgcattactggcagagaaagggacaaggtgccactctaagtcccagggggggggctcc

SEQ ID NO: 3207 - DNA, 110 bp, Homo sapiens
ttcagagagacatttaaggtaatattttgaacgtttcagatatattattgatatgtgctctattgaatgtgtctaaataaatgctgtttatttaaatattcctataatct

SEQ ID NO: 3208 - DNA, 130 bp, Homo sapiens
gagacagaggcgccggacctccagcaagcgcaatcccccgtcgtgaattcagtgaattcagaggcaggacgggatcatccggagtcgggagctgcttccacaggaggcgaggctccccagggctcatagg

SEQ ID NO: 3209 - DNA, 373 bp, Homo sapiens
ggagaagtacggcattccagaacctccagagcccaagcgcaagaagcagtttgatgccggcactgtgtatgtgatgtgcacattttccagttcgtaagctggggccctggctgttttaagtaactgtgtgtttgccactggcaggaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatagtttgtcgggcgccgattcctacaaagatgctgtccggaaagccatg

SEQ ID NO: 3210 - DNA, 374 bp, Homo sapiens
ccgggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagccgggcgctcaacaacaacccgaggaggagcggcacaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaat

SEQ ID NO: 3211 - DNA, 367 bp, Homo sapiens
gccggatgcactagccctgaagaggggtgtcatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtgtgactctgcctgtgatggggtggccttctgctgtcccccctccaccagtgcccttttgcagagagatattttgtgtacacagaagccattccgagtctgggacctgcccctgtgcggatcctgacccagccaacagctgagctgccgggctcctcgaggccctaagccaccccagaggtgccatct

SEQ ID NO: 3212 - DNA, 148 bp, Homo sapiens
cagaattgtaaatgtttagttgtgaccatgacgtattgtttgggtcaatgtccctttccaatgcatactaatatcattatgggtattatatatgaatatatttgatgacatcggaaaagttgtggattttctttctttcctttttttt

SEQ ID NO: 3213 - DNA, 330 bp, Homo sapiens
cttggtgtgccttggatttctgaggatagacttacagtcatctgatgagctatttttcatatttttaaggatcagagaaggctataatatttattccctcagcctttttatttctggcaatatggagcattagaaaattttcaggaccctacagctataaaggacacaagtatgttggacaacatatatacacacatttcattgagatgcatacccacaactccgttgagagggaaagagctctacggacagagacagagcagccgcaggcgcggcagtagctcacacacaggagtgccacactcgcgatatagagtgagaggttaaagc

SEQ ID NO: 3214 - DNA, 292 bp, Homo sapiens
tcttattcacgttttttttaaccataagtggcaaatattttaaaatatttgacaaacactccagaatctagtacgctttatttttagacctgaccctaaagtaggttgttcttttaacaaagggtttaattcgggttgggaatataacatatcacaatacatgacaccaatgggaaagttacttctagagaagccaagagattgggtatcatattttgtctcttggggagctaattttgttgagtgtgtagagttgagcacagatgtatatttttgaagggcagtttagaga

SEQ ID NO: 3215 - DNA, 388 bp, Homo sapiens
ccagcaccatggcggttggcaagaacaagcgccttacgaaaggcggcaaaaagggagccaagaagaaagttggttgatccattttcttaagaaagattggtatgatgtgaaagcaccttgcttattgttcaattattaaggttattatttggaaagacgcttcgttcacccaggacccaaggaaccaaaatttgcatcttattgggttcaaggggtcgtgttgtttgaagttaggcttgctgatttgcagaatgatggaaggttgcatttagaaaattcaagctgattactgaagatgttcagggtaaaaactgcctgtactaacttccatggcatggatcttacccgtgacaaaatgtgttccatggtcaaaaaatggcagacaatg

SEQ ID NO: 3216 - DNA, 362 bp, Homo sapiens
ttttgtttgtcatgtacgaaacaagagggctggcaaggaagaacccgttgttgtccattgcagttctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaaggttatgaagagggctttgttaaacccttaacaacatcaacacataataggagagcaaaaagagtctgggatatgtgttggaaactgctttcctcatgtgcactgtgccataatgctgctcgcagga

SEQ ID NO: 3217 - DNA, 338 bp, Homo sapiens
ggttttctgcctttggagaaggaaagaagactgatgtaattgaccaactggggttactgagcattgaatctcaacttaatttagctgtgctgtttcagtcttctactcacacgtgtatgggaaagttcattgtggtttgaaaatgaattttcaatggataaacattaattaattattaacccattaataatcttgaaagtgcaaggcaccttacatatctttacaccagtatcattgattttctaaaaggacactgattgactgaatgactagagtaagggcacacactcactataagtgtcaccctatgacttctgcttgaaaatttcacttaagct

SEQ ID NO: 3218 - DNA, 540 bp, Homo sapiens
tggttttctgcctttggagaaggaaagaagactgatgtaattgacccaactggggttactgagcattgaatctcaacttaatttagctgtgctgtttcagtcttctactcacacgtgtatgggaaagttcattgtggtttgaaaatgaattttcaatggataaacattaattaattattaaaccattaataatcttgaaagtgcaagggaccttacatatctttaaaccagtatcattgattttctaaaaggaaactgattgactgaatgactagattaaggtcacacaatcactataagtgtaaccctatgacttctgcttgaaaatttcacttaagcttttccctgaatgattaaatttccaatcagatcataattgggatttgttgaggggctgtgactacaaattctgacagtcacatatttctaggggcaaaatgaaaacatagaaaatcctagatcaagccactggttggtgccttgacttttggaccagaacagctgaactgtgtgttaaatatcatcatgagaaacttaaat

SEQ ID NO: 3219 - DNA, 320 bp, Homo sapiens
cctatctggacgaagcagctggcaacctcaagaaggccctgctcatccagggctccaatgacgtggagatccgggcagagggcaatagcaggttcacgtacactgccctgaaggatggctgcacgaaacataccggtaagtcgggcaagactgttatcgagtaccggtcacagaagacctcacgcctccccatcattgacattgcacccatggacataggagggcccgagcaggattcggtgtggacatagggccggtctgcttcttgaaaaacctgtacccgaaacaacacaatccgttgcaaacccaaagggcccagt

SEQ ID NO: 3220 - DNA, 295 bp, Homo sapiens
atcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagagccagcaggtggatagtatatagggtttatgcctgtgtttctttttctccatgagagagctaaacatgagatataatggatatagtatta

SEQ ID NO: 3221 - DNA, 250 bp, Homo sapiens
gtcaccagcagctgtactggagccacccgcgaaaattcggccagggttctcgctcttgtcgtgtcttttcaaaccggcacggtcattgatccggaatatggcctcaatatgtgccgccagtgtttccgtcagtacgcgaaggatatcggtttcattaagttggactaaatgctcttccttcagaggattatccggggcatctactcaatgaaaaaccatgataattctttgtatatataatacacacttt

SEQ ID NO: 3222 - DNA, 210 bp, Homo sapiens
tcgtgccgaattcggcacgaggtcgccttctaccttgctggcttgcccttagggggcaacttcttcccccagcggccaagggacaatcaaaggaaggtcttgtgacaagcctttggtatcttgatgcggacgacggcccggcttaacaagggttatcagtgtagcttattggaaaacattttaagggcggcaatttcccaaggggatttg

SEQ ID NO: 3223 - DNA, 200 bp, Homo sapiens
agaaggagcggcacaggcgccagggcagggaagtcagacctgacaacccagtacaaccggccgcaagcgcaagccccgctttctaagtcaaccacgcggttcctggaaaggcacttgccctctccacttttcctatattggtccagctgaccaaggtagtattttggaaaaggtcctaaggtatataaaaatgtttctct

SEQ ID NO: 3224 - DNA, 300 bp, Homo sapiens
cggcacgagatcctggtgtcgccatgggccgacgccccgcccgttgttaccggtattgtaagaacaaggcgtacccaaagtctcggttctgccgaggtgtccctgatgccaagattcgcatttttsgacctggggcggaaaaaggcaaaagttgatgagtttccgctttgtggccacatagtgtacagatagaatatagagcagctcgtctctcttgaagccctgagaggctgccccgaattttgtgccacataagcacataggtgaaaaagttgtgcgcacagatggccttccatatcc

SEQ ID NO: 3225 - DNA, 310 bp, Homo sapiens
ggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggacccctggtcctccaggtccccctggccctggcatcgacatgtccgccttttctggcttaggcccgagagagaagggccccga

SEQ ID NO: 3226 - DNA, 310 bp, Homo sapiens
gaaccgtgctgcatactatcctcctagccaaattgctcaactaagaccaagtcctcgctggactgctcagggtgccagacctcatccattccaaaatatgcccggtggctatccgcccagctgctcctagaccaccatttagtactatgagaccagcttcttcacaggttccacgagtcatgtcaacacagcgtgttgctaacacatcaacacagacaatgggtccacgtgctcgcagctgcagccgctgcagctacttctgctgtccgcaccgtttccacagtataaatatgtctgcaggaggttcgga

SEQ ID NO: 3227 - DNA, 290 bp, Homo sapiens
gaagctgtagcgtatggtgctgctgtccaggctggtgtgcctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggcacatatagatctgactggaatt

SEQ ID NO: 3228 - DNA, 330 bp, Homo sapiens
cgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggacttaagagttcgagagatccaagaggaagaatccagctgcctattaaaatgacaaatgagcaacgcatcccgatgacgggttccctgtctcttaaagacctttctcttggaggaggagtcttcattttag

SEQ ID NO: 3229 - DNA, 208 bp, Homo sapiens
gacagatccagacacttgccaccaatgctcaacagatttacacagacagaggtccagcaaggacagcagcagttcagccagttcacagatggacagcagctctaccagattcagcaagtcaccatgccttcgggccaggacctcggccagcccatgttcatacagtcagacaaacagaccttcgacgggcaggacccccaggtgtacc

SEQ ID NO: 3230 - DNA, 215 bp, Homo sapiens
ctcgtgccgaattcggcacgagcgcatcccatccggctgggcctggccctcaacttctccgtgttctactatgagatccagaatgcacctaagcaagcctgcctcttgagccaaacaagccttcgatgatgccatagctgagctggacacactaaacgaggagttctatataggactccacgctcgatcatgcagattgctgcgagacaaactca

SEQ ID NO: 3231 - DNA, 115 bp, Homo sapiens
ctcacacttcatctaagatgttcctctttgcgctcaaacaaaatggggagtctcaatgagtttttaaaagatttctttcttccttttttttggggggggggtaaataaatgagcc

SEQ ID NO: 3232 - DNA, 105 bp, Homo sapiens
ctcacacttcatctaagatgttcctctttgcgctcaaacaaaatggggagtctcaatgagtttttaaaagatttctttcctccttttttttggggggggggtaaa

SEQ ID NO: 3233 - DNA, 174 bp, Homo sapiens
ttaagcaaaggtatttttgaagtggtgtagaacccttccaagctttcctgctcagtgttctaccagacttaccctggggcctcgcttaaaagcaggattgaagaaaagggactcggggaaggaacttattgggaaacttgatagcgaatgagtttctgcttggcacagtctctg

SEQ ID NO: 3234 - DNA, 245 bp, Homo sapiens
gttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgagctctttaagttgcctttagtgttggtgctgatttttctttttacaattaccaaaataaaatttattaagagaaaggg

SEQ ID NO: 3235 - DNA, 257 bp, Homo sapiens
aatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagttttaaaatcagtactttttaatggaacaacttgaccacaaatttgtcacagaattttgagacccttaaaaagttaatgagag

SEQ ID NO: 3236 - DNA, 306 bp, Homo sapiens
tgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgttgtgctcacacctgtaatcccagcacttcgagaggctgaggcaggcggattgcctctagctcaggatttcaagavcaccctcgggtaacataggtgaaaccctcgtctctactataaatacacaaaaaattagctctggtgttgtgg

SEQ ID NO: 3237 - DNA, 215 bp, Homo sapiens
ggcgatatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgttgggatcttgcactgtgtggtcctgcattaagacagttgcttgcggtgtcttga

SEQ ID NO: 3238 - DNA, 210 bp, Homo sapiens
atcaatagaaaactaatacagagtataaagaaagtataggaagtaattcaaatataaattccaactctacaattccaactgcaggttacactagaataattaaaacaaagtcaggagatattctgctaatccatgttctttttaaactcctgtagggccttcagagtgacaagttctatggccaaggggtttactcctatttaccatggg

SEQ ID NO: 3239 - DNA, 305 bp, Homo sapiens
agatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttggtatagcccaagaaccacttccatgccatactgtaacattccaacatctttagctgatcagatctctccatatactctcttgccagcttttttccgtgctcccccaactatgtatcagataagagtctctgatc

SEQ ID NO: 3240 - DNA, 295 bp, Homo sapiens
tctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaatttgaatttttttttcaacactcttacacctcttatggggaatgtcaaccctg

SEQ ID NO: 3241 - DNA, 277 bp, Homo sapiens
ggaaactgtgcaaatacatggaaattaaacaacatgcttctggatgatcattaggtcaataaagaaattaagaaaatcaaaaacatttttgaaacaatggaaaatggaaacacagcatacctaaacctatgcgatacaggacaagcagcactaagaggaaagtttatagcaataagcacctacaccaaagaaagtggaaggatttcttataaaccaccttaatgatacacaacctcaggaaagcagggattaaccattcccaaaattagtagaagga

SEQ ID NO: 3242 - DNA, 240 bp, Homo sapiens
tataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttcttgtgtccttttccttactaagtgttttgaat

SEQ ID NO: 3243 - DNA, 228 bp, Homo sapiens
gctagatggcatgatattagaagggaaagatcttttggttttcatttgatgattatcaggtttctttaagtctaaaaaatgccttaaaacttaagtaataaaagaaggtgttctttttggctcatgcagtgtgtcgatctctgtctctcccaagcatttttagactttatgccagagaccacctggaggcaaaaggcaccatttatttaattccttccatactagtac

SEQ ID NO: 3244 - DNA, 236 bp, Homo sapiens
agcagcaacaagcctctgaggggagaccctggagtgatcaagcagaaggtcctgagggagaaggtgccatgcctttgtttggaagacccaagaaaaggactcttgggagcgttctccaggccaccccagaggcagccagtcagctctcggaacgccctcagaggggtggagttagaagccagcccagttaagacaggaccctgaggaaacagacacattgttgaggaggttagagg

SEQ ID NO: 3245 - DNA, 217 bp, Homo sapiens
ctcgtgccgaattcggcacgaggttacattgattattctgaatttgtggctgctcttcatcccaacaaggatgcgtatcgaccaaccaccgatgcagataaaatcgaaggtgaggttacaagacaagttgctcagtgcaaatgtgcaaaaagggttcaggttgagcagatcggagagaataaataaccggtttgggatctcaacaagtgccgcttgt

SEQ ID NO: 3246 - DNA, 234 bp, Homo sapiens
aaaaaccttgtaaaaaaagcaaaaatgacaacagaaaaacaatcttattccgagcattccagtaacttttttgtgtatgtacttagctgtactataagtagttggtttgtatgagatgggtaaaaaggccaaagataaaaggtttctttttttttccttttttgtctattgaggtgctggttattttttttggcctgtttgatgtatgtgttgaaacaatgttgttccacaatw

SEQ ID NO: 3247 - DNA, 178 bp, Homo sapiens
gatcacagtgttttcatcagaactaagtagagggtcggttcctgccctggttttggggtagctagaaaaggaaatcatgaatgcactggaaatgttggctcgagagaaaagacttgcatagctcttcctcgcagtgggtgagagcgtattgatcggagggaccttgcagaggttctat

SEQ ID NO: 3248 - DNA, 125 bp, Homo sapiens
agaagtaagattttaatggttatgataaggaatttgttttggaggtttggaaaatggaattgtttttttttttggcgtctaataatcctggttttgggaggaaatttgtgggttatcttgtttaa

SEQ ID NO: 3249 - DNA, 377 bp, Homo sapiens
agaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaaaaaaaaaaaaaaaaaaaa

SEQ ID NO: 3250 - DNA, 241 bp, Homo sapiens
gacgagtccaaccatgaccctcagtttgagccaatagtttctcttcctgagcaagaaattaaaacactggaagaagatgaagaggaactttttaaaatgcgggcaaaactgttccgatttgcctctgagaacgatcttccagaatggaaggagcgaggcacttgtgacgtcaagctcctgaagcacaaggagaaaggggccatccgcctcctcatgcggagggacaagacccttaagatct

SEQ ID NO: 3251 - DNA, 208 bp, Homo sapiens
tcttgatctgcagcttctctgaagtttggaaaagaaaccttcctttctggagtttgcagagttcagcaatatgatagggaacaggtgactgatgggaccaagagtgacaagcatacacaactacttattatactgtaggagttttgactttgttgatactgagacttactatgaaagtttaaatatgtaaacggattaatgaatttac

SEQ ID NO: 3252 - DNA, 257 bp, Homo sapiens
ggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaattcagtttcattaactccttccctcg

SEQ ID NO: 3253 - DNA, 138 bp, Homo sapiens
aagaatatgaagggggccgaggcgagtcttctaagagggacaagtcaaagaggaagaagaaagtaaaggtaaagatggaaaagaaatccacgccctctaggggctcatcatccaagtcgtcctcaaggcagctaagcc

SEQ ID NO: 3254 - DNA, 183 bp, Homo sapiens
ctgtgggggaggggttgtattcgggttgtttttgtttttttcttgccaggtagataaaactgacatagagaaaaggctggagagagattctgttgcatagactagtcctatggaaaaaaccaggcttcgttaggatgtctgccttactgggttccccaggaaggaaaaatccattcccaccct

SEQ ID NO: 3255 - DNA, 167 bp, Homo sapiens
aaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcgggagataggaaatatgtcacttga

SEQ ID NO: 3256 - DNA, 190 bp, Homo sapiens
ctcgtgccgaattcggcacgagcccactgcaagctcttctcaaattttagtttaattggcattgcttgttttttgaaactgaaattacctgagttttcattttttctttcgaatttataggggttagatttcttgaaagcagcatggaatatatcaccctacatcctgacaattaatttccattccggtg

SEQ ID NO: 3257 - DNA, 120 bp, Homo sapiens
cccctagggaagaaacggaatagtgggtgggttgcgcagggcgtcactccgcagaagggcgggataattaaaaatcctttctaatattggcggggaaaatggccatgtcctcgagccatc

SEQ ID NO: 3258 - DNA, 296 bp, Homo sapiens
ccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaaaaaaaaaaaaaaaaaaaaaa

SEQ ID NO: 3259 - DNA, 232 bp, Homo sapiens
gagatgcaaaggaaataaaacccgaggcttctgcctttggtgcgtgtacagccaggtttcagagacccatatggttttagctttagaaaggatgttggagattatttagttctcttctcccagtttataaagaagactgcggtccagaaagactgaaaattcaggcaaccagtcaagtgctcttaaaggatatgcatacccaggaaaacttggaaactgtaaaactgccagt

SEQ ID NO: 3260 - DNA, 202 bp, Homo sapiens
tgcactttgaagatgagttactccttgtcatcttacaaatatgtgatatggtaattttcataacagatgtcagttttgaaccaagaattggtgatttgtttataagaaaaaaactgggcttcatttctgtgaaattgctctttgaaaatttctttttacacgtgttaagccaactgaggataccgtgatggtgttgatttct

SEQ ID NO: 3261 - DNA, 176 bp, Homo sapiens
gctggctccctcttagattcttgtaccaagcttcttcagaaagggattcatccaaccatcatttctgagtcattccagaaggccctggaaaagggcattgaaatcttgactgacatgtctcgacctgtggaactgagttacagagaaactttgttaaatagtgcaccacttcactg

SEQ ID NO: 3262 - DNA, 312 bp, Homo sapiens
ctcgtgccgaattcggcacgagcaggaatggcgagttgcaagtatggctcagtcagctcctagcgaagccccgagctgcagtcccttttggaagaagaagaagtacatagacaaatatcttggccaagcacagctcgattttttgatcagttggatgttgtttcctacgaggaagtcgttcggctccctgcattcaagaggaagaccctggtgctgatcggagccagttgggttggtcgcagccacattaagaatgcccttctcagccagaatcccgagaagtttgtgtaccctgtcccatatacaacacgg

SEQ ID NO: 3263 - DNA, 119 bp, Homo sapiens
ttggatgcagatgcaagcggagtaggacccctccacggtctcgaactcggctgcagtaaagtacgtgaggctgtctctcggggcctagaagttgcacgcatacagattgctctttctta

SEQ ID NO: 3264 - DNA, 141 bp, Homo sapiens
tcggttagcagctggattgaggactttcataaaatcaaaataactggatgcagagtcctactcagcattaggggctagagggaatgcttaacctggagagagtaagtagccggtagcattactcagctggtaaaacagatc

SEQ ID NO: 3265 - DNA, 235 bp, Homo sapiens
ctcgtgccggtttgagaccagcctgggcaatatgacgaaacctctctccactaaaaaatacaaaaaataaactggggcatggcagcatgtgcctgactcccagctattcaggaggctgaggcaagagaatggcttgaaccctgggahgvaaaagttacagtgagccgagatcacgccaatgaactccahcctgggtgacahahcgagactccgtctcaaaaaaaaaaaaaaaaaa

SEQ ID NO: 3266 - DNA, 136 bp, Homo sapiens
ccttagcattcccccagtccctccctcttcaccttgctcccctctattgtctttccagctcagcctttttccccactcttaaatactgtactacttcactgtaagaacgaaagaataggttaggatacccattgag

SEQ ID NO: 3267 - DNA, 156 bp, Homo sapiens
cctcaggaaattctacaagggcaagaagtacaagcccctggacctgcggcctaagaagacacgtgccatgcgccgccggctcaacaagcacgaggagaaccttaagaccaagaagcagcagcggaaggagccgctttaccccctgcggaagtacgs

SEQ ID NO: 3268 - DNA, 176 bp, Homo sapiens
acccgaacactgatcgctgggtggccacgggcatcgtgtcctggggcatcgggtgcagcaggggctatggcttctacaccaaagtgctcaactacgtggactcgatcaagaaagagattgaaggaggaaggactcagcccagaattcactaggttcgaatccagagagcagtgtgg

SEQ ID NO: 3269 - DNA, 213 bp, Homo sapiens
accagctggcctcagcctcagagctccccctgggctctcgacctgcgccccagcccccagtacctcgtccggagcactgtgagggagctgcagtaggactcaaggcagcccaggggccacctgctcctcgctgtgcctcctaaatacagatgtcatggcctgcacacagacagccctcttgcagaagctgacctcgggatcttctgaacttgk

SEQ ID NO: 3270 - DNA, 110 bp, Homo sapiens
cacatggaaactaaacaatgttcttccttaattgaccagtgagtcagttgaaaaaatttaagaagggaatttgggaaatttttctttgaaggccaattgataattgggag

SEQ ID NO: 3271 - DNA, 434 bp, Homo sapiens
aacacatggaaactaaacaatgttcttcctaatgaccagtgagtcagtgaaaaaattaagaaggaaattggaaattttcttgaagccaatgataatggaaacacagcatacaaaaacatgtgggacacaatgaaaacagtactcagagggaagcttatagctataagtgactacctcaaaaaagaaaaagaacttcaaataaacaacctaccaatgcatcttaaagaattaaaaaagcaagagcaaaccaaacccagaattagaaggaaagaaataatgatcggagcaaagataaatgaaaatgaagaaaacaatacaaaaaatcaatgaaaccaaaccttggttttttttattttgttttcattttgttttgttttgagaagataaaattgacaaactgtaacccagactaactaataaaaaaaaaaaaaaaa

SEQ ID NO: 3272 - DNA, 188 bp, Homo sapiens
tgacgtgggtggccagcgcgatgaacgccgcaagtggatccagtgcttcaacgatgtgactgccatcatcttcgtggtggccagcagcagctacaacatggtcatcccgggaggacaacccagacccacccgccttgcaggaaggctctgaacctcttacaagagcatatcgtggaacaacagatggg

SEQ ID NO: 3273 - DNA, 216 bp, Homo sapiens
ggcaagcttgccagtgtacctgctggtggggctgtagccgtctctgctgccccaggctctgcagcccctgctgctgggttctgcccctgctgcagcagagggagaagaaagatgagaagaagggagggagtctgaagagtcagatgatgacatagggatttggcctctttgattaaattcctgctcccctgcaaataaagccttttttacacatca

SEQ ID NO: 3274 - DNA, 341 bp, Homo sapiens
gtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggagagagccttttccttctccttttcttactctcccctcatggtgtttccctcttaaaggagaggagcttttaatttacacttaccacctcatttgcttttctggaggccatgcaatataggcgggactacagagttaatctcctctttacacatgaggccacgagaggcctcatttggttcacagtcatgcag

SEQ ID NO: 3275 - DNA, 270 bp, Homo sapiens
acccggcgaacctggaagtggaccatgatttcttccaggacaaggtgtggccccatgtggccctgagggtcccagcttttgagactcttaaggttcagagcgccttggccggctattacgactacaacaacctttgaccagaattgcgttgttgggccccacccgctaggtgtcaacatgtactttgctacttgcttcagttggcacgggcttcagcaggccccttgcatttggcgagctctagcagagatatggactctaagggcagag

SEQ ID NO: 3276 - DNA, 225 bp, Homo sapiens
ttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaactggtaatttttttaatttacaaaattaaattgaggcataaccgttgcctctgcgtgcaata

SEQ ID NO: 3277 - DNA, 200 bp, Homo sapiens
aacaatataggcttcaagaagggctggtcctaagagggggcagaaatgaatgaccaggttaaatccctctacatgtggtttctgtttgaaaaaaagaaaactgacatttgaacagggcttttaatttgtttaaaactctgtgtaattacttgtaaccagtaggaaattggaggcattcttattttaggaaaagtgacaga

SEQ ID NO: 3278 - DNA, 231 bp, Homo sapiens
ccaggagaacaaggggaaaaaggtgaccgagggctccctggaactcaaggatctccaggagcaaaaggggatgggggaattcctggtcctgctggtcccttaggtccacctggtcctccaggcttaccaggtcctaaggcccaaagggtaacaaaggctctacttgacccgctggccaaaaaggtgacaatggtcttcacaggctcctcgggctctcaggtgcacctctgt

SEQ ID NO: 3279 - DNA, 191 bp, Homo sapiens
ggggaattgaggaaaaatggattaatacaagagtcctgtgataatatacaaccaagacagggttcttttaacatggattccatgcagtgaatgaagacataggtttcttacccaacacaaatggacagtgggatttgactttcttaaagactttttttgtgggacaattttacaatttggagaaggaaaga

SEQ ID NO: 3280 - DNA, 282 bp, Homo sapiens
caaaaatagagtgggcttcctcaaggagatgggcacacctggctatcggggtgaccgcatcaatcagctcatccgtcagctgaactagacccaggtgaggcaggctgaaaactgcccttggctgacttttgataggccatgccttgccactttacaagttctttttgcatttactagtatttagagtaaccttgagattgggaggaatagaggaggctgcacacatagatgagacctcctggacagtaattccttattagacatgggctatcatagcctaga

SEQ ID NO: 3281 - DNA, 113 bp, Homo sapiens
cgtgaggaaggttgcaagccaacacaaaagttcaaggatctagaagacgattaagggaaggtcgttctcagtgcaaattccaaactcccagacacatatgtttatacaaccct

SEQ ID NO: 3282 - DNA, 187 bp, Homo sapiens
attagttatttacatcaaaaagcttttagaaaatggtacgaggtaaccaattcttgtcatggtgaaatctgattgagtaaccaagcagttttactattctggtgcctgcttcataacacaaatgaaaagctgcatgcatctacagcaggcatggattgtttatgtcgtatgatatcctttattaagt

SEQ ID NO: 3283 - DNA, 273 bp, Homo sapiens
ggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactcatctttgctgtgcaagcagctgtgaagatggacgtacttggtctgactacaatattcaaaaggagtctactcttcatcttgtgttgagactccgtggtggtcctaagaaaaggaagaagaagtctt

SEQ ID NO: 3284 - DNA, 251 bp, Homo sapiens
ataaattttggtggagacaaaccacatccagcccataacaactacccaccttctttctgcttcattctctgccctttctttctgctggctcccctcactcttggttcctttccctttctgatctttctctcctattctttctccttcccttctgtgctccctctagtcctctccctgctcaccagatgacttcagcctctgtgtctccatttcctgtctgcatctgcatggtgtttgtttcctcgggctct

SEQ ID NO: 3285 - DNA, 280 bp, Homo sapiens
agtcactctaggactctgcactgaatggctgacctgacctgatgtccattcatcccaccctctcacagtttggacttttctcccctgctctttctaagagacctgaactgggcagactgccaaaataaaatctcggtgttctatttatttattgtcttcctgtaagaccttcgggtcaaggcagaggcaggaaactaactggtgtgagtcaaatgccccttgagtgactctccccagcccaggccagaggacctccctacaggtgtcgggcgcaggaact

SEQ ID NO: 3286 - DNA, 263 bp, Homo sapiens
cagatgctgaagaggagaaatgtaagctcatttcctgatgatgctacttctccgctgcaggaaaaccgcaacagccagggcactggtaaattggtctgttgatgacattgtcaaaggcataaatagcagcaatgtggaaatcacgctccaagctactcaagctgccaggaaactactttccagagaaaccagcccccatagacaacatatccgggctggtttcattccgaaatttcgtgtccttcttggggagaactgattgt

SEQ ID NO: 3287 - DNA, 88 bp, Homo sapiens
ttaaaaaataaacacatttttaaagatgttgaatttttccccccttattgggaattcttaaaaataaatgcatgcatgttttcccctg

SEQ ID NO: 3288 - DNA, 310 bp, Homo sapiens
catgcctgggccctgctgggctctcccactccaggcggaccctgggggccagtgaaggaagctcccggaaagagcagagggagagcgggtaggcggctgtgtgactctagtcttggccccaggaagccaaggaacaaaagaaactggaaaggaagatgctttaggaacatgtttttcttttttaaaatatatatatatttatacgcgatcctcttcccatttatttctgggaagatgtttttccaaactcagagacaaggactttggtttttgtaagacaaacgatgatattaggccttttgtaagaaaa

SEQ ID NO: 3289 - DNA, 136 bp, Homo sapiens
gaaccccggcatatatggctggcaacgagagcaatttctcttgccaagaaacaaagccaaaggagccaaagaacgagatggggaacaacaccgtgactaaaacaaacagtatcagtaaggaacgggatccgttccc

SEQ ID NO: 3290 - DNA, 563 bp, Homo sapiens
cggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaagggcccttgttagctggccatccctgcccattttttcccctggtcctttcccctgtggccacagggaagtttggcctgaatacccaacccggctctctgcaccagagctgggggcaactcagaagtgtatctctctctgagcacgcattccctgcagcatcaggatgacagattgagtatgctggg

SEQ ID NO: 3291 - DNA, 253 bp, Homo sapiens
gccttgtgaaatgcgcctgctctatggacataagggtgcgggtactgggcggcgccaccctctggacagggggcgcagaccggggctgccctccctgcaagcctgagggtcatgtttgtccacagtggtcgtggtccacagctactcgggaggctgagggagggaattgcttgaaccaaggaggcggaggttgcagttagccgagatttcaccactagactcaggtctgtattacaaacccagactctgtctc

SEQ ID NO: 3292 - DNA, 137 bp, Homo sapiens
tgaatacaaaacaaataagccatcacgcctgcccttccttgatattgcacctttggacatcggtggtgctgaccaggaattctttgtggacattggcccagtctgtttccaaataaaatgacctcaatctaaattaa

SEQ ID NO: 3293 - DNA, 109 bp, Homo sapiens
actcgtgccgaattcggcacgagtcaagaatctttctcagtagttttttgttcttaattctatgaaactggaaatctaagccaaatcaggttatttagactactaaaat

SEQ ID NO: 3294 - DNA, 280 bp, Homo sapiens
ctcgtgccgaattcggcacgagccagaatctttctcaatgtttttgttcttaattctatgaaactgaaatctaagccaaatcagaaattatttagactactaaaattattacctaaatgattaatgttaagttgcctcacaatagcaaatctcagtatcaaacattcccatgctttgggaggctgaggcaggaagatcatttgaggtcaggagtttgtgaccagcctgggcaacatggtgaaaccccatctctactaaaaatacatcaaaaaaaaaaaaa

SEQ ID NO: 3295 - DNA, 234 bp, Homo sapiens
gaaataatggctgaaaaggaaaacaaaacaataatatttgtggagacaaagagacgctgtgatgatctgactcgaaggatgcgcagagatggttggccagctatgtgtatccatggggacaagagtcaaccagaaagggattgggtacttaatgagttccgttcttggaaaggcacccatccttattgctacagtttgtggcctcccgtggctagatgtggaagttgtcaagtt

SEQ ID NO: 3296 - DNA, 300 bp, Homo sapiens
gcgcgacagaggacacttccttttgcgggtggcggcgaacgcggagagcacgccatgaaggcctcgggcacgctacgagagtacaaggtagtgggtcgctgcctgcccacccccaaatgccacacgccgcccctttaccgaatgcgaatctttgcgcctaatcatgtcgtcgccaagtcccgcttctggtactttgtatctcagttaaggaggatgaagaggtcttcaggggagattgtctactgtgggcaggtgtttagagagtcccccttgcggtgaagacttcgggatctggctgcg

SEQ ID NO: 3297 - DNA, 300 bp, Homo sapiens
cccaaacccacttccaccctactaccagacaaccttagccaaaccatttacccaaattaaggtataggcgatagaaattgaaacccttggcgcattagatatagtaccgcaagggaaagatgaaaatttatacccaggcatattatagcaaggactaacccctatacctcctgcatattgaattaactagagatatctttgcagggagagccaaagctaagaccccggaacccagacgagctacctgagcacagctaagagagcacaccggtctatgtagcaaaatagtgggagatttat

SEQ ID NO: 3298 - DNA, 276 bp, Homo sapiens
gctcaacaagactatgcgcattcgcatgacagatggacggacactggtcggctgctttctctgcactgaccgtgactgcaatgtcatcctgggctcggcgcaggagttcctcaagccgtcggattccttctctgccggggagcccgtgtgctgggcctggcaatggtacccggacaccacatcgtttccattgagggccagagggagattcttaccgggcttccgtatctcttaccacgatggcgcttacctttcagacttcattaaacttatacc

SEQ ID NO: 3299 - DNA, 280 bp, Homo sapiens
ctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaaggtctgttaaaaaaggaatctgtttcaacagttgacctgtacaataccgtgtggtgaaaatgaattcaggcttatataaatgatgga

SEQ ID NO: 3300 - DNA, 220 bp, Homo sapiens
agctgtcacagtgacacacaaacaacttacagacttccacaagcaagtcactagtgctgaggaatgtaaacaagtttgctgggccttgcgagacttcaccaggttgtttcgatagctcacactcctgcactgtgcctgttcacccaggaatgtcttttttaattagaggacagggaggaaaccaaaacccgactgtgttcccacaatcagaaaccttcgt

SEQ ID NO: 3301 - DNA, 194 bp, Homo sapiens
ctcgtgcgaattcggcacgagctttaaaccctgcgtggcaatccctgacgcaccgccgtgatgcccagggaagacagggcgacctggaagtccaactacttccttaagatcatccaactattggatgattatccgaaatgtttcattgtgggagcagacaatgttggctccaaggcagattgcagcagattccc

SEQ ID NO: 3302 - DNA, 195 bp, Homo sapiens
gcctgccactccaggctcacacaccctggacagtctccacgtgggagacctggtgggaggcttgggcacgggtgggctggaggctggagggagggttttttcatttgggcgggtttctctgggaacttggagggaccctcttcctattgtaccgggatacccagggattcctttcaagggggggaacggccttaa

SEQ ID NO: 3303 - DNA, 530 bp, Homo sapiens
gcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatggtgagtgtgttggaccgtctggaagggttcagccagcagagttccattcacactgtgctagaggccttccgtcgagcccggcgccgcatgcaggaggcccgggaaagcctcccgcagggacctagtgagcccctctggaaccctggtctcctagctcacagcagccctggcccacagtgcaagaggacaagatgggggatatctgagggcagtgctctcctgcctcttcgtctttctgattagagaccacgttggtctgctg

SEQ ID NO: 3304 - DNA, 258 bp, Homo sapiens
gccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgtagcattaccacttaaagaggaaccagaggctttctgtcccaactgtcaaccttgacaaattgtggagtttggtcagtgtaacaag

SEQ ID NO: 3305 - DNA, 194 bp, Homo sapiens
ctggccagtcctacaaccagtattctcagagataccatcagagaacaaacactaatgttaattgcccaattgagttcttcaagcctttaggatgtacaggctgacagagaaggattccgagagttaaatcattctttccaatccagaggaccaggcgttctctctgccaggatccatctaacctggagtaagtt

SEQ ID NO: 3306 - DNA, 184 bp, Homo sapiens
ttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgcgacaagatgcagaggagatacactgccctggcacccag

SEQ ID NO: 3307 - DNA, 155 bp, Homo sapiens
ccaggccacacctagacaaacaaggagaggaggtctcagaatcagaatcatggagaaaattggccgggggtggtttgggttatgggactcattttagaaaggaggccttcctcattctttgagggcaattaaggtttttcggaactcccaagggt

SEQ ID NO: 3308 - DNA, 296 bp, Homo sapiens
ttcggtgtggacatagggccggtctgcttcttgtaaaaacctgaacccagaaacaacacaatccgttgcaaacccgtaaggacccaagtactttccaatctcagtcactctaggactctgcactgaatggctgacctgacctgatgtccattcatcccaccctctacacagtttggacttttctcccctctctttctaagagacctgaactggcagactgcaaaataaaatctcggtgttctatgtatatattgtctcctgtaagaccttcgggtcaaggcagaggcaggaaacta

SEQ ID NO: 3309 - DNA, 257 bp, Homo sapiens
tcttggcatcgactgtttgcacaaggggacaaatgatatgaagcaacagcatgtcatagaaaccttgattggcaaaaagcaacagatatctcttgcaacacaaatggttagcatgattttgaggattgatgacattcgtaagcctggagaatctgaggaatgaaggacattgagacaactatgtagcaggatccacttctgtgattaagtaaatggatgtctcgtgatgcgtctacagttatttattgtcacatcct

SEQ ID NO: 3310 - DNA, 283 bp, Homo sapiens
gaaccagttgttttgtcttgcgggtctgtcagggttggaaagtccaagccgtaggacccagtttcctttcttagctgatgtctttggccagacaccgtgggcttgttactttgctttgaggttggaggcggtttgcatttacgcctgtaaatgtatccattcttaatttatgtaaggttttttttgtacgcaattctcgattctttgaagagatgacaccacattttggttttctactgttatgtgagacattaggcccagcacacgtcattgtgtaaggaaa

SEQ ID NO: 3311 - DNA, 210 bp, Homo sapiens
gaactgggaacagccaggtgccccaaagcaaatacgcggagcttgcttggccattcatttgaaggagcttggggaagggagattcagacccaccgtaacgcaggggaggccaggagttccccattggaggaggcttaaggcgcggcaatcattcacgctagaggactctggttcggggagtccttggcagaaacggaacgcaatgccaga

SEQ ID NO: 3312 - DNA, 206 bp, Homo sapiens
tcatcctgtactgtgtggtgacgtcccctatgttgctggtggctctggctgtctttttcggcagcctgttacaatctctatcctgcgcaaccttgggagtccaaggcttgtgctctttgggccgagaggtgaagcccagcgaatcaagtatgctctggctggaggcatctccttcccttcttctggctggctggtagcgggctcgg

SEQ ID NO: 3313 - DNA, 310 bp, Homo sapiens
gagtcctggccttgtctgtggagacggattacaccttccacttgctgaaaagggtcaagggccttcttgggcttgattccatctgccctttggtggcctgcttgccctgtgtggctgcttgcacccacagctgcttcttgcttgcttgcttaggccccaggcttagggttgtaaggccaagcgtaggatctggaggagtctggacgaggatatctgggattttgggctctctcacctatctacccaaaaggcaaccccactatgcgcaggtttattcgaacacaacggggataatggcgcatctctcctt

SEQ ID NO: 3314 - DNA, 340 bp, Homo sapiens
  misc_feature 41, 42, 43, 86, 87, 88, 89, 90, 109, 110, 111, 112: n = A,T,C or G
ctcgtgccgaattacggcacgagcatggacttttcctattnnntcatcaggaccagtctcagtctggtcaagttgttcctaatttnnnnngcagttcaggctatctccnnnnggggaatgaggccaaggctttctaatctcttggttgtctctgctatatggagagcctgccctaggatggagctctgctatagatctcacatcacactcaggattgaggctgtgatctctctctctgacctctctgaatatgtacagtagtactctagatcgtctgcaatgtgtgagcagatgatatctgaatgtagtagtaatctcttagccatcaaaaaaaaaaaaa

SEQ ID NO: 3315 - DNA, 148 bp, Homo sapiens
catcccaccctctcacagttcggacttttctcccctctctttctaagagacctgaactgggcagactgcaaaataaaatctcggtgttctatttattaattgtcttcctgtaagaccttcgggtcaaggcagaggcaggaaactaact

SEQ ID NO: 3316 - DNA, 341 bp, Homo sapiens
cacgcttgtagtcctagctccttgggagtctgatgtgagaggttgctgagcctaggagttcgaggccgcagttaagctatgactgagccaccgcattccagcctgagcaccagagcaagaccctgtgtcaaaataaaaaggacctatagaggcattagtgcttggggtaacctattagcatgtcctgccagagaggttctagtgccttaacctgggtgctaagagccccccagatgagtggcttccccgtcccttcctctctctggctgctaatgcctcctccccttatagtatatactgataacacttgatcatctctgatctacttcagagctgttctg

SEQ ID NO: 3317 - DNA, 275 bp, Homo sapiens
ccttaagtagacaaggttatagaatctcaagtcatattttgtttcttctttggtaggttttagggtaccttgctgaaatgatttatcctttcacccttttattctgtagttaacttaaaggcatttagttcaaacagccattgtggagttaaacccaaattcattgaaaggttactccacttaatattttgccatttccttgctctggaatatccagctctgcaattttctggccctatgatttgggtaaagtatctctgtccacagtttcctct

SEQ ID NO: 3318 - DNA, 243 bp, Homo sapiens
gtactttccaatctcagtcactctaggactctgcactgaatggctgacctgacctgatgttccattcaatcccaccctcttcaacagtttgggacttttctcccgcctctctctctcaaggagacctgaacctgggcaagacttcaaaataaaatctcgggtgtcctattaattaatgtgcttccctgaaggaccttctgggctaaggcagagcagactctactctggtgtgagtcaatatgc

SEQ ID NO: 3319 - DNA, 370 bp, Homo sapiens
cacactcctagctgctccagtctcagcctgggcagcttccccctgccttttgcacgtttgcatccccagcatttcctgagttataaggccacaggagtggatagctgttttcacctaaaggaaaagcccacccgaatcttgtagagatattcacactaataacatcatgattatttccatgaagtttaaaaatagctcactttaaagctagttttgaataggtgcaactgtgactcgggtctggttggttgttgtttgttgttttgagtcagctgattttcactcccactgaggttgtcataacatgcaaattgcttcagttttctctgtggcccaaacttgtggttcacacaccctgttgagataaagc

SEQ ID NO: 3320 - DNA, 240 bp, Homo sapiens
cctgcaactcagccatcctgacttcccagatggtgaatatggatgatctaacaggttgctcaggagattcctcaaaggttacttgtatttcacatactggtggtgagcctgccattatctccagcacacactctctgggagatgtaggatcttcatcataggcccaagggagacccagaggttggtttgagtatttcatagagggcactcttcttctcatactgagatgtagaggatatc

SEQ ID NO: 3321 - DNA, 341 bp, Homo sapiens
ctcaacctcttctgtcctcaaagaggccaaacgcagtgcccacagtcggtagccttcactttagatgtcctattcatgtaaaagagaaggtgcccccaccaggcttacatcagcattaggcattcctattgcaccgatggtgttcacattttaccccagtgtgtgcccatgtatgcctttgtgccckgtgtatttatggttagcgcccctttcactgagaggggtgatgatacactgtggccacctcgattcacaccccacatttcctgctcgggggagctcccaggtcacaggccatctctcacctccctccaggcacagtggacactgccaccacctcg

SEQ ID NO: 3322 - DNA, 208 bp, Homo sapiens
ggagggcccccctcaagggcatcctgggctacactgagcaccaggtggtctcctctgacttcaacagcgacaaccacttccttccaccttcgacggttgggctgggattgccttaaccggaccactttgttaaggttaatttcctggattaccaccagattttggctacaccaacacagggttggtggacctcatgccacacatggcy

SEQ ID NO: 3323 - DNA, 165 bp, Homo sapiens
ggacacaagatccctttgctggtggtgacttactcacttcccccaccagagggccttgggacttccgaaaccttccgtaacttggaaagcttccttggctcagcttccacttggggggtgaaggaggccgcttccttaagccccaagccttgagcggccttccaa

SEQ ID NO: 3324 - DNA, 180 bp, Homo sapiens
gtcttggctctgccacttactggctgtgtgaccttgacacgtactaactctctgtgttccatgtctcttaactcttaaaccaaggattaaggaggtgaccctaccctccggattactaaggagggttaatctacacgtaacacatacaaacaaaggctctgctcatcttggtcactgtct

SEQ ID NO: 3325 - DNA, 118 bp, Homo sapiens
tgtggttctgctgctgcttactatttgattaccttgggtgctttctctccagctattgtttttatcttacaatttaatatatttcgattttggttaaagccagaatggaccctgataa

SEQ ID NO: 3326 - DNA, 490 bp, Homo sapiens
tgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttgggactgttagatattttgccgaattaagtatattttatgatctgcaaaaactcaatgaaaagccaggatttcaaaaccctgagcttacatttttgttctctaattaaggtgtattgtacgagcattgaaagatccaaatgcatttccttttgaccaccttcctactttaaaaccagtcaagtttttggaaggcgagcttattcatgatctttaaccatttttgtgagtgctaaattggatcatatgtcaagtttatcaagataataaagactcattgatcacttggccggtacatgacagatatggaaaaatgagacactac

SEQ ID NO: 3327 - DNA, 141 bp, Homo sapiens
cgcacgaggctggctatgtgtttagagataaggtgatgtcagagtttaataacaacttcccgcagcagatggaagaattacccgaaaaacaacccacactgcttcgatccctggacaaggatgcaaggcagattttaaggt

SEQ ID NO: 3328 - DNA, 200 bp, Homo sapiens
caacctgaaatggattgttttccacaactaagagtcactggggacactgcatatttaaaattgccaggggagtcatttggctgctgagggtttcccccagcaattgttccccagagaggggcaaaagggtccgagagagaaaaggtaagggtctccttgcacaatgtccccatagtgtttcatatgttacatatacactc

SEQ ID NO: 3329 - DNA, 210 bp, Homo sapiens
gcgcctcggaggcgttccagctgcttcaaggatgaaggctgtacactccttccagccactggctgcagagaactctatatgaggtggcgcgtgtgacgcgacaactctctgtatcttctatatagagagcgctatatgcgccacagaggttcgtactcacgcgctctggggtaagagtagtgagagtatattgtgcgccgatcacatgtg

SEQ ID NO: 3330 - DNA, 237 bp, Homo sapiens
aacagacctaaaatcgctcattgcatactcttcaatcagccacatagccctcgtggtacaagcccattctcaatcccaacccccctgaaggttcaaccgcgcagtccaattctcactaatcgccacacgagcttacacaccccactatcatattctgcctagagaacatgaaactcagcgacgcgactcacagatgcagtcactaatcctctctcagaggcatcacatcgactccac

SEQ ID NO: 3331 - DNA, 283 bp, Homo sapiens
ctcgtgccgtaatttaacatactgcaagtgtttacagaaagttggcgataggaagacctatgcctctgccaagctttcctctgagttgccttccagaaggaaggttgaagcagaagttaaagcagcttcagagaatatcaattgggacagagggtttcagaagagagtatatgtcaatatttctgtcatatctgtcacccaggtgtattagatctctctatatcgacccagtctctatatactacaatatcgagtatggctatgcacctatgtacagtcatgt

SEQ ID NO: 3332 - DNA, 367 bp, Homo sapiens
gtcgtaagggctgaggatttttggtccgcacgctcctgctcctgactcacgctgttcgtctcggccgactgacaagtcggtcaaggaaggcatgccgcgaacaagccattggtcttttatagggtacccggaaaacacacccgtggatgccggaggtggcattacccgattgcgattaaccttacacagccgaagcgtaaaatccttggaaagggtgtgcctgcacgagataaggaggcgcaaagaagagtatctcaggtgagggcacagctcgtatgcctacgagactatgagtatcactacaggaacatctcttgtggatgaggctactagacgtggcatcgtctccagatgagattcacagcta

SEQ ID NO: 3333 - DNA, 123 bp, Homo sapiens
gctctctgattagttagtgtagatctgctctgcgtactctgaacttccgctctagttaggaggcctaacagtagccgactctcgtcaaagctcaatatgcctatccctttaaatgtcaatccy

SEQ ID NO: 3334 - DNA, 138 bp, Homo sapiens
gataccatgaacataaaacccacagaggtatttgatgtatctacatgtgacaggagactctgcagataaatgaaggccagactggcatgctctactaattaacctgactaaggagggaggcattattactatactcct

SEQ ID NO: 3335 - DNA, 174 bp, Homo sapiens
gtgggtgagtgagcacagcttcatctgtatttacagctgctccccagagcttgcattactgcctgagctctgcctcccggtcaggtcaagcagcagcattagggtctcaatgggagttccgaaccctgttgtgaacctgccacaatgcgagggatctagggtagtgcgactcct

SEQ ID NO: 3336 - DNA, 144 bp, Homo sapiens
cttccttgaaaactacagtttcactctgctggagatactctggactttctctatctatcgtgaatcagtggctattctgccccaagcttttcatgatcagcaagagctctgagagagctctagagacatatactctctcacatc

SEQ ID NO: 3337 - DNA, 185 bp, Homo sapiens
gcaatagtcatgcccttgtccaggctgggatctaattgatacaataggtcgttgactccctcctagtaggagctatctaggtttgtctggaaagtttccgaccctggcttataggcaccacacctcatgtactcctcatggcttggatctctgtattcagcctttgttcagtccaataaactttg

SEQ ID NO: 3338 - DNA, 262 bp, Homo sapiens
ggaattcctcctgatcagcagagactgatctttgctggcaagcagctggaagatggacgtactttgtcttactacaataatcaacaggagtcttacctctcatctctgtgtgtgagagctctccgtggttggttctctaggaacaggaaggaggaggtctacacaccactcccaaggaggataaggacacagggagagagaggttaagctctgcgctgtcctaaatatattatagggtgggatgagtatgcgcaatattagt

SEQ ID NO: 3339 - DNA, 107 bp, Homo sapiens
aatattttgggtcactgattctttcccattttacctttggacactttatttgatcctcagatcaatttttttttttttcccatttcagacccggtttcgaaatgaga

SEQ ID NO: 3340 - DNA, 520 bp, Homo sapiens
  misc_feature 4, 5, 32: n = A,T,C or G
aatnntttgagtcactgattctttgccatggnagctttgaacactttattttatcgtcagatcaatgtgtgtttttttgccattgcagagccgtgtcaagatgagagggaagcgtagaccgcagacccgtgcagctaggcggctggctgctcaggagtccagcgagactgaggacattagcgtccccagaggacccattgcacagtgggctgatggcgccatttccccaaatggccatcggccacagctcagagcagccagtggagaagacagcactgaggaggcctggcagctgccgctgcaccttgggaaggtggtcctgtgcctggagtggacagaagcccctttgcaaagtctctgggtcattccagaggggaggctgacctttttgattccggggacatcttttccacgggcactggatctcagtctgtggagagaacaaaacccaaggcaaagatagcagagaatcctgccaacccaccagtgggtggtaagcaaagagcccatgtttcctgct

SEQ ID NO: 3341 - DNA, 132 bp, Homo sapiens
ccccatcatgggtccgatgcatgctcccgggaagggccttctcccatcggctttaacctatcgaggcgaagcgtccccaattggttgaagttgaaatctcagcgcgcgtgaaaggagcacaatttacaaact

SEQ ID NO: 3342 - DNA, 347 bp, Homo sapiens
  misc_feature 87, 88, 89, 90, 91: n = A,T,C or G
ctcgtgcgaattcggcacgagttccgcgccagagcccagcgcgcctcgtcgccatgcctcggaaaattgaggaaatcaagggacttnnnnnctcacaagcccgacggaaagcatgccaaatctgtcaaggatcaagaaaaataagggcaaccgtgaaggtttaaaggttcgattgcagcagatacctttacaccccttgtcatcactgacaaagagaaggcagagaaactcgagcagtccctgccccccggttttgcagtgaaggacctcataatgaccacgacacactgatttggacctgtattatattatatactaaatatctcaaaaaaaaaaaaaaaaaaaac

SEQ ID NO: 3343 - DNA, 198 bp, Homo sapiens
ctcccttgccacccgtggcgagtcttcgactacaatactagagttcaggcatctttttttgcaatacgagtttaatttaaaggttagcctttctagatcctctctcattcgcagcatggactcaattattttgtgactctcttaaatgttgccttcttttcttgaggcctgtcaccttactttgaagccctgtttggt

SEQ ID NO: 3344 - DNA, 374 bp, Homo sapiens
atctgccagagcctggagtcttccgaaggccgggacccggttccccggccacagttggggtgtgcaaacccgagagaacttgggttgcaaattcgtgaaggagtcagcatcatgtttggcagcttagtatttgagcgcaagagacctgtccatgtagggtttttagaacagagtgctgtttttagagctctgcagcagcatctcagacgcacgagaagggtatatctcccgaggatgtcatgcgtccagagcactagctgtcatcagagttgagactgctgaactaatcacgtcagtcatcaacatgtggtagtaggcatcgatgtctcatgatgcatcaggacgatcatcatcagcatcgatcgagtatattt

SEQ ID NO: 3345 - DNA, 334 bp, Homo sapiens
gttcgtcagagctctggcagccttcctcaaaaagtccgggaagctgaaagtccccgaatgggttgataccgtcaagctggccaagcacaaagagcttgctccctacgatgagaacttgttctacacgcgagctgcttccacagcgcggcacctgtacctccggggttgcgctggggttggctccatgaccaagatctatgggggacgtcagagaaacggcgtcatgccagccacttcagccgaggctccaagagtttgcccgccgggtcctccaagccctggagggctgaaaatggtggaaagggccaagatggcggccgcaaactgacacctc

SEQ ID NO: 3346 - DNA, 335 bp, Homo sapiens
ggctgcccgcctccgcacagccagtgtcccgctggatgccgtgcgggccgagttggagaggacctgtggcccctaccacaagcagcgtctggctgagtattacggcctctaccgagacctgttccacggtgccacctttgtgccccgagtccccctgcacgttgcctacgttgtgggttaggatgacctgatgcctgtgtactgtggcaatgaggtgactccaaccgaggctgcccaagcgccagaggtgacctatgaggcagagagggttccttgtggacgttgctactcactagcttggatggacacctcctggagcagatgctgagtacctc

SEQ ID NO: 3347 - DNA, 181 bp, Homo sapiens
ctcgtgccgcaagatcaaataaggctatgcttattttgtgctgccaggaactgtagcaactctgtgttcttaggggcacacatgtgttttgcaggccctcctgtcctgggggttcaattctggctatatcctctaaggggcgcaagggtaagggacgcttctgggcccagaggaaaaaaaa

SEQ ID NO: 3348 - DNA, 338 bp, Homo sapiens
gtgacaaggacgcccgaagcacagtggacggtcatgaaggagcgggggtttggcaggcgggttacgtccaggagagggagcgccccttgctgcccctcggccgccgacttgacgcgcgggccttgccagcgagcaccctcatcgggctgtcgcctgacagcatacctcaaaaggccctagctaataaacctgtaagcccagcatttgagagaaggtagggtgtttatatataaaaggttgtgtacacctccacgaggtgaaaaatattcagtaacttgtttacatagcatttgtgtaaagactatgatctcatcccaataaaatgatatattaaccct

SEQ ID NO: 3349 - DNA, 154 bp, Homo sapiens
ctgtaatcccagctactaaggaggctgaggtaggagaatttcttgaaccaggaggtagagtttcattgaagctgagattgagccactgcacatccagacctgtagtgtacaaagatgtagacatctcatctcaaaaaaaaaaaaaaaaaaaaaa

SEQ ID NO: 3350 - DNA, 95 bp, Homo sapiens
gtggagatgacccctccctgtgccggctggttcctctcccttttcccctggtcacggctactcatggaagcaggaccagtaagggaccttcgatt

SEQ ID NO: 3351 - DNA, 175 bp, Homo sapiens
  misc_feature 50: n = A,T,C or G
acaagtttcacaaaagaagcctacaagaagtacatcacagattacatganatcaatcaaagggacacttgtaaggacagaggacagagagaggtataaacccttttatgtacacagggtcttcagagacacactcaaggcacacttctctgtctatattttcacaaaactctccc

SEQ ID NO: 3352 - DNA, 96 bp, Homo sapiens
ccgcggcgcttcccagcaccaacatgtaaccggcatgtttccagcagaagacaaaaagacaaacatgaaagtctagaaataaaactggtaaaaccc

SEQ ID NO: 3353 - DNA, 205 bp, Homo sapiens
tcaagtccaatggcagcgtcttcgtccgggactcctctcaggtgcacccgctagctgtgctgctgctgaccgacggggacgtgcacatccgtgatgacgggcgccgggccaccatctcactgagcgacagttaccgtctgcggctggagggtgactcgcgtaccgtgcggctgctgaaggagcttcggcgggcccttggcgcaat

SEQ ID NO: 3354 - DNA, 168 bp, Homo sapiens
gagacagcatgacgccgaggtggatgccacactcaagtccctcaacaccagattgagagcatccgcagcccccgagggcttccgcaaggaccctgctcgcacactgcagagagacctgaaactctctgcacacctgagtgtggagagtgtgagagctctcttgagatt

SEQ ID NO: 3355 - DNA, 150 bp, Homo sapiens
gcaacctgggcctcaagcatgctgctgcagtgaatggcgccaacccgtggcagtcccagaagctggaggcaggaggatggatcctaatctccatgggaagtgtaagcgtgtggctgcaagggaagcgtggcaggcgcctggccttgggtc

SEQ ID NO: 3356 - DNA, 136 bp, Homo sapiens
cgaaagcagaagggaagctcctgcccctcctaaagcttaaggcaaagcgaggctttaaaggccaaggaggcagtttttaaaggtgttcacagccacaaaaaaggaggaggtccgcacgtcacacccaccttccgcg

SEQ ID NO: 3357 - DNA, 130 bp, Homo sapiens
gagaatttggataaatacttgttgagggttggacaattaaggtagaggaacttagcataagtaatattgaaccctgccctgttgagcagaaaattacttaatagggatttaaagttagttttcttagggg

SEQ ID NO: 3358 - DNA, 540 bp, Homo sapiens
  misc_feature 89, 146: n = A,T,C or G
gagaatttggataaatactgttgagggttggacatttcaggtagaggaactagcataagtaatatagaacctgccctgtggagcagaanattactgaatagggattgaaagtaagttttctgaggggagatagaattaaaattganaaggaaccattgtgaaagtcagtgtggcgattcctcagggatctacaactagaaataccatttgacccagccatcccattactggatatatacctaaaggattataaatcatgctgctataaagacacatgcacacgtatgtttatagcggcactactcacaatagcaaagacttggaaccaacctaaatgtccaacaacgatagactggattaagaaaatgtggcacatatacaccatgggatactatgcagccataaaaaatgatgagttcatgtcctttgtagggacatggatgaaactagaaaccatcattctcagcaaactatctcaagggcaaaaaaccaaacaccgcatgttctcactcataggtgggaactgaacaatgagaacac

SEQ ID NO: 3359 - DNA, 275 bp, Homo sapiens
gggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttattccttggagagggctttttaatgaaacccatgcccagggtttgaaggggtttagcatccactttcaggggag

SEQ ID NO: 3360 - DNA, 135 bp, Homo sapiens
atgaacatagaattgctgcttttatatttaactgcagattgtgaattcactgccttatattatttatttctgacacaacagaagcaatttttaattaaacctactgaaatttttgaaaaaaaaaaaaaaaaaaaa

SEQ ID NO: 3361 - DNA, 240 bp, Homo sapiens
tgaacgcgccacctacatcggaacctccaactggtctggcaactacttcacggagacggcgggcacctcgctgctggtgacgcagaatgggaggggcggcctgcggagcagctggaggccattttcctgagggacttggactccccttacaagccatgaaccttgacaacctcaactgacaagcttgggcaacgcctgccgcctgctctgaggcccgatccagttggcaggccaaggcct

SEQ ID NO: 3362 - DNA, 198 bp, Homo sapiens
aaaagttattaagccacctgattaaaagaaaaccaatatttaaaggcatttaatagatatcaagtataacctttgaggagaagaatcaatctgtattacccaaaaaaaaattgttttcattttctggtaagatacacatgaactcggtacactaaaagtgcaaattttgtgttactcgcaaaaaaaaaaaaaaaaaaa

SEQ ID NO: 3363 - DNA, 220 bp, Homo sapiens
ccgccgcttgttgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggccggagaactcactgaggatgaggtggacgtgt

SEQ ID NO: 3364 - DNA, 200 bp, Homo sapiens
agaagacctcacggcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgac

SEQ ID NO: 3365 - DNA, 180 bp, Homo sapiens
cggcacgaggcgaggtttcaccatgttggccaggctggtcttgatctcctgaccttgtgattcaccaacctcggctctactaaaaatacaaaaagtagccaggcatgatggcgcatgccttaattccagctaccccggaggcttagacgggagaatcgcttggacctcgggaaggagaag

SEQ ID NO: 3366 - DNA, 205 bp, Homo sapiens
gtcgagtccgtgtctcggctgacggcatgctccgggccctgctgggctccaagcacaaggtgtccatggatctgcgggccaacctcaagtctgtgaagaaggaagacacagagaaggagccgcctgttgaggttggttacttgagagaagaacgttgagagccatgtcttgcatatgaagggcccgaagagagatattttgatgt

SEQ ID NO: 3367 - DNA, 273 bp, Homo sapiens
aaaaaacatgagggaagaagaagccaaagctgagcgtgagaagaaagagaaaggaacagaaagagaaaggattaaattaggattcaggagattttattactcattttgggcaccatttcagtgtaaaagcagtcctactctccacactaggagggctttccttttttgacctggtccagtgggaaatttggcatttcacattctgattgggtccttgtcatttctgtccattgattcctttattgtcgcgttgttggttcccttcttgggcgt

SEQ ID NO: 3368 - DNA, 323 bp, Homo sapiens
atacatggatcaggccagtgggaatgtaaagaaggccctgaaggctgattgggtcaaattgagggtgatttcaaggctgagggaaattagcaaattcacctacacagttctggaggatggttgcacgaaacacactggggattggagcaaaacagtctttgattatcgaccacgcaaggctgtgagactacctattgtagatattgcaccctatgccattggtggtcctgatcaggaatttggtgtggacgttggccctgtttgctttttataccccaaactctatctgaactcccaacaaaaaagttttaactccatatgtg

SEQ ID NO: 3369 - DNA, 316 bp, Homo sapiens
cgggagcgcttcgcgagatctcggaccacccaacctgaaaggtgcttaggaagttgaaaggcccaaaggagggcctcccggcaaaatggcccgagccttggaccgaccaattcttcctaacgagaagaagaaattgcctgttgcaagtggcggtaagaaccacgctccagttcctgggggatttcggaccggagagacgcgcagagaaacctctgcccggcctaaagcgcgccccaaaagcaagctaagagggcgcttcttcaaacaagacaatttcgcaatttcgcattaaaaaattggacgacaacttgctggc

SEQ ID NO: 3370 - DNA, 310 bp, Homo sapiens
ggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctccgtgggctctcatattctacctcacttctcactgtcagaccgttttttcaacctcacatggttgaattcagtttgg

SEQ ID NO: 3371 - DNA, 330 bp, Homo sapiens
tgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctataagcaggtagcaggtaccatgaagctggaattggctcagtatcgtgaggttgctgcttttgcccagttcggt

SEQ ID NO: 3372 - DNA, 310 bp, Homo sapiens
gcggtgctcgggaaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtacaggcgctgggcctgtccaactacaacagtcggcagattgatgaca

SEQ ID NO: 3373 - DNA, 335 bp, Homo sapiens
ccgggacgtcccagtccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagagctggaggaggagcagcaggccctccagaaggaggttgaggggacagaggatgaggtggaagttatttatccttgaggaggcccaggagaacttgagcaggcca

SEQ ID NO: 3374 - DNA, 300 bp, Homo sapiens
gacccgtgtgcctacgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacatgtccgccgtagctttaccattttagtgagggaagccagcccaggggttggagggggtgttttttggtgtcctattgagagcctgtaatggcgtttgggagctcgtgtgtttatgtgtccgtgtgtttatcc

SEQ ID NO: 3375 - DNA, 330 bp, Homo sapiens
ggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaggaggaaatggctcgtcaccttcgtgaataccaagactgctcaatgttaagatggccttgacaatta

SEQ ID NO: 3376 - DNA, 386 bp, Homo sapiens
gcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgcccgtattatggagatgaaccaatggatttcaaaatcaacaccgatgagattatgacttcactcaagtctgttaatggacaaatagaagcctcattggtcctgatggttctggt

SEQ ID NO: 3377 - DNA, 122 bp, Homo sapiens
gtaataagatgaggaatgaagatgaaatgcgatgatatgatggagatgattttggagtatcgacatgaatgaatattacataacgacgagacgcaatgttaaattagcgacaggattaacga

SEQ ID NO: 3378 - DNA, 400 bp, Homo sapiens
gtcatcagctgcggcatgaagctgaacctggactatctgctggagatgctttgggagtacttggccctgacctgcatctacaccaagaagagaggacctcttccctcgcgcagaatcacaagatggcagtgtgggccctgatgtgtggctgacgttctccccatcctgccctgcagagaggccagacttcacagacgccatcattctccggaaaggggcctcagtggagcacgtgtgccaccgcatccaccggtcactcgccaagccagttcaagtacgccctggtgtggggcaccaagcaccaagtacagtccgcagcgggtgggcctgacccacaccatggagcatgaggacgtcatccagatcgtgaagaaagtaacggcgcctgccgggcctcccg

SEQ ID NO: 3379 - DNA, 322 bp, Homo sapiens
  misc_feature 95, 96, 97: n = A,T,C or G
caaaggaggaagtgaggcgaattctggggctgctggatgcttacttgaagacgaggactttctgggtgggcgaacgagtgacattggctgacatnnnagttgtctgcaccctgttgtggctctataagcaggttctagagccttctttccgccaggcctttcccaataccacccgctggttcctcacctgcattacccagccccagttccgggctgtctgggcgagtgacactgtgtgagaggatggcccagtttgatgctaaagagttagcagagacccaccctaaagaggacacaccacgcagagagagggcttcacggg

SEQ ID NO: 3380 - DNA, 332 bp, Homo sapiens
ccttgccatctggcgctcccatggctcttgcaacatctccccttcgtttttgagggggtcatgccgggggagccaccagcccctcactggggttcggaggagagtcaggaagggccacgacaaagcagaaacatcggatttggggacgcgtgtcattccttgttgccgcaggctgggcgggagagactgttctgttcctcgtgtactgtgttgctgacagactacctcgctcttgtctagatgtgtcaccggggcatctctctggggccggatatggggacaggttggaagcggctccccattatataccagaggtgctacatctatgtaat

SEQ ID NO: 3381 - DNA, 316 bp, Homo sapiens
gaattcggtgtggacatagggccggtctgcttcttgtaaaacctgaacccagaacacacaatccgttgcaaaccccaagggccccaagtactttccaatctcagtcactctagggcctctgcaactgaatggctgaccttgacctgattggtccatcaatccaacctctaacagttcggacttttctcccctctctttctagagagccctgacctgggacagactgcaaaataaactctcggtgtgctatatatatatgtctccctgtaggacctgcgggtcaggacagaggcaggacacttactggtgtgagtca

SEQ ID NO: 3382 - DNA, 218 bp, Homo sapiens
gcaaggtatgctacatggagcctcagctgtctgctccctctcttctgtcagcacagctagcagtcagagacaaatgggctaacccttctcttgagtctctctggagtaaagcctggttgttgtcctccgtggattccatcctgttccagattggtggatagcaaggccttccttccaggcctcttgggagccattgattgagtatcatggttagagag

SEQ ID NO: 3383 - DNA, 270 bp, Homo sapiens
gaataaccacaggcaaacatcaaaacaatacgcataagttcgacaagattaactcttgtctgatatctgcacaaacagatatgcaccatgttggaaacatgtgtctccctagtcccatccaggcttcccacaggaaggccatgatgtgggtctaacccatatgttcggagtaacggagatatagagcagggggagtgtccccaaattggaagagagatgagagatgttccacggatatatgcttgagagcagacgcagtgtattgctgct

SEQ ID NO: 3384 - DNA, 135 bp, Homo sapiens
gaaacttaggtttttccacgcaatcgatggattgtgtcctaggaagactgttctcttcctctcggatctctcgtttcctcctgtacaagggagggtgtcttcagctttggtttgggtggggcctgccggccaact

SEQ ID NO: 3385 - DNA, 244 bp, Homo sapiens
ccaacatgccatccagacttaggaagacccggaaacttaggggccacgtgagccacggccacggccgcaataggcaaagcaccggaaagcaaccccggccggccgcgggtaattcttggttggtctcaataacaaccggacaaccttcggaccaaataccacccaaggcgcttcctttggggaaaggttggaattgaggcattacccacttaaaagagggacccaggacgctctctccccacac

SEQ ID NO: 3386 - DNA, 269 bp, Homo sapiens
ctcgtgccaattcggcagagtggacataggagggtccgagcaggaattcggtgtggacatagggccggtctgcttcttgtgagaacctgaacccagaaacaccacattccgttgcaaacccaaagggacccaggtgacttttccaatcttcagtcactctaggagctcttcacctaatgggctgaccttaccttatgtgccattattcccaccctcttataaggtgcggatcttttctcccctctctctctaggagccctgacttggga

SEQ ID NO: 3387 - DNA, 352 bp, Homo sapiens
aaattacaatactaattcccttaaaaatacaatagattaaacactcttagcaactttccctaattacagaagacagtcgtgtatttaacaattattatttctatgacttctgaaatctcttctcttgaaaactgcattaatctatatatataggctaatgtaataagtgtgattacacactctgttgtagggcgaaacctacatatatgtgtagggccctcccagctgagtgacctacagagtgagtggctacatgatatgtagcatgttctcgccatacatcaggtatgtgacttatagtgtctatcccacgtcataacacctacacgctaaaagcattgccatgtcaaga

SEQ ID NO: 3388 - DNA, 340 bp, Homo sapiens
gcacgagctggtcttgaactcctgaactcagtcattggccaggctggtcttgaactcctgagctcaggcgatccacccaccttgacctcccaaagtgctgggattacatgcatgagccactgtgcccagccaaagcagtcttaaaaagggacaacaaagttggtagtctaactctctcgtattcaatctctatttcacagctatagtgaatttaacacagtgaggctctatatatacacaccctatatagctcattggaccagattcacagtactccagatataatcctctcacatatatggtcatatgattttcaggacacgtgccagacaacatggaa

SEQ ID NO: 3389 - DNA, 300 bp, Homo sapiens
gaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaaggtcactacccgccctaaggtctctgtgtgtgtcctgggacacgacagcacattgtacgcgacttaaggccgtgatatatcccacacatggcacatcggcgcttgaaaactctcaacgagtataaaa

SEQ ID NO: 3390 - DNA, 350 bp, Homo sapiens
gaatgatccgggctttagaattggacccaaacttgtacagaattggacagagcaagatatttttcagagctggagttctggcacacttagaggaagaaagagatttaaaaatcaccgatatcattatcttcttcaggccgtttgcagaggttacctggccagaaaggcctttgccaaggaggcagcagcatctaggtgccttaaaggtcttgcagcggatctgtgccgcgtacctgaacttacggcactcgcagtggtggcgagtctacacagaggtgaggcgcttctacaagtgactcgccaggaggaggacctacaggccagagatgaagagctgttgagggtgagga

SEQ ID NO: 3391 - DNA, 343 bp, Homo sapiens
ggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgagacatctgacaagatgactcccaacagtccctctatcacatatgacatcagtcagttgtttgatttcatcgatgatctggcagacctcagctgcctggttaccgagctgatacccagacataccagccttataacagagactggattacagagaagatctacgtgctcctgcgtcggcaggcacaggct

SEQ ID NO: 3392 - DNA, 289 bp, Homo sapiens
agggacactttcacttgttttgacacagtgctgtaaaagaataaaggatactgttcaaaaattggcctccgaccacaaagacatccacagcagtgtttctcgggttggcaaagccattgataaggattcactttaagagatttggaaactcttcccttttggacttgctcttccatgcagaggtgcaatttatcactgtccgtaacaagcctgcctaagacttgccagaggctgtgtgcgctcttgatgagcggcagagccttccaagcagggccgtcaagggacactt

SEQ ID NO: 3393 - DNA, 149 bp, Homo sapiens
tttaactaatcctccgtcctctatttgtgttgtctcccattttttattattacaatattactgggtgaacatgcttaacaatacattccttggatatctgacaacgtgtttctgaaaaacagattttcataagtaataataaaaataat

SEQ ID NO: 3394 - DNA, 267 bp, Homo sapiens
caaacctgcacacgtaccgctgaagctaaataaaagttttttagaaaaacagcatgcccacttaaataaatctaccctagagacatacctgcacatttatgaaatagcataagcccattattctttgtacataatttatattaacaataatatccatcaagagactaggtgaacaaatacacaacggagcactttgctacctcttaaaaaagaccgagagaatctcacgtgtagagtagattgggattaatctcatacacccttttc

SEQ ID NO: 3395 - DNA, 357 bp, Homo sapiens
ccgcaggcgggagaggaacgcagcagccagccttgggaagccaaagaccgggcagccatggcggtggaaggaggaatgaaatgtgtgaagttcttgctctacgtcctcctgctggccttttgcgcctgtgcagtgggacttgattgccgtgggtgtcggggcacagcttgtcctgagtcagaccataatccagggggctacccctggctctctgttgccagtggtcatcatcgcagtggggtgtcttcctcttcctggtggcttttgtggggctgctgcggggcgtgcacggagaactattgtcttatgatcacgtttgccatctttctgtctcttactcactgttggtggaggttg

SEQ ID NO: 3396 - DNA, 347 bp, Homo sapiens
gggggagtgattgatttagaattgtgtgctcatgttggaagtgacaagtcatttttcctcctcagctctagattcttgatgtgtagcttagttggattagaacgctgaggtttataatgtatttcttattcgataggttgacacaggtgtgtgttaagactcattatactgttgtctacgatttctccctattctgagtgcctcagatttatgttcatcaatcaaatagtgtcacaataatgagatgtcttcatattaatcgatgattaactacacaagaggtggcaatacctcgctgcctctgtgttttctaagggtatgtctcccagggccgcctgcatggctat

SEQ ID NO: 3397 - DNA, 334 bp, Homo sapiens
atttacatgggaattgatcctgtgaccagaactgaaatattcagaagcggaaatggcactgatgaacattggaagtgcacgactttaaaacggatacactggcatctacttcgtgggtcttcaaaaatgttttatcaaaactcagattaaagtgattcctgaattttctgaaccagaagaggaaatagatgagatgagacattaccacactttctttgacagtcagtgatttgggtcccgcagaaagcctattgaaaccgagattttcttaaaagctccaaattctggagatttgtgatacgtgcctgtatggctcaatccactctatatcagt

SEQ ID NO: 3398 - DNA, 344 bp, Homo sapiens
cgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaggtcactgtgccagcccagaacactggtctcgggcccgagaggacctcctttttccaggctttaggtatcaccactaaattctcaggggcaccattgaaatcctgagtgatgtgcagctgatcaggactagagacacagtgggagccagcgagcacgcttgctgaacatgctcaacatct

SEQ ID NO: 3399 - DNA, 231 bp, Homo sapiens
gtcgcatttggccgcctccctaccctccaagcccagccctcagccattggcatgccccctggatcaggccattggctcctcgtggccatcttccacaagtactccggcagggaggggtgacaaggcacaccctgagcaagaaggagctgaaaggagctgatccagaaggagctcaccattggctcgtagctgcaggatgctgaaattgcaagctgatggaagacttggacc

SEQ ID NO: 3400 - DNA, 250 bp, Homo sapiens
gacaaaaattgcggtgcagtgtatactgctcaggggatgggtgctaccaaaatctcacaaatcaccactaaagaagttaaccaacaccacctgttccccagtaacctatggaaagaaagaaatgtctcatatgtttctgcctaaattgggctttaatactttagcgactctcttgagtttggactataaaataggtctggtcttagagcatatgctactgtaagcctactatgattatgtcatcgtgagg

SEQ ID NO: 3401 - DNA, 325 bp, Homo sapiens
aagattctggacaagtgtaatgaaattatcaactggcttgataagaatcagactgctgagaaggaagaatttgaacatcaacagaaagagcttgagaaagtttgcaaccccatcatcaccaagctgtaccagagtgcagggggcatgccaggaggaatgccttgggggatttcctggtggtgagctcctcctctgtggtgcttcctcaggcccacattgagaggttgattagccaccaagtgtagagtgcatgttcacacattaaacattgaggactaattgtgcaatcttgcagtttaaagtagctgcatagtagtactggcat

SEQ ID NO: 3402 - DNA, 280 bp, Homo sapiens
cgaggaaggcattgctgctggaggtgtaatggacgttaatactgctttacaagaggttctgaagactgccctcatccacgatggcctagcacggtggaattcgcgactgcccaaagccttagacaagcgccaagcccatctttgtggtcttgcatccaactttgatgagcctatttattcaagttggtggaggcccttgttctgacacaaatcaacctatttaggttaatacacagatctaggaatggtagccttttaaattacagagggaacccctaag

SEQ ID NO: 3403 - DNA, 195 bp, Homo sapiens
aaggacaagcgcttctcgggcaccgtcagcttaagtccactccccgccctaagttctctgtgtgtgtcctgggggaccagcaggcactgtgacggggctaagggccttgggtatccccaacattggccaccggggcgcttgaaaaacctcaccaaggattaaaaaccttgtcaagggcttgccaaggaggttatc

SEQ ID NO: 3404 - DNA, 226 bp, Homo sapiens
attgatgttcctttgggtctgtgaggttctgtaaactgtgctagtgctgacgatgttctgtacaacttaactcactggcgagaatacagcgtgggacccttcagccactacaacagaatcttttaaattgacagttgcagagttgtggagtgtttttacattgatctcttgctaatgcaattaggattatgttttgcatgtatgactcaataaatcctcgaatcat

SEQ ID NO: 3405 - DNA, 240 bp, Homo sapiens
gttgacattctgaatgcttctaagtaaatacaattttttttattagtattgttgtccttttcataggtctgacatttttcttcttgaggggaagctagtcttttgcttttgcccattttgaatcacatgacttattacagtgtttatccttcatatagttagctaataaaagcttttgtctacacaccctgcatatcattattggggttaaggtaagttgagatagttttcatccattac

SEQ ID NO: 3406 - DNA, 203 bp, Homo sapiens
gtacggggtgtggcatgaatctgtggagcatcttttgaggtcgcaccacagcacatcggcaagcctcaccatccgcagagatgccctgctggccgcaaagtaggtctcattgctgcccgccggactagacgtcttcggggaacaagactgtacaggagaaagagaactagtgctgaggggctcaataaagttgttgttaatgc

SEQ ID NO: 3407 - DNA, 210 bp, Homo sapiens
aagaaactgccgaggatggagaggaggaagatgaaggggaagaagaagatgaggaagaagaagaagaggatgatgaagggcccgcgctgaagagagctgccgaagaggaggatgaagcggatccaaacggcagaagacagaaattggggcatcggcgtgaccctgcccaacaggcttgggtttgggaggcctctcttggccttgaggttg

SEQ ID NO: 3408 - DNA, 220 bp, Homo sapiens
gaaagatttacacacggtgacctgtcataggccaagcgatgagaagagggcgccaggagcctggggtcccgaggtggctcagatggaagccatgggacggccgtcccaggcccgcgcacccacacctcagtttcccctctgtgaaatgggagcttatgcttcttccaagtctgctcgtgccgaattcgcacggggccacggaggaaagaggaaagaagac

SEQ ID NO: 3409 - DNA, 240 bp, Homo sapiens
gtggagaggatctcagcatatttctggaagatagaaagtggatgaagcatgataatgacagagtgaagaacctttcagataaaatgtaagctgatctgaacaacataaccccaaagagacttgcgcacctcacaagcttgtctactgaggagttactccagttgtaagattgagccctctcctactctccccaaactcttatgcacaagacacaggcagtctccactattgataccagtt

SEQ ID NO: 3410 - DNA, 279 bp, Homo sapiens
agaccctcaccttccttctgcccatcttccatgttgtaaaggaacagccccagtgcactggggggaggggagggagtgaggggcagtggtgcctttcctgcagaagagacatgcagcagtagcgctggcgccatctgcaggagctggcgggctggccttctggaccctggcttctccccactgtaacgcctgttacacacaaactgttgttggttcctgccaggcttgagaaaatgatctgaattttttcctcctcttggtttattttgttggttattt

SEQ ID NO: 3411 - DNA, 360 bp, Homo sapiens
gagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatggaagtcctggcacagtttttggtaagcccttgcacagctggaggaatggcatcattataagctatgagttgaaatgttctgtcaaatgtatctcacatctacacgtggcttggaggcttttatggggcctgtcaggtagaaagaattggtatttag

SEQ ID NO: 3412 - DNA, 331 bp, Homo sapiens
ccggcctgggttggagggagcggatgggtgtagggcgaggcgcctcccgccctcggctggagacgaggccgcagaccccttctcacctcttgagggggtcctcccctcctggtgctccctctggtccccctcgttgttgtagcagcttaactgtatctggagccaggacctgaactcgcacctcctacctcttcatgtttacatatacccagtatctttgcacaaaccaggggttgggggagggtctctggctttatttttctgctgtcagaatcctattttatatttttaaagtcaggttaggtataaccttattatgaaggtttttttt

SEQ ID NO: 3413 - DNA, 335 bp, Homo sapiens
cacctgccccagagcccgtttgtggctgagtgacaacttgttccccgcagtgcacacctagaatgctgtgttcccacgcggcacgtgagatgcattgccgcttctgtctgtgtgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaggtgaagtttgtatgtttacctaatattacctgttttgtatacctgagagcctgctatgttcttttttggtgatcaaatt

SEQ ID NO: 3414 - DNA, 245 bp, Homo sapiens
  misc_feature 40: n = A,T,C or G
ctcgtccattttcggccagggaaaaaaaacagaaaaacanaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaatataattaatttgtaagtctgaaaaaaaatatttaat

SEQ ID NO: 3415 - DNA, 102 bp, Homo sapiens
gcctggctggctttaagatttatgcatcctaacatttcttcacctactaacatgagttgtcaagtatgatatctgatctaatcctacatgattttctatttt

SEQ ID NO: 3416 - DNA, 191 bp, Homo sapiens
ccacctctctcctcttaacccctcctccacagctgcagcccatcctcccggctccctcctagtctgtcctgcgtcctctgtccccggggtttcagagacaacttccaaagcacaaagcagtttttccccctaggggtgggaggaagcaaaatgctctgtacctattttgtatgtgtataataatttgagat

SEQ ID NO: 3417 - DNA, 260 bp, Homo sapiens
aagggtgtgggcaccagatactgctacaccatctcatcggcatggacctatatgtggcagcaagtccatctcatcgcttttgggtgaaagtcagtccagtttgtaaagattctcattgtcactgtagacgaggactgggacaccaaaaggagaacctctggccacacttgcaccctgttccaaatcctggtccagtgtcaccacagatggtaaggagctctagagacctcaccagccctgggattggtcacctcactctc

SEQ ID NO: 3418 - DNA, 202 bp, Homo sapiens
gttcgtcagggatgctctgacaaccaggtgtcgtccacgggcgggggcatgggcatggtgacagtggtcctgttgatgtaaccgatgatgctgagcgcctccttcaagcgcgtggtgcatgtgcagcatctcgtcgtgctgctgtgcctgcttgcaactcctccatcagtgtgtctggtcccacataggtacatattggcaa

SEQ ID NO: 3419 - DNA, 253 bp, Homo sapiens
ttgagagcttctcagactatccacctttggctcgctttgctgttcgtgcatatgagacagacagtttgcgggtggggtgttcattcaaaggcaggttggacaaggacggcttgcttgggagcttgggcaaggttcacccaaggtcttgccccaggaaaggttcaggaggggttaaattggaattattcattccctaattaccctggccaaccccacttcttaaattcagttggtggaaggaaccggttttcag

SEQ ID NO: 3420 - DNA, 340 bp, Homo sapiens
cgccatcttccagtaattcgccacaatgacgaacacacagggaaagaggagaggcacccgatatatgtttctctagggccttttaggacaaccatggagttgttccttttggccacatatatccgaatctataagaaaaggtgatattgtagacatccaagggaattgggtcctgtccacaagggaattgccccacaagtgttacccatggccaaaccttggaggagtctccattgttcacccagcatgctgatgggcattgttgtacaccaaccaggttaagggccaagtatctcgccaagagatttaatgtccgtattgagccaattaggcactttag

SEQ ID NO: 3421 - DNA, 372 bp, Homo sapiens
cgctcctgatgatcacgtataaaagtcaggtgttcagctatcctcaccgctacctggtcctcgatcttgctctgctgtttctgatggggattctagaggcagttcggttatacctgggcaccaggggcaacctgacagaggctgagaggccgctggcgccagcctggccctaacggcttggcaccgcccttctctctcccacttcctgctttggcaggccctagtgttgtaggcggacttgggccctaagcgcaacgttcctggcccttaacggccttgaagcctcctacaggtggttgccatcgcggccttcacaggtagctacggacaccgggatacccacaatggggccctcctcctgggctaacagtc

SEQ ID NO: 3422 - DNA, 240 bp, Homo sapiens
ttagtaggggagagaagagttaaatctcccttatagaggagtctaaatcattatgtagatactcccccaacagacatggaccattactccccacctgctaagtgttgggctctgcttagtggctgcttccaaagagtgcaatatggggccgggcgctgtggctcatgtctgagctctagacctttgggacgccaaggacggtggatactttacggttaggagttggagaccagccttggc

SEQ ID NO: 3423 - DNA, 197 bp, Homo sapiens
acttgaatacaccatgggactcacggagtacactagtgatactggagtgctccaggaggagagatatgtcatgatgttacaaggaaaagtcaaattgcttgatatgcatctgagagtgagtgcattctatgtttgcctgccatttaaggtaaatgagttcagcatacatgactatagtgaaaaaaaaaaaaaaaaac

SEQ ID NO: 3424 - DNA, 162 bp, Homo sapiens
actattataagttataagcctatcttctgccttatatactacattttcttggtttaagattcttccctcaaaaccacatttaaatcttttctgaatttagggatggcttctgaaattgggcatttttttttaactcgaaggttaaaaaaaaaaaaaaaaaac

SEQ ID NO: 3425 - DNA, 300 bp, Homo sapiens
gctgtgtgcggaccaggagtgcagccaccctatctccatggctgtggccttcaggactacatggcccccgacttgccgattcctgaccattcaccgggggccaagtgggtgtatgtcttctccaagctgaagggcccgttggcggctcttctctgggaggcagcgttcagggagagtactatagagatctcgctgctcgcctcgggctatattcccagtagcagatgtctcgacgagagcacgacactcatacatctgcagagtcgatgtgagacagacacatagtagtatctactacta

SEQ ID NO: 3426 - DNA, 325 bp, Homo sapiens
agagaacaacattcctctctgtcaacatcgagaggctttaaaacaactgtttagtggaaactttctgagagatgggaaacaagcttctggtgggtgcattttcttggcccggagttgccttcatccacgctacttgccccctgtcccccggcccccccagatttgtacggttgcaacagatgattcctctttctctgggtttaaatttctcagcagcatgatagtgctctggggacagcacacagtagaggagtgtctcgtcacactgtctcgcacacagtaggggctcatatatatgtgttcacttataaaaaaaaaaaaaaac

SEQ ID NO: 3427 - DNA, 305 bp, Homo sapiens
tttgcatccttcaatgacacttttgtccatgtcactgatctttctggcaaggaaaccatctgccgtgtgacttgttggatgaaggtaaaggcagacccgagatgaatcctcaccatatgctgctatgttgggctgccccaggatgtggcccagaggtgcaaggagctcggtatcaccgccctacacatcacactccgcggacacacgaggagataggggcacgagccctcgagctcggggccagtcggccctctagagagcctttccgctctcggtatatgatcgcgcgcagtgaggatgatcac

SEQ ID NO: 3428 - DNA, 190 bp, Homo sapiens
attttgtcaaatgcttattttctgcatctattgagatgatcatgtggcccgtgtccttattaatataggtgtgggtacacttgatcttcagatgttaaaacaaccttgcacttcttggagagcatcctctgctttgttatatgcgtatagattcccgtctatatagttgctcgagtctgtgcttctgata

SEQ ID NO: 3429 - DNA, 169 bp, Homo sapiens
  misc_feature 25, 26, 27: n = A,T,C or G
gacagatccacatcatggaggttgnnngggtgctgcacatggttcgttatggctatagcgactatcaaggtcaagcaggttgaagcagcagcttaagacaaggagctctctctgaagggtctgtatttttccaaggacctctatatacctagggggttaagatattttt

SEQ ID NO: 3430 - DNA, 232 bp, Homo sapiens
aggaaactaactggtgtgagtcaaatgccccctgagtgacttcccccagcccaggccagaagacctcccttcaggtgcccgggcgcaggaactgtgtgtgtctctacacaatgtgtgtctattctcgttgttcaaacacactctcgtattttttttaaaccatacacattgatatataaaaatgtagaaagagttatattgagaagtgaaaaaaaaaaaaaaaaaaaaaaac

SEQ ID NO: 3431 - DNA, 330 bp, Homo sapiens
agaaaattcacacatattcccaacacccaacaacaattaactgttaacatcttgatctgtgcactagtctgtgattattagggtgttagtgataagtatgcataaatgtcaaagatgggaagacagatgaaaaacaagacatagttgtgtggttgttgtgtggattatggttattttgtttcgggtttccttgacaggtcatcatactagtgtttttggtagtgcacctctactacatatatctccactatatatgacgcgtgttcactatagagactctgaagtgacagcagatgttgagagagactcaccactgttttcaccatccac

SEQ ID NO: 3432 - DNA, 545 bp, Homo sapiens
ctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgccctccggagccctcgggtgagccgccggggcccccttctgccagcctcccgtccccaacatgcagtctactctgggtgtcttgtctttatttttgtaagtgtcattgtataactctaaacgcccatatagtagcttcaaactgggaatagcgctataaataactcagttctgcagcccccaaaaaaaaaaaaaaaaaac

SEQ ID NO: 3433 - DNA, 346 bp, Homo sapiens
cagcaggcgcaccaagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgacaacctaaaaaaaaaaaaaaaaaa

SEQ ID NO: 3434 - DNA, 460 bp, Homo sapiens
agagaggggctacaaaaagaccaggatgcctgtgtcgccatgagatgaaggctacaactcaagacaagtttagagaatagccatggccttcaacctacgtaggagaggtctcaaacacacactggctttcaaccggccgcatttctctccctgtggcaagccacttctggagctaaagagatgatgccttctcatgcttccctctttctagagtccatgcttccctctttctagaacattctccaggtacaagatacacagcattccttcttcacagtatccctaccctgcttccaaagcctgagtgacccctttctcagctcaatcctcctcaacattgaccatcctacttggtaggtacccttgggccttagaagtgatgagctgttggcaaatgttgaatgggtaagtaggaatgtctattcaatgattagggcttctttggtaagttgtggtgttc

SEQ ID NO: 3435 - DNA, 210 bp, Homo sapiens
cccaattggaccaatctatcaccctatagaagaactaatgttagtataagtaacatgaaaacattctcctccgtcataagcctccgtcagattaaaacactgaactgacaattaacagcccaatatctacaatcaaccaacaagtcattattaccctcactgtcaacccaacacaggcatgctcataaggtaaggttaaaaaaaaaaaaa

SEQ ID NO: 3436 - DNA, 261 bp, Homo sapiens
ctgcgtctgcctctgtcgtgtgtgctgatttgagtggcttagcttgccacagcgcaacctcttctgtccctttcagtcaatttgctgtatttccctgtggcacgttaccatggaagccgctccagggtgggtccagggtgcaagctgctggtgaggtttgggaggcatcagggctcacgggtgttcatgtgtgttcgtgcgtgtgtgtgcgtacgtgtatataactgaaagtgtctgtacggagtgccctttgctagccat

SEQ ID NO: 3437 - DNA, 372 bp, Homo sapiens
agaatcttcagtactacgacatttctgccaaaagtaactacaactttgaaaagcccttcctctggcttgctaggaagctcatttggagaccctaacttggaatttgttgccatgcctgctctcgccccaccagaagttgtcatggacccagctttggcagcacagtatgagcacgacttagaggttgctcagacacctgctctcccggatgaggatgatgacctgtgagaatgaagctggagcccagcgtcagaagtctagttttataggcagctgtcctgtgatgtcagcggtgcagcgtgtgtcccacctcattattatctagctaagcggaacatgtgcttcatctgtgggatgctgaaggagatgagt

SEQ ID NO: 3438 - DNA, 126 bp, Homo sapiens
cctcaacaagggccacaaatgtgatccaagtgcgtgatcaagcccaggcatctatcgactgctgtctgtgtggccttgatcctaatcataacccatgggccggtctgggacaatgattctgggatg

SEQ ID NO: 3439 - DNA, 220 bp, Homo sapiens
aaatattcaactctttcaacaattgctctgaaatatgtaaagagagaaagaaatctaaattacctagactttattattggtcctagatggttgtcactcccctcaaatttatacagaaaagttttatgaggttcaaataatgctcatgttgcaaactatgtgggatcccctagaaacagaattttttatttggcaagggccctttgaggcatttatatct

SEQ ID NO: 3440 - DNA, 223 bp, Homo sapiens
gtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatgggcaaaatttcaccacttaaaccctgcacttaggtaggaccccatttttaaagagttaac

SEQ ID NO: 3441 - DNA, 195 bp, Homo sapiens
tcgggaagttctgcgcatgcgtggcaccatttcccgtgaacacccatgggaggtcatgcctgatctttacttctacagagattcctgaagaggatttaaaaagaagagcaggcttgcttgcttgagaaggcagttaccaaggagggatttcaaggtgaatttgactttcttccgctctctctagttcactttctc

SEQ ID NO: 3442 - DNA, 110 bp, Homo sapiens
actgccatcagggttgcattggctgtcgctgtgctcaaaactgtcattttgggacttctgtgcttcttcttcctttggtgaggaggagggaaggtagcgaggcgcgccag

SEQ ID NO: 3443 - DNA, 157 bp, Homo sapiens
ggactggcgcgttgctatcgccgaggggtacagagacgccctaggccgtgttctctggaagatcccgaggggggagacaacaagcaacagcggggggcagagaacccaagacaaacataggcccttttggggagggggagcacacgaagataggttc

SEQ ID NO: 3444 - DNA, 167 bp, Homo sapiens
gtagagcagaagaagaagcggaccttccgcaagttcacctaccgcggcgtggacctcgaccagctgctggacatgtcctacgagcagctgatgcagctgtacagtgcgcgccacgcggcgggctgaaccggggcctgcggcggagagcactccctgctgtagcgcct

SEQ ID NO: 3445 - DNA, 187 bp, Homo sapiens
gccagctataaggggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgycctttttttttttttt

SEQ ID NO: 3446 - DNA, 205 bp, Homo sapiens
agatcttcgtgaaaacccttaccggcaagaccatcaccctttgaggtggagccagtgacaccatcgaaaatgttaagggccaaggattccagggataagggagggcatttccccccggacccaggcagagggcttcatcttttgccagggcaagcaggcttgggaggatggccgctactcttttcttgtcctaccaacaatccca

SEQ ID NO: 3447 - DNA, 194 bp, Homo sapiens
cgcggactgttctagtgagggcatccgggtgaccgcaatgaggagaagcgcatcactgaggcagagaagaaccgagcgttttccagcggccactcttgaacgctgtagccagcgagcttttcccagggcccgagatgaggattaagagggacccacaattgacatcattcaccaacgaggaacatgaggcaagg

SEQ ID NO: 3448 - DNA, 214 bp, Homo sapiens
gggaagatggcggacattcagactgagcgtgcctaccaaaagcagccgaccatctttcaaaacaagaagagggtcctgcttgggagaaacttggcaaggagaagctcccgcggtactacaagaacatcggtcttgggtttcaagacatccaaggaggctattgagggcacctacattgaccaagaaatgccccttcatggtaatgtgtccatcg

SEQ ID NO: 3449 - DNA, 315 bp, Homo sapiens
ggcgacatggccaaacgtaccaagaaagtcgggatcgtcggtaaatacgggaccgctatggggcctccctccaggaaaattggtgaagaaaatttgaaatcagccagcacgccaagtacactttctctttctgtggcaaaaccaagatgaagagacgagctgtggggatctggcactctggttcctgcatgaagacagtggctggcggtgctcgaacgtacaataccacttccgctgtcacgctaaagtccgccatcagagactgagggagttgaaagacagtagacgctctctactctctgagacatcactggc

SEQ ID NO: 3450 - DNA, 198 bp, Homo sapiens
gccgagcgatgggcatctctcgggacaactggcacaagcaccgcaaaaccgggggcaagagaaagccctaccacaagaagcggaagtatgagttggggcgcccagctgccaacaccaagattggccccgccgcatccacacagtccgtgtgcggggaggtaacaggaaataccgtgccctgagggtggacggtgggga

SEQ ID NO: 3451 - DNA, 207 bp, Homo sapiens
gacgactcccggaggctggggaagttctgcggcgacgagtcccgggctccatctcctccgaaggaattgaactcctcggtccagttcgtctcagatctcagtgtcaccgctgatggcttctcagcctcctacaagaccctgccgcgggggcacttccaaagtagggcaagggcccgccccaaacgggggactgaggctcaagtgaag

SEQ ID NO: 3452 - DNA, 187 bp, Homo sapiens
ctaggagactgaggcaggaggatcacttgagctcgggagtttgaggctgcagtgattcatgattgcaccactgccttccagcagcctgatgacagagtggggatccctcgtgccgaattcggcacgaggctgagatccccaaggcctttcctacaaagccccctcccttcacaagggggacagagaa

SEQ ID NO: 3453 - DNA, 164 bp, Homo sapiens
gggaaactaagaaatggttgacagcgttcccacccatctacaatgttattttaggtgctttgtggtaagtcttttttcttagattgcgctaaaatttcttagattgttcagcgctcagaacaaaagtttgaaaaatgcatttgttcatatatgaatgtcatctc

SEQ ID NO: 3454 - DNA, 366 bp, Homo sapiens
gaagcacctcagacctcttctccctgcccatctgctgacattgacatgaagacaatggagactgcagagaaactggctagatttgttgctcaggtggggaccagagatcgaacaattcagcatagaaaacagcaccgataaccctgacctgtgggttttacagaaccaaaatagtttttctttcaaattctatcgaagaagtgttttactatgtccaccaatttgtttcacgggatcttcgcacaacctccacactgtggtggtgacacacgggggtgtcatgagagcccctcgacctctatgatgggggaggcagaggtttttagacgggcccctccctcggagggtatcttgtgagccacacgt

SEQ ID NO: 3455 - DNA, 259 bp, Homo sapiens
cagggcactcctaatctctggttgttctttcctcagccttgagtagttcctcatgtgcatgtgctgatcttactccatggaatactcaaaggggggacctcttaagatcttgagttttttctgttgcagctctcacctgtctagtactttgtcctgtgaactgtagctactttgggctccctcgatgttttgcactatcctcctcagctcagtctgctaagctctgtctcggggttcccttccttgccctatggcgcga

SEQ ID NO: 3456 - DNA, 275 bp, Homo sapiens
tcgtgccgaaattcggcacgagggcggcgcgcccctcgacaaggtggtcttcgggatccgtatcggtttaaagaagcggacggagtttctcattggccgccgaggcatgcacacgggccagtttgtgtattgcggcaggaggcccagctcaacattggcaatgtgctccctgtgggcacatgcctgaggatacaatcgtcgtgctgcctggaggagaagcctcgagcccgtcgcaagctggcccgggactcaggcactgtgcccaggttctctcc

SEQ ID NO: 3457 - DNA, 321 bp, Homo sapiens
gcggtcgtaagggctgaggatttttaggtccgcacgctcctgctcctgactcaccgctgttcggctctcgccggaggaaccaagtcgggtcagggaagccccgcgcgcaccacccattggctttttaagggatacccggaaaacccaccccgtgggatccgggagttggcaattaacggaattcggattcacccttaacaggccgcaccgtaaattccttggataaggtgtgtcctgactcgataggaggcgcaaagaaagactctcaaagtgaaaggcccagctcgtatccctaccaagactttgagaatcactacaaga

SEQ ID NO: 3458 - DNA, 223 bp, Homo sapiens
agatggcggaggtgcaggtcctggtgcttgatggtcgaggccatctcctgggccgcctggcgccaatccggtggcttaaacagggtaccttcttgggcccgaagggtgggtgggtccgtaccgttttaagggcaataaccaatttcttggcaattttctaccagaaaacaaaggttgaagtacccctgcttttcctccccaagcgggatgaacacacaacccy

SEQ ID NO: 3459 - DNA, 245 bp, Homo sapiens
cttgctcctaagcctgcagatggcctattgtgggaccttgtgattgtgagaattaatacttaataaactccccattacatacatatatctgttctttagttctgtccccttagagaaccctgactaatacacctctttttctcgtggaacaataaaaaaataactttaggggcccccatatttttagacagattcagcttagcccatatttttgagggtccccctgtgtactcgacacttgaaca

SEQ ID NO: 3460 - DNA, 226 bp, Homo sapiens
agtcccccgttgcctcttcaaacctacagcttctctttgccatttgtggatttcacatcactccacacagaaacattacagcctggcatccccagtctttgcctttttccagctgcctcgacacaagactgtggcctgtccctatttgccaggcacgccatttcaagggcaggaaggggcagtgtcctccaagcccacctttctgtgcacgctcttaggggaggtg

SEQ ID NO: 3461 - DNA, 235 bp, Homo sapiens
gcggcccttcctgcagcgcctgccgccccggggactcgcagcacccacagcaccacgtcctcgaattctcagacgacacctggagactgtcccgacacagcgacgctcccctgagaggtttctggggccccctgcgtgccatcactcaaccataacacttggatgccggttctttcaatatttatttccagagtgccgaggcagcagacacgccctcttagtgtggggcttattd

SEQ ID NO: 3462 - DNA, 247 bp, Homo sapiens
gcactgccaagactgagtggttggatggcaagcatgtggtgtttcgcaaagtgaaagaaggcatgaatatttgtgggaggccatgggagcgcttttgggtccaaggaatggcaagaccaacaagaaggtcaccattgcctgactgtgggcaactcacgataaagtttgacttgtgttttatcttaaccaccagatcacttccttctctaggtcaggggagcacccctcccccccatttgctcgcagg

SEQ ID NO: 3463 - DNA, 364 bp, Homo sapiens
cttcaggtacaggtctacttgacactaaagttcaagaactgcaattccaaattcctgagcccatgaactttttccccctagttttgtctcagccaacagaaccagccatggagctcgctggggtaacatttgctctctggctcactgactttctagacttcagggcatattcacttcgatacattgtacaaattaattttgtttctaaaataggagtggtaaataaggatgactaggggcaagtccctgatttttatgtgctaaacatttatggaaatatttacagttttaagtcaagggtggcagggccttgggaaggcgttattagggaaggggagaattgggatttgcccatagcaacaaa

SEQ ID NO: 3464 - DNA, 284 bp, Homo sapiens
ctgttgtggtgcatggccccgagcccttctaatggggctgaactgctctacaagcgcatcatcgtctttcttcctgagcacgagttccagatggacagtgtaggtcaaggaccttaaagacaaggccaaagagacttcagatgccatcacttaaagagcgaaggaagctaccgtgaatttacttggtgaagaacgaagagcacctaaaccagacttgatggaactttctgacctctctgtaccttctactgagcttgatgttatattagggactctggtaatat

SEQ ID NO: 3465 - DNA, 230 bp, Homo sapiens
gcggcctgtgcaggtgattggggctctgattggcaagcaggagggccgaaatatcgaggtatgaactcttgaggctgctgttcccacaaccttggaaggagaaggttattcttgacaagggattattgaatacaaccaagaggagcagttttaaacagggtttcaaggagcttgagtgactcgggttggttaccacaagggggcactctagaccttcggacatctacacg

SEQ ID NO: 3466 - DNA, 275 bp, Homo sapiens
gttccacctaagttacgaaggataatctgccttactaaaaattacacagtctctgtatgactctcctagattcatcctcaatcttccttgaggtgctgtagggtgggcaacagtgtttgtattggtgaaggtgttgaaagttggtagcatgggacttgaaaattaatttagagtttgagagttagagatcttctggattaaggccttcacatctagaaaagggcttagcccagggtgttataagatcccatgtgggggtgctatatgctatttct

SEQ ID NO: 3467 - DNA, 313 bp, Homo sapiens
gcagttcgaaaaggaaaacaaaaagatggttaagagtccaaacctgaaagacaagaaagaaatgcccaacccagactaaggcttacagttacgccaagtccagtgaaaggcaaagggaaagtgggtcgccccacagctttcaaaggcattcaaagggaaaggactccttctcccaaagaggaggattgaggacccggaaagccgcccagaaaagaaaacatctcaagcccccaacccgagaatcctgggctatgagggtcttagatgaagccccttctggggaggtattaaaaggtatgatggtctggggaga

SEQ ID NO: 3468 - DNA, 314 bp, Homo sapiens
tagatcgccatcatgaacgacaccgtaactatccgcactagaaagttcatgaccaaccgtctacttcagaggaacaaatgtcaattgatgtccttcaaccccggggaagggcgacaagtgcccttaaggcaaggaatttcggggaaaaaacttagccaaaaatgtacaaggacccaaaccggatgttcatctttgtaatttgggattcagactcattttggtgggttgccaaggacacctggctcttgggcatgattaatggattcccggggtatagcacaaggaaatgtacccccacatcagtgctctcacac

SEQ ID NO: 3469 - DNA, 264 bp, Homo sapiens
ctcgtgccgccctgagttggttgcctctcccctgctcactccagtcacatagagaattggtgttccgcagttgggatgcagctgttggacaaggtatttcggggggcaaaggttggtaggggaaggacaagctgttcacttgctgtttacaaggcacaaaggtgtatttaaaaatgtcttaatatttgcaaattttaaggctctggtccaatatatagggaaaagttgaagggggaaaatactctggatgcttctccaaagggt

SEQ ID NO: 3470 - DNA, 142 bp, Homo sapiens
ctcgtgccgaattcggcacgagaagaacctggaggaggagggtctgcccaagaaccccgacttgcgtatcgcgcagtgcgttccaacttcaggcctggcccgagcaaccgaggagacgcttccccgttcgcgcacgagcgct

SEQ ID NO: 3471 - DNA, 243 bp, Homo sapiens
aacaaatcaagcacatccttgctaatttcaaaaactaccagttctttattgggtgaaaacatgaatcagatggcatggttgctcaattggacttccctgagggttggtgttgaccccatatatataattttcctttaaggattggtgttagagatatgagaaaatagttaacacatgtgtgcacttatattttgatactatcacatcgtcatcatatatctgctctgctttgtcatacacaca

SEQ ID NO: 3472 - DNA, 247 bp, Homo sapiens
tttagaatttgtctagtaggctttctggctttttaccgaaagccctcttatgatgtttgtgcatgatagatgttcactgtgcaaaaattatgggtaggttttggttgtcttgatgcagttgtaagctttgggtattgaaggattggccacgcctctggcgcttacggctgcgcgagtgctgtttcccttccgctcccagagggcgttgggacggtgttaggacgctgcgctttatacgtcgagtatt

SEQ ID NO: 3473 - DNA, 343 bp, Homo sapiens
ccggccgcaggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctgtgacaagctgggccttggagccgacgttgcccaggtgaccgggccctccggagttgcaaggggaagatgctgctgttcagcgggcggcgctcttgaggttcgacgtgaaggcgcagatagtggatccccggagcgccacacgtgtggaccgatgttcccaaggtgcctttgacacgcacgacgt

SEQ ID NO: 3474 - DNA, 348 bp, Homo sapiens
aagaacaaaggcaagcatccattcctcactccaccacttttctatttcagtgggtgtcgttgctacgatgaagacttttgaaatttccttttctcttttaggacagggtcaggatttaggactcatagccttaaagctcattacatacttcctgtaaccatcagtccaaggttcagttcactataagtgcatgttctataaccaagagctatacctcatttcacattttaaaatatgtactctcgcccgttgcagtgctcacgctctaataccagcactcttgcagcagcgcgatatgcgcaagctcttgaggtcacgagtgttagacaccctcgccaccactgtgad

SEQ ID NO: 3475 - DNA, 299 bp, Homo sapiens
ccggtggggacagagggccaattcgggcaccatcccccaattcccaatactcgagaagtaaatggatggtactttgttgtcagagccagagtaggggacaaatggattgttggattcttaggtttgaggcttcgcttttgaggctttgacacacactattcggattgcttttgtagcactctcaattcagagagccacagcttttggggtagagagaggggtgctcttgtccccccacatatgacacagatatatatggggtcatcatgttgtgtgtgctgcagagtctcacagcagag

SEQ ID NO: 3476 - DNA, 340 bp, Homo sapiens
tgaaggtgctccttgccgccgccctcatcgcggggtccgtcttcttcctgctgctgccgggaccttctgcggccgatgagaagaagaaggggcccaaagtcaccgtcaaggtgtattttgacctacgaatttgagatgaagatgtaggccgggtgatctttgtgtctcttcggaaagactgttccaaaaacagttgataattttgtgtgccttagctacaggagagaaaggatttagctacaaaacagcaaattccatcgtgtaatcaaggactccatgatccagggcggagactttaccaggggagatggcacagaggaagagcatctactgtgagcgt

SEQ ID NO: 3477 - DNA, 301 bp, Homo sapiens
gcctgaactgcggcttgggctttgggacttggcagagagaggtcgggagcaaggggacgaacggccagaacacagttagatctcaaaggtaataagagtgccttcacacagtaggcattttatgatggctgactaagtgaaaagagcttggcttggtcagagcattgttgcccacccctgtaatctcagcacttttggaggccaggtgagtagatcactctgaggtggggagtttgagagcagacccgccacacatatgcaaaaccccatctctactataaatacacaaattatgccgctr

SEQ ID NO: 3478 - DNA, 327 bp, Homo sapiens
ccgccttagtgctgaaatatgtagtacatgaatatgccttgtttaattacagaaaattccaaaacttgtactatttttttttccatgtagaaaggcaggaatttcttctaagctttcctggacagcagatgaatgagcgcgtagctttagtttgtacgtaggtacagttgtgagcactatatgtactctctgtgactacttttgacacaagtaggtttttgaatgtaacacgataagtcaacttgagttgtaatatatatttgggggtcagctcactacacattgtgactctatacactgtactctatatgtgttgtagagttcccc

SEQ ID NO: 3479 - DNA, 241 bp, Homo sapiens
gttgctgagggcaacagcaggttcacttacactgttcttgtagatggctgctctaaaaagacaaatgaatggggaaagacaatcattgaatacaaaacaaataagccatcacggctgcccttccttgatattgcacctttgacatcggttgtgctgaccaggattctttgttgacaattggcccagtctgtttcaaataaatgtaactcaatctataattaaaaagagagagaatttgaga

SEQ ID NO: 3480 - DNA, 338 bp, Homo sapiens
gtttttaacctaaaatggtttataaaggttgaaaaaaattaaacaattgcaataaagcttagagaatatgaatataaaaagaaatagttttgtacagcagtatgatgtgtttgtgttctaagctaaggattattacaagagtcaaaaagtttaaaaatgaaaatgtttgtaaagtgaaatgttacattaggctatggttaaattattattgagagaataaatttttaaaataaatttagtgtagcccaatgtacacggtttatatagagccttggtgtgcacagtgatgtctcgagctcacattactcactgtctcaccccgggccgtcgtagtctct

SEQ ID NO: 3481 - DNA, 310 bp, Homo sapiens
ctcgtgccaattcggcagaggccatggcatcgggccatgtcctcaagcgtgtgccagcatggcccaagggcccattctctgatcgtctcaatctgttcagcaggacttttccccatgccaactttgtctaaggccacagtttgttttgcaatcatggggtagtaggatgttcagcaaaggatcagtcctttattgggaatttggaggtggtgtttgtagggctttccatttcaggcaatttcttttgtccatttggagttgtattgaccaggatggttaggtctaggcagaccatcttccgataggattt

SEQ ID NO: 3482 - DNA, 414 bp, Homo sapiens
atcatgggccagtaacaagcaaggtgggcaaggagatggaatccaagtgaatagtcagtttcagcaaggattttcccagccttgcaggcagcttggggatcaaggaaaaaaaaggaaaagggaaacaaatgatggacaacttattgggaccctggacccagttttacgtccaaccaaattgttgcttgttggagaaaaggtggtaaggctgctggctcaacttcgtcaactgatcaagatgaaaagctccctggccaggatgaaagcacaagctggaacatcagcagcaaaatgatatcctcaaagtggtggaaaagaggatagctggtggtctcacaggctaactgaatgacagcaggctgctctcgctcccagtatagagcatgatgctcctatatgctccacagtatccta

SEQ ID NO: 3483 - DNA, 397 bp, Homo sapiens
gcctaccccttccttgtactatccctatgaggcataattataacagctccatctgcctacgacaaacagacctaaaatcgctcattgcatactcttcaatcagccacatagccctcgtagtaacagccattctcatccaaaccccttgaggcttcaccggcgcagtcattctcatattcgcccacggacttacatcctcattactattctgcctagcacactcaaactacgacgcactcacagtcgtcatcatatctctctcgaggtacttcaatacttctactcctactaatagctttgttgatgacttctgagcagcctcggtaacctcgctacccccaactattaacctactgggagactctctgtctagttaaccagcgtctctgatcaaata

SEQ ID NO: 3484 - DNA, 317 bp, Homo sapiens
aagagacctaggaccaaagcacccaagattcagcgtcttgttactccacgtgtcctgcagcacaaacgggcggcgtattgctctgaagaagcagcgtaccaagaaaaataaagagaggctgccagatatgctaaacttttggccaaggagaattgaagggaggctaaggagagcgccaggaccaaattcgcgagagacgcagactttcctctctgcgagcttctacttctaagtctgaatccagtcagaataagattttttgagtcacactaaatgagcatcagcctctgaaaaaaaaaaaaaaaaaaaaaaaaaac

SEQ ID NO: 3485 - DNA, 401 bp, Homo sapiens
  misc_feature 9, 10: n = A,T,C or G
cttaaactnnctatatttatattttacataagtttttaaaatccgatacagtcaatatttgtttattaaaattatatgatggaccatataatataccaggctgaggaggtccaggcgtatcaataccccaagggaggcacgtccatgtgggtaatgttaagggataccttatatgtcaggccctaaccaaaggaggtttgtggaacttggagagatccaggaggtaacaccaaaaggctgcattgagcaatgcctgcctagccctcctgtacagctcatgattatattgtcgcctgaggccaccttacacaaaaccattcctatctccatgcttttgtttatgctgtgcctccttgagagggcacgctcaccgctctgctgtgttgatactaccgaccctc

SEQ ID NO: 3486 - DNA, 401 bp, Homo sapiens
caattccatatttgatggtagagtggtggcaaagcttccttttaccctctttcttacatccaagggactgtctcatcgaaatctgctggggagatgacaccacagactgttccttcattttcctgtatattctctgtactatgtcgattcgccagaccattcagaggattctcggccttgccccttacacggagccgccaccaagcaggcaggtggatttcttggcccaccacctccttcttggaagttctctagatctcaggatctctatattctctatcattcttctagacacacacacatcagacttgcatctgttttggtagcaggaccataggtagccttactacttggcgctcttctagttttgaattattctaagctgtgggtatgatagagtg

SEQ ID NO: 3487 - DNA, 404 bp, Homo sapiens
gtcagatcttacgtggcttcctgctgggggagatggccttcacccacggatgccgggttctcctttctttcctcaccccaacctttactccaccagagaaacttccttttgacctcagtggggaagagggtgatgagacaggcctagaaagtagtgggggaccaagcgagtggacgccctgctccgggattcctgagtctgtaaatagtgtgcccagcagctgtgaactccctatatagctgaggctgacagtgtcctccagagctgtgtgagaaatgagagcggacgtccacaggcacccagccagttttgggtgttgtgactcactacacctctgtgccctagcagaggtactgttggctcctcgtcttgtgagccttggggtcagctctctacacatgtgt

SEQ ID NO: 3488 - DNA, 374 bp, Homo sapiens
tttgcaacaggggaggaaaaaagacccaaaacttccaaggccctgcttttttcttaaagtactttaaaagggaaatttgtttgtattttttatttacattttatattttttgtacatattggttaggggtcagccatttttaattgatctcggatgaccaaaccagccttcggagcgttctctgtcctacttcctgactttacttgtgggtgtgaccatgtacattatactctcagaggagaaaaacacctcgtaaaagagcaaattgacaccagcatcacatcttatccgagcatcccagtaacttttttgtatatgctactcagctgctactatgaagagttgtgtagtatgaagatgattaaaacgcccaa

SEQ ID NO: 3489 - DNA, 255 bp, Homo sapiens
ggccagcccctcctctccccgccttctgggaggaggaggtcacacgctgatgggcactggagagggccagaaggagactcagaggagccgggctgccttccgcctggggctccctgtgacctctcagtcccttggcccggccagccaccgtcccaagaaccaagaatgcatttgcctgtccccccgggccagcctccacaacttgatgtgtgtgtttgtttggggggaatatttcatatattatataagagacag

SEQ ID NO: 3490 - DNA, 416 bp, Homo sapiens
ctaatttttttttttgttattgtggagatggggtctcatttgttgcccaagctggcctcaaactcctgggctcaagtgatcctcccacctaggcctcctaaactgctgagattaaaggtgtgggtaaccatattctgcctcaatgccccttgttttatagcccttgttactgaaccgtaagtctctgtttttcatcagaaagagtcatacaagctattcccctggggtcctaggtgattccttaggaacggatcactttttccattagattggtatctccagaataactagtggtcattcccagacttcttaaatgccaatatgaggaacctcctgcacgagcaagaccagatttttgagaacaggaaaatagggaagtgttggaacccttagggtaagcctaagcctttactcat

SEQ ID NO: 3491 - DNA, 416 bp, Homo sapiens
cgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcatttcccagggtattggcaagcttgccagtgtacctgctggtggggctgtagccgtctctgctgccccaggctcttcagcccctgctgctcggtcttccccttctgcagcagaagagaaggaagatgagaaggaggaggagtctctaagagtcaaatgatgacattggattttgcccttttattaaaatccctctcccctg

SEQ ID NO: 3492 - DNA, 295 bp, Homo sapiens
aaacctgggagatggagtggctcatgcctgtaatcccagaactttgggaggccgaggcaggaggatcacatgaggtcgggagttcgagaccagactgaccaacaaggagaaaccccgtctctactaaaaatacaaaattagccaggcatggtggcacatgcctgtaatcccagctactcgggaggctgaggcaggagaattgcttgaacatgggaggcggagattgtggtgagcccagatcacggcatttcacttcagccttggagacaaagagaaacttcattccaaaaaaaaa

SEQ ID NO: 3493 - DNA, 370 bp, Homo sapiens
ctggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaaccgtgggctgttacttgctttgaggtggaagccggtttcaattaccgctgtaatgtattcaatcctaatttatggaaggtttttttgtaccgaattctcggttctcttgaagagatagacacacacaatttttgggtttctcacactgtatatgtagagacaca

SEQ ID NO: 3494 - DNA, 354 bp, Homo sapiens
cccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactccgacccggggaggtagttacggaaaataacaatacagggcttctttcgaggcctgtaattggattaggtcactttaaatcctttaacgaggattcatttgagggcaagttttgttccaagcaagcgcgcgtaatttccagtctccattggcgatatataaaggttctctcagtgttaaaaaggtctcgagagttggg

SEQ ID NO: 3495 - DNA, 330 bp, Homo sapiens
aatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacccgtgtcttataggttacactgccaaaacaatgccccgtaaggtggcttatttgtataattgggttacctaaggcacatattaaaaggtaaactacctgttaaggggtctgcacactggcccagtgaggtaggttcttcc

SEQ ID NO: 3496 - DNA, 250 bp, Homo sapiens
gcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacggagcaccacctggtaaaatcttgaaaacaa

SEQ ID NO: 3497 - DNA, 250 bp, Homo sapiens
ggcttttctcttgtgctatggacagttgacaatttaacctaagcatataacttttcaatatgtaattgacagtagaagtgtgacaggatggtggtttacacacatgtatgatacccttttctaaataagagtttctgggctgggcaggttggctcacactggtaatcccagcactttaggaggctgaggtgggaggaatcacttgagcccagcagtttgagaccaacctggccaacataggcagaaccct

SEQ ID NO: 3498 - DNA, 230 bp, Homo sapiens
cagctccgagctgtcacttgaccgtgagaagatgctttgttcatctttagagtcctcctttaactctgattgtctctaactccagtgagacaggaaggaccaagggttgcgaccatcatccaaataatcatagtaattccacctatttatagagcaccaattatgtatccagcaacttggaacatagggtgtcttgacttatgatggggctatgttccgataaaaaccat

SEQ ID NO: 3499 - DNA, 390 bp, Homo sapiens
ttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaatttttgtatttttagtagagatggggtttcaccatgttgcccaggctggttttgaactcctaacctcaggtgatccgcccgcctttgccttccaaagtgctgggattacaggcgtgagcacttttgcccggcttatttttctttatgtttttgcttcgtaagaggttcttttgagcagtgatttgcaactcttgctgacgttgctggggaagctttaaaaaaaa

SEQ ID NO: 3500 - DNA, 350 bp, Homo sapiens
aaaaaactctggggatctttatttgttaataagatgatgtcgtaaaatagctgatgggtggggcgcggcaggtcatgcctgtaatcccagcactttgggaggctgagacaggtggattgcctgaggtcaggaattccagaccagcctggccaacatggtgaaaccctgtcactactgacaatacaaaaattagccaggcgtggtgctgcgcactggtaatcccagctgcttgggaggctgaggcaggagaatcacttgaacccaggagatggaggttgcagtagccaagatcatgacattgcactccaccctgggcaacacagttagattctgtctccaaaaaaaaaaaa

SEQ ID NO: 3501 - DNA, 406 bp, Homo sapiens
tgtgggtaaagtgtggtgttaaaaatgagttataggccaggcactatggctcacacctgtaatcccagcactttgggagcccaggtgggcagatcacttgaggttcggagtttgagaccagcctggccaatatggtaaagccccgtctctactaaaaatacaaaaattagacatggtggcatgtgcctgtatcccagctacttgggaggctgaggcaggagaattgcttgagcccaggaagtgaaggttgcagtgagccaagatctcaccactgcactccagcctgggcaacacagggagatcctgtctcaaaaaagaaaaacatttttacagttgacagattgccaacaatctaaatgaccataggagaaagggtaaataagttgcatatttgcacagtataaca

SEQ ID NO: 3502 - DNA, 400 bp, Homo sapiens
gcgaatttggcacggaaggcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtgacctgcttcagcagcttgtgctgcaccagcaggaggtcctgccccctcactgctgctgctccagctgaggagaaggaagtggaagcaaaggaaggaggattcgaggagtctttatgatgacatggctttgggctttttgactaaaccccttttataa

SEQ ID NO: 3503 - DNA, 140 bp, Homo sapiens
acgaggccaaacaatacaaaggtagccaaggaaagaaattgaccgaaagaagcataatagagtagcaattgtaggacttacacttactacttcccttaaggctgacaatgtcaatcaatcacaagggtcgactgatatct

SEQ ID NO: 3504 - DNA, 185 bp, Homo sapiens
acattcggctcggagacatactaatggtggctttatctagtatggagacgaaaatttgcggtcccaacattgccaaagtccagatgatttttcacgggtgtgctaacggaagggttcagaaatcaccttaattgcaacgacaaaccattccctcatttcgcagaagcacctggaacctcaaggaa

SEQ ID NO: 3505 - DNA, 370 bp, Homo sapiens
cggtgacgatgataaaactcggcccctggtgaaatgacgcccctcccccacctgcccatggcctgggactctctgcgatgtacataactatttaatgcagcggcagggccgacagctttccctgagaggacttaaaagcagaaggaaaccgagatgcttcccgcagccgtggacgattctccaggactctttttttaccttgagcacttgcctcgtgagacttcatagaacagtggtttactgtccccccttctcacctcctcattctctctggctctttctgtcttccccttcttacctccttccttcccttaggcatcacttcttgggaggtaaaggaccttgacttaggttcccggaaaaaaaaaaa

SEQ ID NO: 3506 - DNA, 340 bp, Homo sapiens
acagatcagtcacagataaattgtttaagatccaactccatgtttgagtctgtgtgcatgtacatgtctctgtctgagttttgtatatgcttagaaataaagaactaaagtaatacagaccttaagtacaagtatcattttctttgtttttgcttcttccaattttctaaattttctttaattaccttgtgctactttgtaatcagaaacaaaatcaattataattttcaaatattttcaacattttcataggttctcatacaattaggcattttcttctatattacccttctatgttctacttgctttctttaataggtgacaaggctcttacattaag

SEQ ID NO: 3507 - DNA, 200 bp, Homo sapiens
gtctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaaa

SEQ ID NO: 3508 - DNA, 264 bp, Homo sapiens
ccgcacatggctcggaggatcctacgcccacggagtctcgctgattgctagcacagcagtctgagatgaaacagcaaggtggcagcgaggctgggggaggggcgccggccattgcccaggcttgattaggtaaacaaaggcagcttggggaggctcgaactgggtggagcccacaacagcgcaaggaggcctgtcctgcctctgtatgcttcacctctgtgggcagggcacaaacaacaaaagacagcagtatcctcttcagag

SEQ ID NO: 3509 - DNA, 229 bp, Homo sapiens
cggcacgagcagctggcaacctcaagaaggccctgcctccattccagggcttccaattgaccgctggagatccgggcagagggcaatagcaggttcacgtacactgccctgaaggatggctgcacgaaacataccgctaagtgggccaagattgttatcgagtaccggtcacagaagacctcacgctctccccatctattgacattgcacctatcgcagcataggaggg

SEQ ID NO: 3510 - DNA, 280 bp, Homo sapiens
actttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcactttagctcttcagtattacaggagtttataaatatgtgtttctttgtatggggacactctcaactctcgggagtatctcca

SEQ ID NO: 3511 - DNA, 276 bp, Homo sapiens
aggacctggtttttcaggtactgggagccgggggctcactgcttgcactgtgcttagggtagggatggtaaatatcctccctgcatggctttatcctccctctcattccaaagcaggtatcttcttgttgtcacagagtttcatttagttcagctgcagccacgttgccatcttgagctctgtgtctataggtgaccatctctgtacatatgaggggagcctctctgtctcctccactctatatgcagtcatctttggagagcgcgaggagaaggt

SEQ ID NO: 3512 - DNA, 200 bp, Homo sapiens
cggcacgagggaagaccagtttctttcaatctaaggctatttaatatacattaagaggcggcgcaggtggctcacggcctgttattccacacaacacttttggaggccaagcaagccgggtaatagaggcaagagagtttagagcccatccctggctatacacacccggtgaaccccctgctctctctctaaatacacaa

SEQ ID NO: 3513 - DNA, 250 bp, Homo sapiens
gtttttagtggctcgggatatattagatgacagtgagtgaaatacactaatttctccctcttttctcatgcatttcatttctaggaaccagagagaaagtattggggaagggagccaagcagggagacgtttcacaccttgcctctaaactctgggtctctcatatcacatgtgtgtatacacaggctgtgttttgtccacagatatcggtgggatacgctacaccgcgactcgctctctactctctcct

SEQ ID NO: 3514 - DNA, 284 bp, Homo sapiens
cagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtggtggctctatgagcaagtgtaatatgcggatagaaggcgtgtatcattggttttgatgagtatataaaccccgtattagatgatgcagaagagattcattctcaaacacagtcaagagaacaactcggtcggatcatcactaaaa

SEQ ID NO: 3515 - DNA, 269 bp, Homo sapiens
ccagaacacaggtgtcgtgaaaactacccctaaaagccaaaatgggaaaggaaaagactcatatcaacatttcgtcattggacacgtagattcgggcaagtccaccactactggccatctgatctataaatgcggtggcatcgacaaaagaaccattgaaaaatttgagaaggaggctgctgagatgggaaagggctccttcaagtatatcctcggtcttgtgataaactcaaagctgagcgtcgaacgtcgtgatcatccaccttata

SEQ ID NO: 3516 - DNA, 355 bp, Homo sapiens
agatggtgagaagccgggttttctctatgctaaatgtgtctactaagagcagcactttctactagctaagcacaatcataggcccaccgtgatgagctgctagtcttgaataacattccctgacttaggggaaggcacacaaaaacatattaaggtatgtctattttcatatgtgtgatactgacagagccatggtatttctaaacatatagggttctctcttttcttgtattctgagccaattgcatttattcactacattacaaaccatcactgatgtatccacatagcacacatagtgcagtatgatcatagagataacatcttttataagcagtgatttatgggattttct

SEQ ID NO: 3517 - DNA, 117 bp, Homo sapiens
ctacattgaagactggcaattcgttaatgattatcgccatcctgtcagtgtgacacgatttgtccgacccacatgggaccagattaggtttcattgatgcacacagtgatgggattg

SEQ ID NO: 3518 - DNA, 103 bp, Homo sapiens
  misc_feature 8: n = A,T,C or G
ctgaaatntcaagctccaggacatgcaaggcatttatcaggtgaacagaaggtagagccttggtgatatgacattggaggataatgtcaagggtgttggggta

SEQ ID NO: 3519 - DNA, 150 bp, Homo sapiens
cgccagtatctggaccagatccgcagacaatctttgaaaacctgaagatgctgaaccatgcactagtgtccagattcatgacggtgccttcagagacctctgaccctatgtacagagagctgatgaggctgtatgtcagagagagagagg

SEQ ID NO: 3520 - DNA, 180 bp, Homo sapiens
gttgatccgctggtcccctcttttgggggtagatgcggccccgatcaggtctgactcgctgctctttttgttcccttctgtctgctcgaaccaactgcccttcggcttatctcctctcctctttcctcacaccggcacactggggagtcacagagattggggctctgggctctctacagg

SEQ ID NO: 3521 - DNA, 170 bp, Homo sapiens
ctccccccgagcgccgctccggctgcaccgcgctcgctccgagtttcaggctcgtgctaagctagcgccgtcggtcggtcttccttcagatcggccatctatgtaatatacttacccggggacctctatctagaccacggatgtagaatgtttcttccgacaatcttaca

SEQ ID NO: 3522 - DNA, 273 bp, Homo sapiens
ctcgtgccgaattcggcacgagcaaagtacctggactttatggaatccttctatacttcattgtcaatcatttattggttctaaaactggatcggacaatgttgctattttcagggaggccaatgtttttggaggtaaaatgcacaaattaattttctctttgcctttgcaaacacaatttttttttctgtcatttgcaattgttgcacaaaggggccacgaggggtcttcaagacaggccctcccttatttcttccccggggtggggggcgt

SEQ ID NO: 3523 - DNA, 250 bp, Homo sapiens
ataatttcttacggcctgtttttactgcagtctcggaacataaagtgtgaagatttcatggacatttatcacttccccaatcaataccccttgttgaatttcctatgcttgtctttactttaatctcttaaatcctgtcatcttcataagctgaggatgcatgtcacttcaggaccctgtgatgactgcgttaactgtacaaattgtttgtaaagcatattgtgtttgacaatatgagatcagtgcaccc

SEQ ID NO: 3524 - DNA, 176 bp, Homo sapiens
atagattttatgagaattaagtgagatatgcatttagtgtacaggataatgcctgtcacatagtaagtatgtaataagcatttattatttacttattcagggtattgagtttattgaatttgtgggagcctcggggttattgggaggagggcttggcgttcaaatcaaagggctga

SEQ ID NO: 3525 - DNA, 285 bp, Homo sapiens
ggggagccttctggaacacgttgctttgcccagtcagtggtgctgaggggtatagacaggcatgccacacacgccagctcaccccagggacaacctcccacccctcttgcccttcatagcatgttacccactgtgggaagagaatcttttggcgtctagtattttacaaccaagcaagcaagccctctgaggtgatagaggtgctttccccatctgcttgcttgtactccctccccagagggggcgtcctcccttactcacccaccatcttcttcaatgatggca

SEQ ID NO: 3526 - DNA, 213 bp, Homo sapiens
cggcacgagcgaggccccacaggaggagaaggctgtgttctttgcagggaatgaatacattgatctactcagcagcaccctgtgaggcgaggggtaccccaagccacattaccagccttgggacatttccccctgatgtccacgagagtgggagtccgccgtttacattgaggcagaaacaaagaggagatataatattttcttgtaggagaa

SEQ ID NO: 3527 - DNA, 401 bp, Homo sapiens
ctcgcgaggcaacctctgggccaccggtcacttcatgggcaagaagagtctggagcccttcagcccattcccattgtgggacagactctcccacaacctctcctttaggggacccagcgcactttcagactttagttcaatatatcttgcttctgggaattcctccctcgcttaaaaagaagagcttcttgtgggcgtcgtagccgtctaagaccgccccccgcaccacccaaaatactagctaacaagagggacgtcttggtgacaacatacttactagcaagatgatcaaccaacctaattagtggcagacaacaaacaaacaatggctttcgttatagtattgctaccccaccggaagggatgctttcattggatggcctcccttgattggcacgccc

SEQ ID NO: 3528 - DNA, 394 bp, Homo sapiens
taacataccacgtgtgagagaaatacatttggaaaacaataaactaaaaaaaatcccctcaagattaccagagttgaaataccctccagataatctttccttcattctaattcaattgcaagaggtggggagtaaatgacttcttgtccacaagtgcccacagatgaggagatctctattacagtgcactatggtgtatttcacaacccccgtggaaatacttcggggatgctaccatcctacaacttcgttgttgtttttagcagcagtagtggttcatgcttcgggagctactggagggttattaattagtagttagtagtatccacccattatatgtatgcatcaatccctccctcaggtgggcttcatcgtcctttattaatggagggtg

SEQ ID NO: 3529 - DNA, 309 bp, Homo sapiens
cggcacgagggatggggcttcacttgcttgttgacttccctcctgccaaggggatttggggctttcttgaaagacagtccaagccctggataattgctttactttcttgtgtttgaaggcacctgtttgggttgttttgggttaggtgaccttattgttaaaaacgggtttttcttcttgggggaggggttacacaagggctctactttcagaagtgggacttcttgtttttttttctcttttaaagagggggaagaggttggggctggtggctccacaactgctaatacccacccactacttaggaat

SEQ ID NO: 3530 - DNA, 204 bp, Homo sapiens
aaagatttaagtaattttgccatcctaggcttaaatgcaatattcctgggattatttacaatgcagaattttttgagtaattctagctttcaaaaattagtgaaggttcttttactcttaattggtggacaatgttcacataaatgaattgctatatgaaaagggttaacagataacagactctggagtgtgtgtagcactcta

SEQ ID NO: 3531 - DNA, 308 bp, Homo sapiens
caacaatgatagactggattaagaaaatgtggcacatatacaccatggaatactatgcagccataaaaaaggatgaggttcatgtcccttttgtaggggacaatgggatgaaaatttgggaaatcatcatttcttcaggtaaaacttattcgcaaggggcaaaaaaaccccaacacccgcatgtttctcatttcatagggtgggggacccccacacattggagcaccattgggcacaagggagggggggcatctacaactctttgggggcttcttttttgggggtggggggaggttggggagggggtt

SEQ ID NO: 3532 - DNA, 343 bp, Homo sapiens
gagatgacgaagggaacgtcatcgttttggaaagccgtcgcaataagacgcacacgttgtgccgccgctgtggctctaaggcctaccacctcaagaagtcgacctttggcaaatatggctaccctaccaagcgcaggagaaagattaactggagtccaaaggctaaaggaggaaataccaccggacctggtggaataaggcacctaaaaattgtataccgcagattcaggcatggagtccgtgagggaccaccacctaaacccaagagggcagcttttgcagcagtccagttctatctcaaggagtgtcaccgacttagtcatgcaatatatgattctggtgt

SEQ ID NO: 3533 - DNA, 211 bp, Homo sapiens
gacagacaaggcttgggtgtatatgccaaccagatctcattgaagtatcagcttgttggtactaggtgcaagtgtagcatgttccacatgtagaccaatctttggggtccattggccaattttttaggggatgttactggcccaccattttttacgtgagggggtccctcgcgcggggggtgtaagagttattcaagggttatttttcccm

SEQ ID NO: 3534 - DNA, 239 bp, Homo sapiens
gccatgagcagcaaagtctctcgcgacaacctgtacgaggcggtgcgggaagtcctgcacggaaccagcgcaagcccgcaaggtttcttggagacgggtggagttccagaatcaactttgaaggaactatgattccccagaagggacaaggcgttttttggggcaccctctaggctttaaggtcccttcccgccccttaggtttctgtgtgtcttccctgggggaccagcagacactgt

SEQ ID NO: 3535 - DNA, 151 bp, Homo sapiens
ctgtgcgaattcggcacgagcatgattctattatgtattggtacgtctgtagacagatatattttctcacataagtttctatctttccaaggttacaaatcacacaggtgcaacttgtttttcaattgccatttatggaggagggggtgac

SEQ ID NO: 3536 - DNA, 277 bp, Homo sapiens
gttttatgctttttctacatcagttattatcaaagacaaaagttataggcatgaggtggctttgcaagataagtctgcaggaaaattttccccatctcatttttcgtgaaagggttatctatgactttcaatgttcaattaaacgttaattgttttatagaaaaataatgatttttctggggtttcattcatctcatttctgctcaaccacaagggacatactcaatttcactacagtaggggaataccacggtatggcagccacctcactgctatg

SEQ ID NO: 3537 - DNA, 323 bp, Homo sapiens
cttatccctaccttcatgttccagtggaagaccttagtaaaatcaaagatcagtgagttcatctgtcatatttttttcacttgctttcttactgaccagcaaccaggattttttttttcctgcagagcaagttttcaaaatgtaaatacttcctctttttaacagtccttggaccattttgatccagttcaccagtagggttggacagcatattattttgcatcattttgtccctggttcaatcaagatgttttgcagatattcctttaacgggcggactttggctgtttcctatgacacatgtagtggtgattatttggagt

SEQ ID NO: 3538 - DNA, 311 bp, Homo sapiens
cgaagaaggaagctcctgcccctcctaaagctgaagccaaagcgaaggctttaaaggccagaaggcagtgttgataggtgtccacagccacaaaaagaagaagatccgcacgtcacccaccttccggcggccgaagacacttcgactccggagacagcccaaatatcctcggaagagcgctcccaggagaaacaagcttgaccactatgctatcatccaagtttccgctgaccactgagtctgccatggaggaggatagaagacaacaacacacttgtgttcattgtggatgttaaagccaccaagcacca

SEQ ID NO: 3539 - DNA, 246 bp, Homo sapiens
agctgacgcctctgctttcctccacctgaagagaacctgcgtgctgctcctttgcttcggacctccgcctctgcccgggagaaagcccaggccagcctgctgacaagcagagaccatgagaaggagagttcaggggtcccaatccaggccatcctagaccagccagctccagctgatccgcacgcagccacttcggctacctttctacttgccaaagggaggtccagggctcacccagattcagag

SEQ ID NO: 3540 - DNA, 113 bp, Homo sapiens
cggctgtgtcaacttcggctattacctgtaccggtgcgatccagcatgagccccacgaccaacgtggtcctgtgtcgtgtcagtgtggccacggccctcgtcgggccctgtcg

SEQ ID NO: 3541 - DNA, 183 bp, Homo sapiens
gacactaggaaaaaaccttgtagagagagtaaaaaatttaacacccatagtaggcctaaaagcagccaccaattaagaaagcgttcaagctcaacacccactacctaaaaaaatcccaaacatataacttacctcctcacacccaagttggaccaagtcgtatcaccctatggagcacctaat

SEQ ID NO: 3542 - DNA, 143 bp, Homo sapiens
aaaaaggacccttcactattcttgtttagtaaatagctgtctgctcttcagggaactgttacctatgggtgtattaccaaagaacgctggcaattggaaatgtcctgatggaaattctttcacgtgccggttctctggcatcc

SEQ ID NO: 3543 - DNA, 156 bp, Homo sapiens
gggtgcccagagatgcagggggtaaaattcaacaaggagaaggaattctctaggcaaactcttttaacaattttgaacggggcgagaagccccttgggccagaacttaggaggaggttgcgaatcctaatccggcatgcagagtttacaggccagg

SEQ ID NO: 3544 - DNA, 195 bp, Homo sapiens
ggacaactggcacaagcgccgcaaaaccgggggcaagagaaagccctaccacaagaagcggaagtatgagttggggcgcccagctgccaacaccaagattggcccccgccgcatccacacagtccctgtgcggggaggtaacagatataccgtgccctgaggttggacgtgggtatttctcctggggctcagagt

SEQ ID NO: 3545 - DNA, 182 bp, Homo sapiens
ctaaaattgaccatgtaattggaagcaaaacactcctcagcaaatgcaaaagaatagaaattataacaaacagtctctcagactacagtgcaatcgaattagacctcagggttaagagacctcactcagacccacacactacatggatactgaacaacctgctgctgtatgactactgggta

SEQ ID NO: 3546 - DNA, 170 bp, Homo sapiens
cagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgatt

SEQ ID NO: 3547 - DNA, 249 bp, Homo sapiens
ctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtcccccaagagggctccggaggatgagctaccccctcaggtgcacaaggtatagacaaggctgagcagggttcctgttgcccagatg

SEQ ID NO: 3548 - DNA, 275 bp, Homo sapiens
cagttcatgaacctgggaggtgtgctgtcctggctggacgctacttcggacgcaaagctttcatcgtgaagaacatttatgatggcacctcagatcggccctacagacattctcttgtggctggatttacccctaccccccaaagtgacactgccatggcaagaagagatcgccagagatcaaggtaaatctttgtaaagttatactcaatcacctaatgccacaaggtactctctgatatcccttggcaaactttcgtaataggatgtttcagg

SEQ ID NO: 3549 - DNA, 290 bp, Homo sapiens
ccaggggactcgaagtgtcgtttcggggccgctgtctacggggagaggaggtggcggtgccccttggcctcgttgggatacgtgatggtgacagaagagaagaaggtttcgattgggaagccagaccctttgcgggattccgggacttacgaccaggaggaggagccgcttggagcggacttcgaccgcttcattggagccacttccaacttaagccgtttaccttttggttcttgagacattccttggcccggatgccaaagttcgttgggccttaacttggccacctt

SEQ ID NO: 3550 - DNA, 355 bp, Homo sapiens
cagagtctagctcccaccagcagtcgggcctgcctcctgcaaaagaggggaaagagaagaaggagaaacccaagagcaaaacagcccagcagattgccaaagacatggaacgctgagctaagagtttgaataagcaggaggaaactttaaaattagctttcagcctgtcaattccttgagggaaggagaaggagataatcttctgcagcagacgttggctttctctctttgagagaagggagccttagctgaaggcagcagctcatccagtattggtccaaatggagatgaggagatcccctcaaagggtctggtgctgctacagtgtacagtacataggagactgtgagtctta

SEQ ID NO: 3551 - DNA, 265 bp, Homo sapiens
gtccttttctgccacctcccagccacacacatttgcagacccacaagaagaactgtagccttgataatttcagttcaggctggaaaaatgccatgcaataatctggtttgctttcagtaagtaggcaccaggtgaaactgtatattttcatcacctattctgctgttctatctaaaatgagtgtacctgtggtgtgtgactggcccttgtttgtgccagctcctacaaggatgttcctgtgagacactgtcgcctgccctctaga

SEQ ID NO: 3552 - DNA, 295 bp, Homo sapiens
ctgatcctgagctggccttggcccttcgtgtatctatggaagagcagcggcacgccaagggagggaggaggccccgccggaagcctgcagctttcttctcttggaggccggggatttctacgactgggacttaagactcagacgatgccctgctgaagatgaccatcacccagcaagagtttcgccgcacttggcttctcacctaagcagtatgactgaggagacagattgcttatgcatgcagatctcctgcaggagcagagttcggcaggcggaatcagcagcattcatgcag

SEQ ID NO: 3553 - DNA, 275 bp, Homo sapiens
catatatattgtgcagctagggcgacagccaagaggtgtgtgtatgtctttatgaaatgtttgaaaagagataaactgactgcttgataatcactctcaggtgtaaagctccaagtgtaaataaaagtggcattaacaaatctttcagtacaaggtacagctgactatatataccagggctagctaagggcacagctgagagctccgatctccagagagactaatctaaagctctgctttgtacttcctcaccctgctttcgtacaaggaggggg

SEQ ID NO: 3554 - DNA, 350 bp, Homo sapiens
cggcggtgtcggcagctgctgtagcgaagagagtttggcgcgatgtctcacaccattttgctggtacagcctaccaagaggccagaaggcagaacttatgctgactacgaatctgtgaatgaatgcatggagggtgtttgtaaatgtatgaagagcatctgaaaagattgattccaacagtccctctatcacatatgacatcagtcagttgtttgatttcatcgatgatctggcagacctcagctgcctggtttacgagctgataccagacataccagccttataccaaagactgattaagagagatctacgtgctctgcgtcggcaggccaacaggctgggaaatattg

SEQ ID NO: 3555 - DNA, 260 bp, Homo sapiens
gctgtctccatcttgtctgtatccgctgctcttgtgacgttgtggagatggggagcgtcctggggctgtgctccatggcgagctggataccatgtttgtgtggaagtgccccgtgttttctatgccgatgctgtcctagtggagacagactccactgtaactagattgatctatgcactctgtctctgctggcagggagtatgtgtagcctgtgtaatgttgataccaggaatggaagacagcttaataagattcctgga

SEQ ID NO: 3556 - DNA, 260 bp, Homo sapiens
cagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtaatggagggtctggatgcattcgatgacctcatgcagcacacgcacatccagccctggtacctcgcgggtggagaggcccatcaccgaggtcctccca

SEQ ID NO: 3557 - DNA, 308 bp, Homo sapiens
gtcaacccaagacctaagaatcttgatgttggaataaagatggaggaagctatgacctacacagaggacagttatgggatggatgggaaggttaatcagccccgtctcactgcagacatcaactggcaaggctagaggagctacacagtgtgaatgaaaacatctatgagtacagacacaactacagacttagtctggtggactggactaattacttgaaggatttagatagagtatttgcactgctgagagtcactatgagcagaataaaacaattagactaaactctcaagtacgggtctggttgt

SEQ ID NO: 3558 - DNA, 355 bp, Homo sapiens
atggcggaacaagggagacacaagaagcggatccaggaagttggtgaaccatctaaagaagagaaggctgtggccaagtatcttcgattcaactgtccaacacagtacaccaatatgatgggtcaccgggttgattattttattgcttcaaaagcagtggactgtcttttggattcaaagtgggcaaaggccaagaaaggagaggaagctttatttacaaccagggagtctgtggttgactactgcacaggcttttaaggagcaggtttttcaccgagccctaaagtatgaaatgaatatgataaggcataaggaagagaaggtaaggaaagctgaagtggaaagagagataaag

SEQ ID NO: 3559 - DNA, 209 bp, Homo sapiens
tagaaaccaagtccataccatttaatgtagctaatgcaatgccatttggcttttttttgccctgtaaataattgaaggggagagacaaacggcaagagccttcctctaggtaattaggggtcggattccagaaagcctttacgggccattttcttaaagtgttcttccttcataaaggatttatattgatttgtgtgcggtaaatacat

SEQ ID NO: 3560 - DNA, 185 bp, Homo sapiens
tttaaatcttggctatctaaaatttcctccctttgtcttgaatatttgtaaggcctttaagaagttagtgtcagcaaattaattgaaggttatgcttcctatactggggccatattcacatactgagtatagtactcctgctactgctctcaatgtaaaatgtatgcctgggtgttttaaagtaa

SEQ ID NO: 3561 - DNA, 269 bp, Homo sapiens
agacagggatggagtaaaccgaagccaatttcagggctcttggcgtgttggacacagaaggaatcctagtgcagcctttggtagctaacagtcactgattttataattggagaatgcgtaaagattcatttttcaaggagaagagcctccaaatggccaatgaaggaggtaaataaactaagatattccgagggagggacccaggccacctcccttccgcagtctgcagatgagggttttttgaatgaaatgccactctcattttcaga

SEQ ID NO: 3562 - DNA, 460 bp, Homo sapiens
ggtaaccttttgcactcaaattcctttatcaggaataacttacatagccactattttacaaagccattggaacctttttatttggtgcagctgctagtcagtccctgactgacattgccaagtattcaataggcagactgcggcctcacttcttgggatgtttgtgatccagattggtcaaaaatcaactgcagcgatggttacattgaatactacatatgtcgagggaatgcagagagagttaaggaaggcaggttgtccttctattcaggcactcttcgtttccatgtactgcatgctgtttgtggcactttatcttcagccaggatgaagggagactggcaagactcttacgcccacactgcaatttgtctgttgcgtatcattatgtggctgtctcgagttctgatataacacactggagcgatgtgtgactggactattcaggagctctggtgca

SEQ ID NO: 3563 - DNA, 273 bp, Homo sapiens
gtgactagtgttcagcttgattaggacgaacctgggcacttagccatgcaggaacatggcgagcctctagccctattgggagcagcaatgggtgcctcgctggatcagaagtgcagtggatgccctgccggatctggaggggtggaagtcagtggggggtctgtcgacggcgatgatcggcagtggtggatggtgagcaaaatctcagctcgagagtactcctagagcggccgcggcccatcgattttccacccgggtggggtacaggtaagt

SEQ ID NO: 3564 - DNA, 309 bp, Homo sapiens
gggagaaactatcaatgctggcagccagtttgaatataatgtagaaggagtgacttccaaggaaatggctacccaacttgccttcatgcgcctgctggccaactatgcctctcagaacatcacctaccactgcaggaacagcattgcatacatggatgaggagactggcaacctgaaaaaggctgtcattctacagggctctaatgatgttgacttgttgctgagggcacagcaggttcacttacactgttctggtagatggctgctctaaaagacaaatgtatggggaagacatcattgatacacaca

SEQ ID NO: 3565 - DNA, 277 bp, Homo sapiens
tctcagtgaattctggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaggaggggacttgaattttagggactttaattcacccctccttcaatacacctctcccccttcttgtttgcacatgccaagatact

SEQ ID NO: 3566 - DNA, 231 bp, Homo sapiens
cggcacgagagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaga

SEQ ID NO: 3567 - DNA, 158 bp, Homo sapiens
cggcgtctcgtgtcctttcagcctatgtcagccgcctgcccgcggccttttgcgccgttgccccgggtccggatgctggccgtggcccggcctcttcagcaccgctctctgctccgcgggggcccagacgaggctcgggactttgcagccgccttagt

SEQ ID NO: 3568 - DNA, 339 bp, Homo sapiens
gcgggacttagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaggaaggctgggtctcagtcctagtgggagacccccttcctagtccacctgaaaacaccaaattcaccatcatctgtcagagattaaaggacacaccttagagagagtcatccacacacattcacacacgctagcaaccttcca

SEQ ID NO: 3569 - DNA, 340 bp, Homo sapiens
gtatgctctcagttgagaacaatggaatggatttctcaggagctttaagccttctttaaagtttaccagaatttagaacgtaaacatctgctcaaagttttaatcaaatgtagggaatatacaatgtggatatttctgtaactttgtcagctagaatattatgtttcacaagtctttaaaatggcatttttcaatcaatgtttgatcaaacacaccacggttaaattagtttgaaaaatacaacttactatatatagattgggctgtagtctcatgcagagtctggtgataactttggcatatcaaaggctctagtgagctccataataagatcttgttt

SEQ ID NO: 3570 - DNA, 315 bp, Homo sapiens
gaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaggattttagaggtgcaatatttatagtgttatttgtgtcacctacaagcctttccctgaggtgttacaatcttgtcttgcgttttctaaatcaatgcttaataaaatatttttaagggattacag

SEQ ID NO: 3571 - DNA, 209 bp, Homo sapiens
ctgacattaacagttttccatgaaaacgttttatttgtgtttttaatttatttattaagagggattctcagatatttatatttttattttatttttttctaccttgaggtcttttgacattgtggaaagtgaatttgattgaaatatttaagcattgtttgcttattgttccaagacactgtcaataaaagcatttaagttgaatgcga

SEQ ID NO: 3572 - DNA, 285 bp, Homo sapiens
atttagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggagttcaaatttgacagcgagttcagctcagctgtgggccttctgcccttccagctgtgcctagcaagcaaaacccaggaaagaagcagaagcctcctggccttacatacagaatgcctggacaagagaaac

SEQ ID NO: 3573 - DNA, 300 bp, Homo sapiens
ctgtcctttccccagtaccacattgttttgattactgaagctcagtggtaagtcttagatcaggtagagtgagtcctctaattttgtttagattgtttgcatttctatataacttttaaaaacagctttttaatttttagaaacaaaagtctgctgggattgtggctggaattgtcttttctccatagtcagtttggagaactgactttttaacaatattgattttccaacatatgaacctcatatgtttttccatttatttgtgtattcctaggtcccctcagcaatgttttatcattg

SEQ ID NO: 3574 - DNA, 360 bp, Homo sapiens
gacactagtggatccaaagaattcggcacgagaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggattgtcaccacaggtgaatgcagtctttccagaatcaaaggcggacctcattttgattgtggtagcagtggagcacgcactcctggctttaaagtttatacttgcatttgccatacctgataagccacggcatatccagatgaaacctagccagactggaatttgagtctttgga

SEQ ID NO: 3575 - DNA, 146 bp, Homo sapiens
tccttgttaaatatcaggaatataggccgggtgcggtggctcacacctgtaatcccagcactttgggaggctgaggcgggcggaacacctgaggtcaggtgttcgagaccagccaggccaacatggtgacaccccgtctctactaa

SEQ ID NO: 3576 - DNA, 228 bp, Homo sapiens
gaactgcagaaaaaggaagaagagaatgctgacagcgatgatgagggggaactacaggatttgttgtctcaggattggagggtgaaaggcgcattgttatagggttttaaagacccaaggtttctaacagcctctgctgttgtataaaaagtgctgtctgctcagtagtatagcggttacttcatgcctcaagatttgggtacctggattgctaaactggattgttga

SEQ ID NO: 3577 - DNA, 219 bp, Homo sapiens
aataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgcgcgtggtggcgggcgctttaatcccagctacttgggaggct

SEQ ID NO: 3578 - DNA, 326 bp, Homo sapiens
ggcgagatcagcgccctgacggccgaggcgcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactacatccagcctggggctgagggctgaggcactcgcgaggagagggcgctcctctctacacacctactagtcaccagagactttagggggggggatccactcgtgtgtttctatttttagaa

SEQ ID NO: 3579 - DNA, 158 bp, Homo sapiens
ctccaccccatttgctcgcagtatcctagaatctttggctctcgctgcagttccctttgggttccatgttttcctgttccctcccatgcctagctggattgcagagttaagtttatgattatgaaataaaaactaaataacaattgtcctcgtttgaa

SEQ ID NO: 3580 - DNA, 374 bp, Homo sapiens
tcaagaccttcccctaccttttgtggaaccagtgatgcctcaaagacagtgtcccctccacagctgggtgccaggggaggggatcctcagtatagccggtgaaccctgataccaggagcctgggcctccctgaacccctggcttccagccatctcatcgccagcctcctcctggacctcttggcccccagccccttcccacacagccccagaagggtccagagctgacccactccaggactaggccagccctcagcctcatctggagccctgagaccagtccaccacctttctggcctcatctgacactcctccgcatcctgctgtgtgtcctgttccatgttccggttccatccaaatacactttctggacaa

SEQ ID NO: 3581 - DNA, 312 bp, Homo sapiens
agaacacattatgtacatgttttctattcatgtccagggcatgagaatcttaatattcttatacttccctttttgcatgcagtatgtctggaatatgtttataaaattttagcaaggggtgagatcaagggacagaggtagagtggttatttaaagacaatcagaaatgaccttaaaagctgccctgcaaaaccatcctttcctatcatgaagagtacctccatatttctagagattgtctctgaaccgttgctacatagccataaatgtctgtaaatcatgttggctatcagttcttgctattctcagagc

SEQ ID NO: 3582 - DNA, 215 bp, Homo sapiens
aaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaggaaaaaaaaaaggcaaatggggttagggcctcatggaatgggaggggaagg

SEQ ID NO: 3583 - DNA, 400 bp, Homo sapiens
ctccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaaggctgtggcactgtcctcctctccggtcctcgaagggccgagagtgtaccgcatttcggcaaggcccaggaccccgcaaagcaaacaaacctacgtccgtccagggccggagttcggcgtccaa

SEQ ID NO: 3584 - DNA, 175 bp, Homo sapiens
cggattggaagcttcggaagaggccctcgatggggcccacccatccccggacccaagtcttcttcctggcgggcctctcgtctccttcctcggtttgggcggaacgatcacctcggatgcctacgtggaagggacctcgaatgtgggaccccagccccttctccagctcgaaatc

SEQ ID NO: 3585 - DNA, 210 bp, Homo sapiens
gggttccagcttagctctctcagatcctatcctgtggatttagttattatgtgtatttatgtagtatttcaaacatttcaaaatgctttcatctatgtttatcacattttaataccacagcacttataatgatgtcactacatataggagctcacagttaaggggttttctgaggctgtaaagttattggaggacttgagacacactccg

SEQ ID NO: 3586 - DNA, 210 bp, Homo sapiens
gactgtttctaggcagtccttttacttatcccctctgttctgcaattcccaatcccctttgtccttacaatagtttagttagtgtcactttacaggtgactctcattcttacttagaggcctcttctctgtgttcctgtaccgcgtaggactatctctgtcttagcacccatcacataatatttgactaacttcacctatcttataactg

SEQ ID NO: 3587 - DNA, 102 bp, Homo sapiens
gagtacttcttagagcggccggggcccaatcggatttttccacccgggtggggttaccaggtaaagtgtacccaattccgccctatagtgagtcgtattaca

SEQ ID NO: 3588 - DNA, 265 bp, Homo sapiens
gttcctgctagcatggtgcatacatcttggaggtggcgcacagttaacaatgaaccaaattacatgagcaagatgagttttactaactgctatggaaattaaatggagcattattggtagaatgggcctattaaagaaggggtctttttattcggttgtatgatcaggaatgacctgttggaaggaagtgattttcaggcaagactgtatatctgacataaaggcacaaatccagacactaccactaactggctctgtgacttgg

SEQ ID NO: 3589 - DNA, 250 bp, Homo sapiens
tttttggttacggcagcacttttatttttccttacacaatgacgtgttgctggggcctaatgttctcacataacagtagaaaccaaaatttgttgtcatctcttcaaagaatcgagaattgcgtacaaaaaaaaccttacataaattgaggatgaatacatttacaggcgtaaatgcaaaccgcttccactcaaagcaagtaacacccaccggtgttctggccaaagcatcactaaggagggaactgggt

SEQ ID NO: 3590 - DNA, 131 bp, Homo sapiens
ggtcgacatkgrtcaagrwttggcacgrgscccaatctgatggtattaggagtggggctttgggaggtgactaagtcacgagggtaaagccctcatgaatggaattagtgccctcattaaagagatcacag

SEQ ID NO: 3591 - DNA, 183 bp, Homo sapiens
caaatttaggaacacattgagccttgggttaagtaaatatttcacttatatgggacacttggcctctgtcagaaattggcgaccagcctgggccgacatggtgaaacctcatctccactaaaaatacaaaaattgggcctggtgtagtggcacacgcctgttgccccagctagtttggaggcc

SEQ ID NO: 3592 - DNA, 241 bp, Homo sapiens
taaacaaggagagaagctatttaaacatgcaggaggcctttgagacagccgattgctacacccaggcctgaatcagccctaaggcttttttgaggctgaggcaaaaaataaaatccacgaatttggttagctttcctttcatgaaattagagatacactgttgtaaatacaaatcacctatagacacacatgactactgagagacttcaaggaaattaacctataatttccttaatctcat

SEQ ID NO: 3593 - DNA, 194 bp, Homo sapiens
ctttagaggacagaaaggataaggatgctaaattccgtctgattctaatagagagccggattcaccgtttggctcgatattataagaccaagcgagtcctccctcccaattggaaatatgaatcatctacagcctctgccctggtcgcataaatttgttctgtgtactcaagcaataaaatgattgtttaacta

SEQ ID NO: 3594 - DNA, 163 bp, Homo sapiens
gcggaagagggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaagcggcc

SEQ ID NO: 3595 - DNA, 155 bp, Homo sapiens
ccagcaggaggcgccatcatgggagtgacatacgccataacaaggaccgaaagttcggcgcaaggagcccaagagccaaggatatctactgaggctgttggtcaagttatacaaggtttctggccagaagaaccaactccacattcaaccaggtt

SEQ ID NO: 3596 - DNA, 301 bp, Homo sapiens
ggcaggagcagggctggacgggcctgaaggagaccacgggccccaaggaccccaaggcgtgcccggcaccagcaaggacggccaggacggtgctcccggcgagcctgggccctcccggagatcctgggcttccaggtgccatttgggcccaggggacacaggggatcttcgacactcagcctgccaaggagccgtgttaggaggggtcggggagaaatcaggctctcgaagctcataaaattcaacgtgaggaagcaagttacaaggacgcccgcagcacagtggacgatcatgaaggagc

SEQ ID NO: 3597 - DNA, 326 bp, Homo sapiens
cagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttatcccaattaaaagtatgcagattatttgcccaaagttgtctcttcttcagattcagcatttgttctttgccagtctcattttcatcttcttccatgggtccacagaagctttgtttcttgggcaagcagaaaaattaaat

SEQ ID NO: 3598 - DNA, 322 bp, Homo sapiens
cccttgcgcttcccgagctggcggggtccgtggtgcgggatcgagattccgggctatggcgccgaagttttttcgtcagtactgggatatccccgatggcaccgattgccaccgcaaagcctacagcaccaccagtattgccagcgtcgcgcctgaaccgccgctgcctacagagtcacactcaatcctccgggcaccttccttgaaggagtggctaaggttggacaatacacgatcactgcagctgctgtcggggccgtgtttcgcctcaccacctgcatcagcgccatgtcgcgagagccgacgacccctgaactacttc

SEQ ID NO: 3599 - DNA, 161 bp, Homo sapiens
atttaaaagggcttcgctcatatataggaaaatcgcatatggtcctagtattaaattcttattgcttactgatttttttgagttaagagttgttatatgctagaatatgaggatgtgaatataaatgagagaaggaagagagtaaagtagagtgagtctcc

SEQ ID NO: 3600 - DNA, 203 bp, Homo sapiens
ccccccaccccctggattttccttctccctccatcccttgacggttctggccttcccaaactgcttttgatcttttgattcctcttgggctgaagcagaccaagttccccccaggcaccccagttgtggggggagcctgtattttttttaaacaacatcacacattccccacctgggtgctccccctttccatggtgccaact

SEQ ID NO: 3601 - DNA, 338 bp, Homo sapiens
gtttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcaggttcggatgagaccaggtgttgcttgttcagtatctcagcccagaaagatgaattaatccttgaaggaaatgacattgagcttgtttcaaattcagcggctttgattcagcaggccacaacagttaaaaca

SEQ ID NO: 3602 - DNA, 103 bp, Homo sapiens
tccgccgctggcagtgcagtgccgacttgggggggtgctctcaccctctcagtggcggcgatgcagcagtccaggctgtgttgtgcttggccacgtttgtggt

SEQ ID NO: 3603 - DNA, 144 bp, Homo sapiens
tcaggcacgtgtcgccgatccgtcgcgtgccccagcgctctgcctcttgtccgatttgcgattgtgttggcggggtgtcccaggtgtctaggttgtgtttcgaaggcgtgtcccccctatggggtggggtgctccagatcgtac

SEQ ID NO: 3604 - DNA, 132 bp, Homo sapiens
ctcattgtgccatatcgaatgattgcaaactcggctgtgcccctatatatggtcccgggggtattatttataacgggtcaaatcacatgttcaatattaatggtgggcgtgttgatggcctgattaggtcat

SEQ ID NO: 3605 - DNA, 115 bp, Homo sapiens
gctgtccttgcggagccttcctatccggcgggctttggctgttcttgagcttgtgcacttcggagcctgaggatctgtccccgccgggatatgggttcctccctagctcctggag

SEQ ID NO: 3606 - DNA, 106 bp, Homo sapiens
caggcagtcgcatggcgatgtgtcatggcagggggcgcaggtctgtgtcacgcgcacgtgtgccatgtgcactcctaccgcatggtttgcttgcgccgctctcagg

SEQ ID NO: 3607 - DNA, 154 bp, Homo sapiens
catcatgcacactggccagccacgccggcatgtccaatgcgcagtggtttcactcaccatgtgtcagtgtggtgtgccacatctgtggccatgtgtcgtcggggcttgtgtttttctagtgcgcggcccgcttgtcacgctgggcaggctccat

SEQ ID NO: 3608 - DNA, 112 bp, Homo sapiens
tccccttacattacatccgacccccctgcttgattatggggtcgtactggccgggactactccgtctacgtcttgctgtatcttcctcacgtgggtccgctctttctcctct

SEQ ID NO: 3609 - DNA, 102 bp, Homo sapiens
gacttcactccctgcggacggcttacttctgacggcgctgcactggggactactctcccggtctcttgccgtgggtacggcggggctcgcggtaagtacctc

SEQ ID NO: 3610 - DNA, 167 bp, Homo sapiens
tgagcttttcaggagagcgagtttaagtttgcaaagtacaagctgcttccggagataaattcgttcctcaaggtgtagagggagaaaggcccaatctctaaggcccatctcctcttctttttctctaacgtgccaagatcaagtcaccctgcttcttgggctctcaa

SEQ ID NO: 3611 - DNA, 262 bp, Homo sapiens
gaaattcgctgggggccaggcacgttggctcacacctcttaatcccagcactttgggaggcactttgatccacctaaggtcaggagttcgaaaccagcttggccattacagggaaccccgctttctattaaaatatacacaaattaaaaaatttagccaggcatggtggcaggcgcctgtattcccagctmytttggagcctgagacaggagatttgcttgaccctgggaggcagagtttccagtgagcagaggttccgcca

SEQ ID NO: 3612 - DNA, 360 bp, Homo sapiens
cgtcattctattcttgctgcctggaatgtccttcctttccattgccacgtgtacaaattcaaccccttgttctagacccagcacaaacatcacctaaacattccgtgaagcctttgatcttgctcaaagcctcctcctcgtgtttagggtgttttttcatctctgttatgacacagtattctcggtcacagcctataattcctcgtggcagccatcctatagaatacttgaaggacgtatcagattttaggtatatttttgtcattctagcagtcacactgagtcttgacatagaaactctctactctttgctaaatgcatttatttagaatctcctagcttggatagagtgggattagt

SEQ ID NO: 3613 - DNA, 321 bp, Homo sapiens
gaagggagccgccgccatgtctgcgcatctgcaatggatggtcgtgcggaactgctccagtttcctgatcaagaggaataagcagacctacagcactgagcccaataacttgaagggccgcaatttcttccgctacaacggactgattcaccgcaagactgtaggcgtagagcagcagccgacgcaaaaggtgtcgtggtggtcattaagcggagatccggccagccgaagctgccacctcctatgtgcggacaccatcaacaagagtgctcgcgcacgtcagcagcatcagacacatgatccgcaggacaagtaccgccc

SEQ ID NO: 3614 - DNA, 249 bp, Homo sapiens
ctcgtccatttttggcagggtggaacgccgaggacttaaaaaagggtggcgggcagtagcagcagccactctaggcagcagagttccgtcaacccagacccagttgcactagacgcgcatcgggaattccttcacaggcctgcgtctggatacgtgccacaggagatctggaagagagctgaggaggccggtcaatgaggtgaagcgccagcgatgacggagctgacagaaggacgtgtctgaggcgga

SEQ ID NO: 3615 - DNA, 226 bp, Homo sapiens
aatttaaagttccagattttgagctactattgctaacagatcccaggtttatgtcctttgtcaatcccctttctggcagacggtcctttaataggactcctaagggatggatatctgagaatattcctatagtgataacaaccgaacagatgttaccactgtaccagactcagaagacctatgaaaagaagttgtatgtgccacataaaactctgaatataaaggt

SEQ ID NO: 3616 - DNA, 105 bp, Homo sapiens
aatttttttaggtagtacgcagagacgtagttaacattaaaaaagcaattcttttgggcactttttaatatccaactaggggttttttttggtgttattgttgtc

SEQ ID NO: 3617 - DNA, 408 bp, Homo sapiens
gacactagtggatccaaagaattcggcacgagcgccagtccctcagcaggcttcccaatggatttcaatgtcactctacgccttcgagctgagctggggagcactccattctgcctgggtgacaatgccttggtttcaccactatcggaatgtgactatcgggcctccagaaaacattgaggtgaccccaggagaaggctccctcatcatcaggtctcctctccctttgacatcgctgatacctccacgcctctttttgtatatgtccattactggaaaaggaggatccaccaggtcaaagcctttcagaggactccattcattggtacttaaaccctccagagttctgtttcaagccagccactctttggcaaagtacactgagggtcggcattaagacaatctctc

SEQ ID NO: 3618 - DNA, 369 bp, Homo sapiens
ctcgtccattttcggcacgaaaaaattatggagtgggaggacagtatgaaccgcacttcgacttctctaggcgacctttttgacagcggcctcaaaacagagggggaataggttagcgacgtttcttaactacatgagtgatgtagaagctggtggtgccaccgtctccctgatctgggggctgcaatttggcctaagagggtacagctgtgttctggtacacctcttgcggcgggggaaggtgactaccgaacaagacatgctgcctccctgtgcttttgggctgcagtgggtctccaataagtggttccatgaacgaggacaggagtcttgagaccttgtggatcacagagtgactgacatcctttb

SEQ ID NO: 3619 - DNA, 192 bp, Homo sapiens
ggaattttatgtcaggaagtgtggtgatattcttggggtaaccagtaaactaccaaggagccaacaggatgcccaaacatataccttgagcacgtcttcttacaagtggtggagttcacgaaattgaaccaggacatgacatcgatacacgtgaaacagcattccagacactttctgaggaccatgactctg

SEQ ID NO: 3620 - DNA, 213 bp, Homo sapiens
cttagatagcttttatgaatatagcttaaaattgttgagatattccaatacamccacactggccttcatgggtaaggggcagactggatgttttactctttcacacccagccctgttttctcagtacataccttggtcatgggttactaattgattactttgaggaggagagagggcgcacacaacactgatgagtcaatgccatacctcaga

SEQ ID NO: 3621 - DNA, 332 bp, Homo sapiens
ccggccgcgaggtagaaaaggccaaacgggccctgtcttctcagcatcaagcaagaattgaaattgagtccttctatgagggagaggacttttctgagaccctcgactcgggccaaatttgaagagctcaccatggatctgttccggtctactatgaagcccgcccagaacagtgttggagattctgatttgaaggaggtctgatattgatgaaattgttcctcgttgggtggctcgcctcgattcccacagatcagcaactggttaaagagtcttcattgcaggacccatcctgggcataaccaagatgatgctgtgcgtatggtctgctg

SEQ ID NO: 3622 - DNA, 212 bp, Homo sapiens
tcagtcacaacagcagcctagcagtacacccgagaagcgaagaacctccctcattccaggcccaagtcacccaacatgcaggacctgaagaggaggtttaagcaagccctctctcccaaagtgaggcttgtcacttccgtttgtaggcaggaggagcactcagggggtttggtttccccaggaggaggcctsaggttttcctagtcaggacc

SEQ ID NO: 3623 - DNA, 117 bp, Homo sapiens
ggcgacgcggctgagggcttctcgtcggggtcggggctgcagcgtcatgccggggatagtggagctgcccactctagaggagctgaaagtagatgaggtgaaaattagttctcttgt

SEQ ID NO: 3624 - DNA, 188 bp, Homo sapiens
agctggcaacctcaagaaggccctgctcatccagggctccaatgacgtggagatccgggcagagggcattagcaggttcacgtacactgccctgaaggaatggctgcacgaaaacataccgctaagtggggcagattgttatcgagtaccgtacacagaggacctcacgcctccctatcattgatata

SEQ ID NO: 3625 - DNA, 202 bp, Homo sapiens
ggaattcggtgtggacatagggccggtctgcttctttgtaaaaacctgaacccagaaacacacacattccgttgcaaccccaaaggaccaaggtactttccattctcagtcactctaggactctgcactgaatggctgacctcacctgatgtccatacatcccacctctcacagtgggacttttctccctctctttctgaga

SEQ ID NO: 3626 - DNA, 143 bp, Homo sapiens
cggcacgagggcgcctgaaatcccagcctactcaagaggctgaggcaggagaatcgcttgaacctgggaggcaaaggttgcagtgacctgagattgcgccaccgcactccagcctgggcgacagagcgagactccatctttaa

SEQ ID NO: 3627 - DNA, 194 bp, Homo sapiens
caacagcctcaagatcatcagcaatgcctcctgcaccaccaactgcttagcacccctggccaaggtcatccatgacaactttggtatcgtggagggtctcatgaccacagcccatgccatcactgcccacccagaagattgtggatggcccctccggaatactgtggcgtgatcgccgggggctctacagaaca

SEQ ID NO: 3628 - DNA, 406 bp, Homo sapiens
ctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctccaggctgagaaactaggaccaccatcctgaatggtttaacgtgtacacaaggtccacatcacgtgagcacccatgagtgtgccgtcctttaagacggatcataaacctggtcagcttcatcgaacaagtagcagtttccatgaaatagacctgcccttcctttttgaattctccggggaaagggtgacttaactggagtcaggaggagctgaggagccttacctcca

SEQ ID NO: 3629 - DNA, 389 bp, Homo sapiens
gtttcttgactggaggccatcaaccctcttggttgaggccttgttctgagccctgacatgtgcttgggcactggtggggctcggcttctgaggtggcctcctgccctgatcagggacctccccgctttcctgggctctcagttgaacaaagcagcaaaacaaaggcagttttatatgaaagattagaggcctggaataatcaggctttttaaatgatgtaattcccactgtatagcatagggattttggagcagctgctggtggcttgggacatcagtggggcaaggttctttgttcctggtcactgtatttgcttccggtcttcctgtgatgcctcttgggtctttggtttggtggaggaggccattgccctaattacctgctagctt

SEQ ID NO: 3630 - DNA, 332 bp, Homo sapiens
acgatactgagcttcttcctatttgccatggctttcactgtataaataggagaggatgagagcccagaggtaacagaacagcttcaggttatcgaaataacaatgttagggaaactcttatctcagtcatgcataaatatgcagtgatatggcagagacaccagagcagatgcagagagccattttgtgaatggattggattatttaataacattaccttactgtggaggaggatgtaaaaaaaatgcctttgagacagttctttgcttttaatgtggttcttctgtggcttgtagatgtgagcatcctcttgaaatgtaattgtagttcag

SEQ ID NO: 3631 - DNA, 244 bp, Homo sapiens
ctcactgtcttaaatagaatttttaaatagtatatattcagtggcattttggagaacaaagtaaatttaacttcggccttctaaaattttttgtaaagactataggtttagacatctttctcattcaaatttaagatatctttctcccctggatcaatctatcaatattgatagaggccacactagtatatccctttatacatttacaccttcttatttagaggtattgatgcaaatattgaca

SEQ ID NO: 3632 - DNA, 373 bp, Homo sapiens
gattattacactcttgtgggaggcaacttaaacattatcagtaaaagaggtgctaccaaggtgcagtcaagttgctaatcatccgttatttcactataggaggctgaaatagctgcttccagctttcactttgctttgctgtcagtgtagtaacatttcagggataagtatttttatgtggctctaaaccttaactatacttaaatgaaaattgaaatactactgtgtaaatgacaggtatataatgtgcagtttttaatacatacattctgtgtataaggagatgggtgagtctactgcaggcacaattgaaatcctgagtttggtatatgggctcaccaaataatagggggaaacattttgaaggaacatg

SEQ ID NO: 3633 - DNA, 384 bp, Homo sapiens
ctcgtcaatttcggcagaaaaattcaagttcttgaatttgattctaagttgcatattataacagtctcgaaaattattttacttgcccaacaaatattacttttttcctttcaggataattttataaatcatttgacctacctaattgctaaatgaataacatatggtggactgttattaagagtgtttgttttaagtcattcaggaaaatctaaacttttttttccactaaggtatttactttaaggtagcttgaaatagcaatacaatttaaaattaaaactgattttgtatctatttgagtatatatggaggctgaaataatgtttattcttataaagggtaattaattgcccaggttccctggacagtcactgatattgt

SEQ ID NO: 3634 - DNA, 348 bp, Homo sapiens
tcgagttttttggtggttttaggaaacagaatgcatttaaaaatggactgaattgttttggtgctctttaaagatgagatgcattttcttttggcttgtgggaaaaccagcactgtcacttactccagagcagagattccatctgatttatggcattcaagatttacctggggagctttaaaaattataaatttccttggagtccattctcaaaccatttgatttcataggtttggtgtggagcccacaactgttttttgaaaaatgtcatgggtaatcatgatgtctagctagaatgggagcttgtcttgggggtgaattaactccctctatttgtgcacaggaagg

SEQ ID NO: 3635 - DNA, 314 bp, Homo sapiens
aaacaattcatgaaagtggacctttaaaagcttgtcagagttgcacaaatctaactggtattttgtttttgtttttaggaggagatgttaaagtaacccatcttgcaggacgacatttaagattggtcttctgttgatctaagatgattattttgtaaaagactttctagggtacaagacacattgttttccactgtatatagctgccaattagttttctttgttttacttgcctccgctatcgtgtatgactcatgtgattgttatacacatttatagtatcattcatgtaacctcaataatgctcctatgta

SEQ ID NO: 3636 - DNA, 386 bp, Homo sapiens
agaaggagcgcatctgcagaagggctccggcttccacctggacctgctgctcatcgtggccatgggcggcatctgtgccctctttggcctgccctggtttggctgctgccactgtccgctctgtcactcacgccaacgcgctcactgtcatgagccaaggctgtcgcacctgggggacaagcccaagattcagggagtcaaggagcagcgggtgacggggctgctggttgccctccttgtggcctctccatagttatcggggatctctccggcagatcccctggcgtctctttgaatttctgtacaagggagtcactccttaaggggtccagtttatgagcggctgatatttggtaagccgccaaaaccaccagattttattaagg

SEQ ID NO: 3637 - DNA, 354 bp, Homo sapiens
ccaaattgggcaagttcatgaaacctgggaaggtggtgcttgtcctggctggacgctactccggacgcaaagctgtcatcgtgaagagcattgatgatggcacctcagatcgccctacagccatgctctggtggctggaattagcccgctacccccgcaaagtgacactgccatgggcaaggaagagatcgccaagagatcaaagataaatcttttgtgaaagtgtatactacaatcactaatgccacaggtactctgtggatatcccttggacaaactgtcgtcaataaggtgtctcagagatcctgctcttaaacgaaaggcccgacggaggccaaggtcaagtttgaaggg

SEQ ID NO: 3638 - DNA, 335 bp, Homo sapiens
tggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacatgtgggctccaagcagatgcagcagatccccatgtcccttcgcgggaaggctgtggtgctgatggcaagaacaccatgatgcggaaggccatccgaggcacctgaaaacaccccgctttgagaatctctgcctatatccggggatgtggctttttttcaccaggaggccccattgatagga

SEQ ID NO: 3639 - DNA, 181 bp, Homo sapiens
caacttgcagataaggagcgggtgcagctgccctggagaacacccacctcttggaggttgtgaatcagtgcctgtcagcccgctcctgagcctggcctttgacccctcagcctgcatactggtatcctggtccagctcctgccagggctgttaccgattgttttcttgaatcactcacaat

SEQ ID NO: 3640 - DNA, 127 bp, Homo sapiens
ccaggccctgtcctcgtgtccctcacacccgtttgcgtccgttcatgtcatgtcaaaaaaaacattgtgttgaggccaccttgtgttccccagccatagtgcgtagggcccacccagcgtaaggtgt

SEQ ID NO: 3641 - DNA, 219 bp, Homo sapiens
ccctcagtgaatagtgactacatgaagggggcacttactagaggcctgagtaatggaatttcaattagcttctgcttcccttttctaaaaaagaaccacctatgcttaagaataattaggccaaaataaacttgagtaatttgtacagtcaatattttgaagtttcggagttaaccgtgaaatagcaagctgttctccaggaaaggacatccagggttc

SEQ ID NO: 3642 - DNA, 251 bp, Homo sapiens
ttgggtagaaattcctgcctcgttcaatgcggcaagtttttgtatataagataagtacggtcttcatgtttatagtccaaatttgcaaaccctacaactctcggtgtcataggtctattttaagggragagagagaaaaacacccttactatcttgggaggcaatattaacaaacagagcttttttcaaatagcaattgtacttttctacctgtacccttttacataaagtgtttaaatttcagaaggtct

SEQ ID NO: 3643 - DNA, 223 bp, Homo sapiens
caagattcagcgtcttgttactccacgtgtcctgcagcacaacacggcggcgtattgctctgaagaagcagcgtaccaagaaaaataaagaagaggctgcagaatatgctaaacttttggccaagagaatgaaggaggctaaggagaagcgcaggaacaaattgcgaagagacgcagactttcctctcttcgagcttctatcttctaagtctgaatccagtca

SEQ ID NO: 3644 - DNA, 204 bp, Homo sapiens
ctccctcccaccttcctcccacctcacctgtcgcacccactgtgaaagttggaatatgtggtctccctggcctcagggctctgactctgccagggtggggctctctaacccacaggtgttggctgccttgcccatgttcccactgtctctttcacttggtctgggtttggcaggcactcctcttacttgagggccaggattctc

SEQ ID NO: 3645 - DNA, 201 bp, Homo sapiens
aaacaaacaactgatggtcctttttgtttccttaattttattctttcttgattttcatagtatcgttttttactcagttctcttcatacttctgtatattccttttctttattctcttagagtccttggcttacaccctaaacactgacatatttccacctcaacccacttctctattgctcaattctcgagtgatctctc

SEQ ID NO: 3646 - DNA, 148 bp, Homo sapiens
caagaatcagctgaaggaattgccagaaaaaattgcccaaaactcttcaggagctgcgtgcccatgagaatgagatcaccaaagttgcgaaaagttactttcaatgggactgtaaccagatgattgtcatagaacttggcaccaatcc

SEQ ID NO: 3647 - DNA, 171 bp, Homo sapiens
cttgaccactatgctatcatcaagtttccgctgaccactgagtctgccatgaagaagatagaagacaacaacacacttgtgttcattgtggatgttaaagccaacaagcaccagattaaacaggctgttaaggagctgtattacatttatgtgtgccaaggtcaacaccct

SEQ ID NO: 3648 - DNA, 275 bp, Homo sapiens
ccccaatttacagggtgactcacagccacattggtgactcacttcaatgtgtcatttccggctgctgtgtgtgagcagtggacacgtgaggggggggtgggtgagagagacaggcagctcggattcaactaccttatataatatttctgaaaacctaccagccagagggtagggcacaaagatggatgtaatgcactttgggaggccaaggcgggaggattgctttagcccaggagttcaagaccagcctggcaacataccagaccccgtctctt

SEQ ID NO: 3649 - DNA, 320 bp, Homo sapiens
gtcagccagcagttgaaacaagggctctctgctatctcacatctgaattgaattgtttcctacagacttctcatagctctctaggcaaggaatacatcttctcaccttcccacactaagaaaggcctctgtctgagcctgggtgccgggtggccaggattcctgctgaacgttcaggagctttccatctccagaggtgagctcctagttcctgcttaccttagaacttgtagacatataatgttacactgaaagaacctctcgtatagttggatcacacccttaccatatttatttaaatgtactgctttaatatgtaca

SEQ ID NO: 3650 - DNA, 255 bp, Homo sapiens
ggcacgcggcctgctttggcctgcagcccggctgctgcggcagatggggagccgccagatcgccatcgcgggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggcccacgtggagcgggactttttggaggcgccttgcagattctg

SEQ ID NO: 3651 - DNA, 315 bp, Homo sapiens
gcacgagagaacagccacagcagatgacaaaaaacttcagttctccttaaagaagttagggggtaaacaatatctctggtattgaagaggtgaatatgtttacaaaccaagggaccagtgatccactttaacaaccctaaagttcaggcatctctggcagcgaacactttcaccattacaggccatgctgagacaaagcagctgacagaaatgctacccagcatcttaaaccagcttggggcggatagtcttactagtttaaggagactcgccgaagctctcccaacaatctgtggatggaaagcaccacttgct

SEQ ID NO: 3652 - DNA, 345 bp, Homo sapiens
aagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctccgcagggccaagttcaagtttcctggccgccagaagatccacatctcaaagaggtggggcttcaccaagttcaattgctgatgattttgaggacatggtggctgaaagcggctcatcccagatggctgtgggt

SEQ ID NO: 3653 - DNA, 340 bp, Homo sapiens
ggggcctccaggagaggtgggaccccgaggacccagggcttcctggcagtagaggagaattaggaccagtgggatccccaggcctaccaggtaaactgggttctctgggtagccctggcctccctggcttgctgggccccctggacttcctggaattgaaaggtgacaggggtgtagtcggtgaaccgggtccaaagggtgaacagggtgcctcttgtgaagaaggtgaagcaggagaaagggggaacttggagatataggtttacctgcccaaaggatcttcaggtatcctggggcacctggcttgagagccttaggaagtggggcctcctggagtgga

SEQ ID NO: 3654 - DNA, 307 bp, Homo sapiens
cccaagctatctaaagtttgttagatagctgcatgtggctttttttaaaaaagcaacagaaacctattcctcactgccctccccaggtctctcttaaaggtgggattttaccaggttaatttactcagcaggaattggtgatcactccaggtaggtttgggggcaaaaattccgagggtgctttggggagttttgaatgttagaattgaccatctgctttttattaaatttgttgacaaatttcctcattttcttttcactcgggctggttaacacagtcaaatattctaatcctcgtattttaagg

SEQ ID NO: 3655 - DNA, 303 bp, Homo sapiens
aattgtctgaacagtagaacgatacaatcctgaaaataatacctggactttaattgcacccatgaatgtggctaggcgaggagctggagtggctgttcttaatggaaaactgtttgtatgtggtggctttgatgggtctcatgccatcagttgtgtggaaatgtatgatccaactagaaatgaatggagatgatgggaaatatgacttcaccaggagcaatgctgggattgcactgtagggacacatttatgcagtgggaggattcgatggcaataatttctgatacggtggaggttttacct

SEQ ID NO: 3656 - DNA, 305 bp, Homo sapiens
gcttcggggcggacgtgttgagtcccttgccgcatgtattggactccaagggggccactcagagcctgttgctgagacacttctgttctcgcgggtgtacagcaagtactcagtgactgtgtggtggggggagctggggcccgggcattaatagatgatccacagagctgtcattctaagtctcagtcagagccataggggttccagcagagattggtcactgaggtcagggttcctccaccacaggaggggccttgacaaatgtggaccacttcttgattgggaccactaacttttattgggac

SEQ ID NO: 3657 - DNA, 310 bp, Homo sapiens
ctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagttattatcctactgaagatgtgcctcgaaagctgttgagccacggcaaaaaacccttcagtc

SEQ ID NO: 3658 - DNA, 245 bp, Homo sapiens
aatataaccagtgacttcaactttggcatttcattcatacttctgtagagaacggaaaactattgtccattaacatgatatgctaaacattctataaacattctggtatttatgtgagacttgcccatctactgtctggctgtgtctgccttttaatcatgaacagttacatgatttataatttcactgattgagattactttgtaaggagctgttcagaggaataaaatatgacctgtttgggg

SEQ ID NO: 3659 - DNA, 280 bp, Homo sapiens
cggcacgagccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcggtaggatgggtgagtaaaatgattcccttctccgattggccaaggccgatggcatcgtttcaaggaacttttgatggagag

SEQ ID NO: 3660 - DNA, 345 bp, Homo sapiens
tcgatgccggaaaaacaccttggcccgccggaaggcaggcacatgggcataggtaagcggaagggtacagccaatgcccgaatgccagagaaggtcacatggatgaggagaatgaggattttgcgccggctgctcagaagataccgtgaatctaagaaggtcggtcgccacatgtatcacagcctgtacctgaagggtaagggggatgtgttcaaaacaagcggatttctcatggacacaccacagctgaggcagacaggcccgcaagagctctggctcacagctgagcccgcagtctaacacaaggagcacgagcccgtgagacccctcagccaagaggagaga

SEQ ID NO: 3661 - DNA, 120 bp, Homo sapiens
ccagtcttgctgagccacccgctctctctgggtccatcccatccctgagccaggggagggcagcatttcatgggcatgtctatcagaggtgggccttgccagcctctcccccaggggttg

SEQ ID NO: 3662 - DNA, 198 bp, Homo sapiens
ggctcacgctgtcatccaacacttggggaggccaaggttggttgatcacttaggttaggagttaagaccaggcttggcaacattggtaaaccccgtctctatcttaaaatatcaaaaatatgcttggggttggtaatttgtcctttaattccggcgttctttggggggtatgggaggagagtttttttaaccacgagg

SEQ ID NO: 3663 - DNA, 138 bp, Homo sapiens
gttcgtaccaagaccctggtgaaggattgcatcgtgctcatcgacaggcacacctaccaccagtggtacggtgccatcatgcgttgccctggggccgacaggagggagccagagtcgtctcctcgcggaggagggata

SEQ ID NO: 3664 - DNA, 289 bp, Homo sapiens
gactatatcagtttttggaaagcagggttcctctgcctgctaacaggcccacgtggaccagtctgattgtctttccttacacacctatgttttttaggtagtcaacacttacagggagcacatctctaacacaggttctctgtgtcacatatgtgtttggtgacctcgatattgtgatattagagtagggccttctatattcgccatatcaccgtcgtttgtgtcacctcctgactcctcccttctgcgggatactagtggatgtattagtgatgattagtggtgataa

SEQ ID NO: 3665 - DNA, 235 bp, Homo sapiens
ctccagggaccaagtgttgagatttcaaggccggggtgagaccaaaggtacggttatgtcacagtcctaatgtgtggccttctctgattggtacatctccaacccaagagagtgtacacatacaaggcacccgaggacatgtcgcggggagacgcgagatcgtcgcactagagggctctgtgggccctctgtgggcgccctgttagagtgttacactacggggggccactacttc

SEQ ID NO: 3666 - DNA, 272 bp, Homo sapiens
ccatgctgcaggtatgaatcagcacttaggggctcatcttcattctggagttatttatgtggactctggatattacacaatttttggagtatagctcacagcgcaaaatatatgtgtcgtctctgggtgtgtgtgtgtgttatatccccatctctgtacatagtaccacagccacatgtgtgttctctctagcaccatcatcatcatgagcgcgatggtggctgctatatgtctcatatgagataagggtatattattatacactatgaatg

SEQ ID NO: 3667 - DNA, 170 bp, Homo sapiens
gatgatgccagttaattactttgaaatgctcctcaaccaggcaagggcaagactcatgcatcataggtggcacacaccacttctaaggacacagactctcagagcctttgcgtctcgcgggatgtgcgacacctatggtgtctctaacatttccaccttctctcacaagg

SEQ ID NO: 3668 - DNA, 155 bp, Homo sapiens
cacgttcttaggcttttgttactgataccctaaatcggaaagtttaggtcctgagaaagcaaggtcagcgtcctgaaattgctgactctgtgagagtatatcacactctctgcgcctcagatgtctccacatgaaatataatatctctcctctga

SEQ ID NO: 3669 - DNA, 173 bp, Homo sapiens
cagtatccttggggtgttgctgaagttgaaaatggtgaacattgtgattttacatcctaagaatatgttgataaggacacacatgcagggacttgaaagagaggttactaataatggtccaatatgaggactacagagagcagagaaactctgcacagtgtgaacttatatat

SEQ ID NO: 3670 - DNA, 301 bp, Homo sapiens
attatattctagataacacagctaagaaatggcccacatgttcattgaggctaactttctcactccaaagctatgaaggtctgaattagattgcctcaacctgaaaaggtcaaattgatcattgtttagtcataatgactctctatatgaactctgtggatttcaatttttaaaggtgtcttaaaattgaaatgtcctggtctaatttgctagcaattcattgtattggagtgcaaaatgtttgccatgagaagtatatggtagtgatttgccccctctccttatgatatgcccgcggtct

SEQ ID NO: 3671 - DNA, 285 bp, Homo sapiens
ccttgcctaacgcagccatggctcgtggtcccaagaagcatcttaagcgggtcgcagctccaaagcattggatgctgggataaaattgaacccgtgtgttttgctcctccgtaccatccaccggtccccaaaagttggaggagagtgttttccccctcaatcaattttcctgaagggaacagactttaagtatgcccctcaccaaggagatggaagtaaaagaaggattttgcatgccagcgggttcattaaaaatcgatggcaagggtccgaacctcgatataa

SEQ ID NO: 3672 - DNA, 222 bp, Homo sapiens
tcgtgacctgacctcgaggtggacaccaccctcaagagcctgagcagcagatcgagaacatccggagcccagagggaggccggcaaggaacccccgcccgcaccttccggttgaccttaaggatgttccacttttacttgaggagtggggagtacttgatttaccccaaccaagggcttcaaacctggatgccatcaaagtcttcttcaacatgaagattgg

SEQ ID NO: 3673 - DNA, 205 bp, Homo sapiens
ggttcttaaaggggcaaattacttagataataaagcagagggaaatattagattcggtatatcgttcttcaagacaacttgcctcttaagcgggatgtgaaatttttgggcaagacttttcttttaatttttggaacacagaatgttggcacgctttgcccctactaatagaatttgcctccctccggaattttggcggcacaaa

SEQ ID NO: 3674 - DNA, 244 bp, Homo sapiens
cctaaatcttaagaactttaattgacagtttcaattgaaggtgctgtttatagacttacacccagtgaaaggccaggccattaatgacaaattccttggaatgttcctcttaaggaaaataattgcttggtcaattcgaaggcttaaggcattttccggtttttttgaatggcttgggctccccctgcctgaatctaaaggtttcccggctttttcctccctaagggcccttttataccccttt

SEQ ID NO: 3675 - DNA, 341 bp, Homo sapiens
tcaggactccgaggaccaaagggccagcaaggtgaaccgggtccaaagggacagatggcctcgggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttacaccaggacgtgatgtctcaccaggccagaggggcctcccgggaaaggatggatcctcgggacctccaggcacaccaggcccaataggcattcctggcaccctggagtccaagggatcacagg

SEQ ID NO: 3676 - DNA, 260 bp, Homo sapiens
ctaatactaacatctcagacgctcaggaaatagaaaccgtctgaactatcctgccgccatcatctagtcctcaatcggccctcccatccctacggatcctttacataccagacgggggtcaccggtccctccctttaccattcaaatacaatttggcaccaatttggacttaacctacgggtacaccgactacggcgggctatttctctatctcctacatatctttccccattatttcaagagccaggggagccgtcgag

SEQ ID NO: 3677 - DNA, 265 bp, Homo sapiens
ctgaactgtaaatcttcaggaatatgtattaagattgtggaatgggtgtaagacaattggtagggggtgaaagtgggtttgattaaatggatcttttattggccctatgatctatcctttaacttgaaagcttttgaaaagtggaaaagggcaattttgttgcatttccccatttcttgtttttaaaagacccacaaatctcaagccccataaatggctcgtattgaactcttacatattgaattaaagtggttaaacacaaagg

SEQ ID NO: 3678 - DNA, 345 bp, Homo sapiens
atcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttttacagtgtgcaagaaaaatacttaacaaaatcgaatcaggtgagctggaccccgaaagaatgggctcaggtattcagtacggagatgctgccttaagacagctgaggtcaccccggcgcgcacaggcccccaacgctcaggagtgtggttgttaggagagcacacaggtgttcatacagtaggcattttgggcacaatcgttg

SEQ ID NO: 3679 - DNA, 195 bp, Homo sapiens
cttggtgccgaagttcggcacgaggttattggcctgagcacagctgaaatctagcagaggtaactcttctggctccatagtctgttcacttgataattcagggttctactgtttggcgttcagaaccaatgagcagaaggaatcgatttattagcttaattatttacatacaatgggtgaaaactccaacagaag

SEQ ID NO: 3680 - DNA, 380 bp, Homo sapiens
ggaagcacgctcacaaaggtaaagactttttctgtggcttaatccttgtcatgttttcggctcatggacacaaggacacatttttcattgccttctctcacagggcttcttgcggcttcccgggttcactttcttgttgttcttttacactccctttcacaagaggacactttgcttccccccttcttcttcgtttctttggcatccccctagggaaccttgcacacaccagggtctctcgagcttcttggaccctgccttcttaccatgcccgctctttaaggcaggtcaggaggtcgcttgcctgggttcgaggtcctagttaaaataccttagtggcttgagacccttgggggtagggtaaactttttcaagccaag

SEQ ID NO: 3681 - DNA, 319 bp, Homo sapiens
gccatgtcaaccacccttgcactgtggaggaggagatgtctgtgcccttgaaagaactgattgagaagcatgctggggtgttcacgggcgggcttggggacaaacctcctttgcttgttgattccctgggcgggcttcgtcttaccccaacttgattccccaaaggtctggtgttgttgagacgggtgctgattgggacttcgattgcgctggtgcaggcacagacaagggccttgggcacaagcttgcgggtgattcggtcatgggaccgctcggacgggacaatcgtgaaaagccaatcgccccgcctcatttaagt

SEQ ID NO: 3682 - DNA, 269 bp, Homo sapiens
aaataatacattgaccactttccttcatttcttggggaaggaaaggagacttagagcagctggtgtgctcaccccttcctagtcaccttccatttaaccacaagactatgtagcgcttggcccctagcctctttgcaggagccttgttttcctaggcccgaactgtttggattacagacttggagggggtcaggaaactgttttacctttctttttccccctttggcatttaattaaaatttaagttaaattccttttttccacttcaw

SEQ ID NO: 3683 - DNA, 199 bp, Homo sapiens
cgtttcctaaatgtatgcttgtggacctgttttcaaatatatgttactgaccaattatttactatcctacatttttaatcataccagttttaggctaatgctaccaattacagttcagtctctccgtgggcaatttttttttaccctgaaaaccccccaataagtaggcaagttttaacccttttccaatgggcccaat

SEQ ID NO: 3684 - DNA, 90 bp, Homo sapiens
cggcacgagctcgtgcgaattcggcacgaggctgggcacagttacctgcttgctgttctcagatgcctcttctgttgacttccatctcat

SEQ ID NO: 3685 - DNA, 200 bp, Homo sapiens
gagcccagggtctaccatgcaagcagaggaccaggctttctgcaccgcagtttgtttaaacttggacctgtaattggtaagctatttatgggccctggcacttttgttccacacccaacacttccagcatttagctggccaaatggcggagagttttaatttttaacttatttgacaccggaaggtaattccgccgaatg

SEQ ID NO: 3686 - DNA, 209 bp, Homo sapiens
catcaacattcacaagcgcatccatggagtgggcttcaagaagcgtgcactcgggcactcaagaggattcggaaaatttgccatgaaggagattgggacctcccagattgtcgcattgacacccaggctcaccaaagcttgcttggccaaagggataagggatttgccactccgcaatccctgtttccgcgctttcccaggaacgtaat

SEQ ID NO: 3687 - DNA, 359 bp, Homo sapiens
ctttgatgtttttttgtcattgttctcaagtgcaatatgacaatgtcacactctagatatttcaaaggtgtcattaattttaggaaggcctaatttaaaccaattatttggtattatttttggtttgggcagggaaggggtgattaaggtaggggttatttacccccctaaatgggcccattctgcatttgtatcaggggctgggaagtgatttattctcaccacagttgtgacacactttgaaattctcctgagggtcactgaggatgctgtagtaggttatcaaaattattcgctacctaatcacatagaaggtaatatcttggtggccaccacagtgggtagcaagaatgatctgt

SEQ ID NO: 3688 - DNA, 280 bp, Homo sapiens
gccatgagtatgctcaggcttcagaagaggctcgcctctagtgtctcgctgtcgcaagagaaggtcttggttagaccccaattaggaccaattgaaattcgccaatgccaacctccgtcagcagatccggaaggctcatcaaaggatgggcctgatcatccgacaagccttgtacggtccattcccgggcctcgatcgccggaacaacacttggccccgccgaaaggcaggcacatggcataggtaagccggaggctaccagctactgccagtattgcca

SEQ ID NO: 3689 - DNA, 276 bp, Homo sapiens
catctaagccagagagagacagggcagctgggggccgggctctcagcagtgagatggcagccccttcctgcttgccacaaccacggtaagttctcaagtcccaacctcgggggattgttttcaagcaagggcttgtttgacccacaagcttgggccctgttccctctttggacctcggcttctaatcttgtcaaatagctttggccaacttgaacggacctaacgtccagagaccgagtcctttataggacagtctccgctctgccttcacaacgt

SEQ ID NO: 3690 - DNA, 209 bp, Homo sapiens
attttgcgagtactcaacaccaacatcgatgggcggcggaaatagcttgcatcactgcattaagggtgttggccgaagatattcttatgtggtgttgaggaaagaagcaattgacctaaccaagaggccgggagaccttacttaggatgaggttggacggttgatcaccattattcagatccagcagtcaaggtcccagcttggtcttg

SEQ ID NO: 3691 - DNA, 258 bp, Homo sapiens
gcggtggggcggacagccgggggtgcgcactttgggcccccctggccatggcggcgaaggtggactgagcaaccttccaaccgacttggaaggaaggcgaaaattcctttcctgaagggccttagttacaaagcagcgggaaggacattacttctgcaaggactttgtcaagcttgaggaggttcccgcaattgaaggagattggcgaaagggttgctctgtaagggttgagaggaccaggtatataaaagggcacag

SEQ ID NO: 3692 - DNA, 182 bp, Homo sapiens
ctccgctggtgatcaaggaggatgagcttcgagagtccattgaaattataacagacatctgtctttctgagggtagccagcctgttttcagttggtccctgggagccagctggagacaggtggtcctgtaaaagctttattcctaatgtgggccaatccactccaatgagtcttcaaaaact

SEQ ID NO: 3693 - DNA, 216 bp, Homo sapiens
ccaaggcgtgcccggcaccagcaaggacggccaggacggtgctccggcgagcctgggcctccggagattctgggcttccaggtgccatttggggccaggggacaaccggggatctgcgacacctcagcctgccaaggagccgtgttaggaggggtcggggagaaatcaggctcttggagcttcataaaattcaacgttgaggaagcaagttacaag

SEQ ID NO: 3694 - DNA, 237 bp, Homo sapiens
gcagcatcccatagcaccccgcccttgccccatcaccctgtgggctacatgcaggacacggcatgggccttgcttcccagaggcacctgttttggggtcttcttgagggcttgtgctttcacagctctctttgaagcagatgcttggtgacttggtaggctcttttatacctttgtcacaaggaagctttgtaaaaccagcagtgaaggaaatgttgccactgtctaacctaggcat

SEQ ID NO: 3695 - DNA, 174 bp, Homo sapiens
cagcagcacaatttatccttttctgttaaagggaaggcttcttttcagacttatataaggttttgaattttgggaaaatatattttttcttggggggtttgggggttccctggtttgtctctggtagagtacacaccctttttcttagagatttagtgatatagtgagatactc

SEQ ID NO: 3696 - DNA, 237 bp, Homo sapiens
gcaaagctgcttcaggacggttcgccaggaccttagcagatgtcgtccagtatcgaaggaagagaagcagacccaacttctttgccgaccatgtatcaactgcgtatattaaaagggtatttcccctgggatcgtgtccccatatacagaggtccctctccggatatccccttaactcctagggggtccccccattagacggaggggtactaacacacttggagactattttatgtg

SEQ ID NO: 3697 - DNA, 259 bp, Homo sapiens
ggagttcttagctaaaatattcttggagttattttattcaaacggctaatgtatattcttcacctagactttctacaaagtatactctggtaaagatctctctttgtgtaacacacacagtatcccatccgggtattttaaaatatttataaccaaaattttttggggagatcttgggaaacataatcctggggactacatctctaggaaaagtcccccaacccctgggaggtctatctggatggtgtccccataatgc

SEQ ID NO: 3698 - DNA, 186 bp, Homo sapiens
ccaattcttccagttgtttgccccaaggcggcttgttcaagcttcttcccaaaacctttatttgtggccttctagtctttggaggcctctaaatgtagaaattggggcccacaaagcttggccagagaccacaacgaggagagtgggttttgagcaatgtgggttttatatttctgggagggccct

SEQ ID NO: 3699 - DNA, 202 bp, Homo sapiens
acacttcagttgaaggaaacacaaagaggattgttaaaggctattatcaggaatcgattggagacaggctcacagaccctatttacaaaacaaccgcctcacattcaacacagggagagtatccccccccatccccatctctgtgtcccctccctccctacagggcgcgtgtgtaccccacctcccccagagcttcgcgggc

SEQ ID NO: 3700 - DNA, 169 bp, Homo sapiens
tatatattcattcatgcattccttagcttattcactgagctttttacaaacattttcaaggtccatatctctcccaacacatataagtgtaagcgcattggggctttcacaagagatatataatcacagtgtcccttctcttggggggggcgctatctatatgtctccc

SEQ ID NO: 3701 - DNA, 199 bp, Homo sapiens
caacattgggagcctaatcttcaatgtaggggccggtagaccttctccagagcatggtctcacaacagagaagtccttggaatcctatgtaatgtgtgtctcatagtgtgagagagagagaagtggggacgaaagagaagagagagatcctgagagagtctttatatatataaatgtggctttgtgtcttttgtgatta

SEQ ID NO: 3702 - DNA, 257 bp, Homo sapiens
cgccctttcagttctgcttgctgtccgcaccgctgcgttaaccggaaccggcgggcgaacagcatgacgtgtccgttttgagagacttcatcacaccccgactctgtgcccgttatatacacacagatatgggggagaagtatatgtgtgagacacactagaagaggtttttagccacagacccattaaattgtagatttttgggatagagagctatagcgcgtgtatatgattctctacaacagggggtagaagaa

SEQ ID NO: 3703 - DNA, 222 bp, Homo sapiens
actgtgagtcaagaattggcacgagccttttcctctttacacgaggctctcttcttgctcgagcccagctgagtccttgttcctctcctttaaggtggacaattctggcactttggaggtcaaggccaaggaaattaaggccgagatttagaaaaccaggctgagggctgcccctgagagagctcagacccctaaaccctctccctgttggtacacgagagg

SEQ ID NO: 3704 - DNA, 103 bp, Homo sapiens
ccagaatcccattttccaacttagttccaaagaacctttcccagtggatttgacacatttgagctagtctatgggagggtatattttaattaggaggaaaccc

SEQ ID NO: 3705 - DNA, 214 bp, Homo sapiens
ggagtgtgggcgagctccccagcaccgtggaatcactccagaaggtgcaggagcaggtgcacacgctgctcagttaaggaccaggcccaggccgcccgtttgcctcctaaggatttcctggaaagaacttttttttttggaaaacctaaaagcctaattaagccaagtggaggcggacttgaaaatgctcaggactcttgtggacagtttggtt

SEQ ID NO: 3706 - DNA, 122 bp, Homo sapiens
cggcacgagtcacagctgtttttagtagaagttaggttcttaaaatgtgcccatcgatggtcacttaaacatgttgccaggtaataggcacctccccagggcttcaaggcattgaaaagggc

SEQ ID NO: 3707 - DNA, 218 bp, Homo sapiens
cccagtgcgagcacccttgtttgggagggtggcagaggtcctgccaggcccacagtctgttcccctccagtcaaccttctttttgggcaagcagcacccaaggtttccatcccatagggaggtgttctttttgggaggggattttagccccccttgccccagggcacaagcccacaatcaaaagcttgttctcaagcaagggggccagagcgaggtgg

SEQ ID NO: 3708 - DNA, 230 bp, Homo sapiens
gaagtagacagtggctggtatggctcttaggctccctggggcctgctcagctcctcctgctccttgcctgttttcttgatgattttggggctttggaggtcccctttgtcctcatcttagacttaaatgtggggatccaggatggccctccctcccttttacccttccctccttaagcctgcaacctttatcctgggaacctgtcctccctttttcccaactattcatct

SEQ ID NO: 3709 - DNA, 237 bp, Homo sapiens
cagaggcggcggcaaccccagccacagagagacagtggcacctacgagcagccggcccctgatccatgaccgagactcttgtggggctcccagccccctctgcctcccgggcctacccccccgggccacttattgacttaacccaaggaacaagcacaatcccctggacaattattgactttgcctccaggtacgggcatcccccattaacctccaatttggacggcaggacccgtt

SEQ ID NO: 3710 - DNA, 296 bp, Homo sapiens
cccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggagattctgatgagcattactattcactgatgcagaaagacggtcttttgcataaaagactttttttaacactttggacttctctgaaatatttagaggtgctaatttctggc

SEQ ID NO: 3711 - DNA, 224 bp, Homo sapiens
ggaaggcccctccccgtcgccagccgggccctcatgctgaccttgcaaattcagccgctgctttgagcccaaaatgggaatattgggttttgtgtccgaggcttgttccaagtttgtcaatgaggtttatggggcctccagaacagaatgccatcttcctgaaatgttggacatgccagtgggtgtgactccttcatttttccttctcccttcccttgggacaa

SEQ ID NO: 3712 - DNA, 152 bp, Homo sapiens
gacaatcccaccttttcaacggggcttcaccaccaaatacggccgccaccaccgaaatgacgaggttctccggggaaaagtaccgccccagcgagggttcagaactatcactttggaaggaggtcaaccctttaaagaaccgtacaaggcct

SEQ ID NO: 3713 - DNA, 302 bp, Homo sapiens
gtcagacggatgggtgactagacccatggagaggaactcttctgcactctgagctggccagcccctcggggctgcagagcagtgagcctacatctgccactcagccgaggggaccctgctcacagccttctacatggtggctactgctcttggagtggacatgaccagacaccgcaccccttggatcttgctgagggctcaagacagaggcccagccaccccaggggctccacaggcgctgtcatgcaaaccaatacagtatctagtgtctgtgtgagcacaagagtatagtataggtgtgt

SEQ ID NO: 3714 - DNA, 310 bp, Homo sapiens
aaaaaagcaagagagaacactgtagagtttaaacacggtttctttatctggtgcccgcatggggagatgaaggtaaagaggccaatttatccagcaaatgtgcccaagcaagtcgggaataattacctcccttgacatcttacaaacttgtctgcatcccacaaaaattctatagggcagtgcctctcacgtcatattcagagagaccaccatagtcaagtgagcgtcattattattactatatcgctcgtcgtcgcagtactgcacgagtgtactctggagagtctacatatatatcgcggtctactat

SEQ ID NO: 3715 - DNA, 311 bp, Homo sapiens
gccgcagaagcgagatgacgaagggaacgtcatcgtttggaaagcgtcgcaataagacgcacacgttgtgccgccgcttgtggctcttaaggcctaccaccttcagaaggtcgacctgttggcaaatgttggctacccttccaagcgcaaagagaaagtatatacttgaggtgccaaggcttaaagacgcgaatacacacgcgactgtgtcggatgtagggcacatctaaattgtatatcacgagagttcacagcatatgagtctctgtaggacacacatctaacccagagagcagcatgctgtcagcagt

SEQ ID NO: 3716 - DNA, 330 bp, Homo sapiens
gtactttccaatctcagtcactctaggactctgcactgaatggctgacctgacctgatgtccattcattccaaccctctcacaggttcggacttttctctccctctcttttcttaagagagacctgagactgggcaggacttcaaataaaatctctggtgttctatattaattaattgggccttccctgtaaggaccttcggggtcaaggcaggagacaggactctactctgggtgtagagatcatgtgccctgtagagtacatctcccagcccagagcacaagagactctcttagaggtcgccggcagcagcatctgtgtgtgtcctac

SEQ ID NO: 3717 - DNA, 322 bp, Homo sapiens
gtctttcgggggctccgtaactttctatccgtccgcgtcagccttgccaccctcatcttcaatatgcctgggtctgacccccagttgcacttaacgttggattcttaaggcggtcttccaggaaagcagtgtggccgccgggcggcggatatcactctttccgcaagaggaaatatgcagctgttggacacagagtgtcacagcgcacacactctcgcacaggacaccgggggatatgtcgctgattatacacaagagtatacatctggtctcacagttgcgtcctgtcacagtatagatgatgagtcttctgcacatcgct

SEQ ID NO: 3718 - DNA, 379 bp, Homo sapiens
ttccactgttaaaataaagcttacatagttttcttcctttgaaagactgtgctgtcctttaacataggtttttaaaggctaggatatttaatgtgaaacatccgttttcattgttcacttctcaacccaaaattatgtgtttgccacaacccaaaccaggttcatgaatatatgggtctatatatagatagacacatactctgagcgctaattgtttatactctgtataatatattcacagggttaaacacactactcacacactgtgtcgtcttcgactacaagcgcaacaaccttaagagcgcgatcatatcatgagtactctacatgctgcatcctggctagaacgcagctctgtgtatacagtatcagtatatca

SEQ ID NO: 3719 - DNA, 334 bp, Homo sapiens
aaataacaattttcaaaaatacatttttgtagtaaaaacgcaccatcggtgttacattacttgtataaatcaaatttgcttgaaggtttattaaacatttttattgtttactttaaactttggacattattcaggtctatcttgcttgtctgacgacattggctctcaatatataaatatcaccgttttcctgcttcaaggctcacattctcacagaggtaaacgcgtatatgtaggggatatactctagtcacatgaggttgtttgtaggaaccccttatcacatatggagagatcactgatattcttcatcggcctaggatcagtcgcctag

SEQ ID NO: 3720 - DNA, 349 bp, Homo sapiens
ctaaatctcaagcttggacccacgggttattttttttttccaaagcagtaatcactgttctcagcatttcttttaggatcgtgatttaccaggccatacccttcaaaggtcctcataagtgtataaagtaggatattagtattggaggcagcatgaaattgtgaggaaggtataagcaggatgctagaagattcttatagagtaggaaaatatactctacctactctaatatagtgtaacaccacagatcataggtgtgtcactctcctctaaagatgtgatgatactctatctataggtttacaacccaatatatacatggtcacacacactggaaaaaaaaaaaaaa

SEQ ID NO: 3721 - DNA, 283 bp, Homo sapiens
ctcgtgtgtgtatgtgtgcgtgtgtgtatgtgtgcatatgtgtgtgtgtgtgtgtgtgtgcacgtcgcgcctggagggggggcatgagttttgccagaatgtgagtgtgagagtaataatgcaggggtgagtgtgagagggactgcgtttgcattttataatcaaaagcttaatatatcccatctttttgagttaaccctttctggactctgagccgtgcaatcactccactgatttctctattctccggggagaacaataaatgtgattacgtgagcagtga

SEQ ID NO: 3722 - DNA, 368 bp, Homo sapiens
tgctcatcgacagcacaccgtaccgacagtggtacgagtccactatgcgctgccctgggccgcaagaagggagccaagctgacttctgaggaagaagagattttaaacaaaaaacgatctaaaaaaattcagaagaaatatgatgaaaggaaaaagaatgccaaaatcagcagtctcctggaggagcagttcagcagggcaagcttcttgcgtgcatcgcttcaaggccgggacagtttggccaggcagatggctatttcctatagggcaaagagttgagtctatcttgggaaatcaaggcccggaaaggcaaataaatcctttgtttgtctcaccatgtaataaaggggttattgttttgttccaca

SEQ ID NO: 3723 - DNA, 196 bp, Homo sapiens
cggcacgagaagttccagtagttagggcattcatttaatgtgcataggcactttctgtttatttaagagtcaattgctttctaatgctctatgggccgactatcaaggatattagtaagaaaggatcatgttttgaagcagcaggtccaggtcactttgtatatagaattttgctgtattcaataaatctgttttg

SEQ ID NO: 3724 - DNA, 209 bp, Homo sapiens
gggagttggtgctttcttttcctttttttttttttcccaggggagggaggagagaaggaaggggataagactttcccaaagggggaaagccgttaggttttaagagggccaaaaccaggccccgcaaaagtttttacctttcataaggtggtattggggtttggggaaaagccctcaacatcgtcctactttagaatcttcaaggggaa

SEQ ID NO: 3725 - DNA, 360 bp, Homo sapiens
tgccttcatgcgcctgctggccaactatgcctctcagacatcacctaccactgcaaggacagcattgcatacatggatgaggagactggcaacctgaaaaaggctgtcattctacagggctctaatgatgttgaacttgttgctgagggcaacagcaggttcacttacactgttcttgtagatggctgctctaaaaggacaaatgatggggaagacattcattgatacaaacaattagccatcacgcttgcccttccttgatatgcaccttgggacatcggtgtgctgcacaggattcttgtggacatggccagtctgttcaaataaatgactcatctaattaagaaggaaggaatttga

SEQ ID NO: 3726 - DNA, 193 bp, Homo sapiens
atgtaaacagatagagattatattgtagtgatgtatttattaagtatatttgggttaattttaccacctgaggcttattgttgaaccttattttcaaccaacctgtcagttaaatttgtatacgtattcacatactgaggatgaccgtaagtggccttaattttgggttcctcaatagcctgaattcctggca

SEQ ID NO: 3727 - DNA, 194 bp, Homo sapiens
tcatcaggcatgacaagtttctcatatatgatgtaactgctttaggcagtttaatgtgcttttaagcttaattttgtcatgcaactattttttcgactttgggaagtcagagtctttcaaatccaaccgttatttacctggagtcattgataagctgcattgcattggtcaggcttagcacacattttcgactc

SEQ ID NO: 3728 - DNA, 138 bp, Homo sapiens
gtaagacatttgtgattacatttcacattagatcactttcatataagaactagcagctgtagatgcatttaatattcatatgatcctcagcatcagctgttttgcagtttttagtaccggtaagaacctgcacctgga

SEQ ID NO: 3729 - DNA, 149 bp, Homo sapiens
agagtttgtgacatttatcactccttgaaagattaagacaccaaagaagttgggtgagtggaagcagaggaagtagtctttaaggctatgtattctgaatggctagtctgaagcataacctacattttggtaacggtcctaaggtaaag

SEQ ID NO: 3730 - DNA, 151 bp, Homo sapiens
tctctttgttatgtgtgtcatgacaacagatattcttctgatccgggagctgatccagtagaaaacatttaatcactctatatactttggatgaccaaacttttttttataggaagggattactgctaggattgctataatgaaaccttca

SEQ ID NO: 3731 - DNA, 154 bp, Homo sapiens
atttgatggtcccaaagtacggcagctgcaaaaagtagtggaaggagattgtctacgtgtcttggagaaaattagttaggaattttggatgggtaaaaggtacccttgccttactccatcttattttttttagccccctttgagtgttttaact

SEQ ID NO: 3732 - DNA, 182 bp, Homo sapiens
ctcggccccacgtccttagaggccagagcacatctgataactgcaatcacagccgtccgctggaaaaacgttttcgaagcacagtggccagcgagcgagcacgtggctactccctgttgcatgtcaaatccacacagatgtcagcggcagctgcttcgggcagacccagccctcgggctcgg

SEQ ID NO: 3733 - DNA, 195 bp, Homo sapiens
cggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgttgggatctcgcactctggtgtctccatatagag

SEQ ID NO: 3734 - DNA, 206 bp, Homo sapiens
acctgtttcaaagagtcagccggtaactcctgaaaacatcgagctagacaagacaggcatggcttttgggaggaggacaagaatttggagatctggcgtgaggcaatatggaacagggaaactggtctaacataactgttgcatactaaattcaccaacccgacacaggtgtcatgttaacggcacacatgggggcccatgaggac

SEQ ID NO: 3735 - DNA, 204 bp, Homo sapiens
gcaattggtcaggatttagacaatcaccttaactttagtctcagcagcatcatcagaatgggataaaggcccctgtgtttggtctccaaaatatacccttaaggaccactttttaaacattcctacttgcagcttcggttttctccttgctctggtttatatatatattgcagggcaccactgagatgcgccatgaatatccac

SEQ ID NO: 3736 - DNA, 195 bp, Homo sapiens
ggacagctccagcttctacgtggtcatgtggaagcagatggagcaaacgtattggcaggcgaaccccttcccgtgctgtggccgagcctgggcatccaactcaaggctgttgaagtcttccacaggccccggggaacaactgccgaacgtctgttgcattacagagacacacacgtccccagtgcgcgctctctg

SEQ ID NO: 3737 - DNA, 203 bp, Homo sapiens
gccaaccccgtgaactatggccggccctacagactttcctgcgtggaagcgtttgctgccaccttctgcatcgtaggctttccagaccttgctgtcattttgctgcggaagtttaaatgggcaagggcttctttggaccctaacccccagactctcggacaagagacgcgggctctcggcagaccccgaggaggtgtctctca

SEQ ID NO: 3738 - DNA, 190 bp, Homo sapiens
caaagttctgggaaagggaaagctcccaaagcagcctgtcatcgtgaaggccaaattcttcagcagaagagctgaggagaagattaagagtgttgggggggcctgtgtcctcgtggcttgaagccacatagagagagtttcactaaatgctaactcacttttaaaaaaaaaaaaaaaaaaaaaaaaaaaa

SEQ ID NO: 3739 - DNA, 185 bp, Homo sapiens
cgttggtaggatggtctggatggtatatattcaaggaaggtactagaatgaagtgcttaggacagagtacagaggtagtgcaccgccattcctggcttatagcaacttagtttctccattttttaaattttttggagggtaaatatatccattcttattttttcatagaatttttaaaatgggga

SEQ ID NO: 3740 - DNA, 331 bp, Homo sapiens
tcaaatgtttattttatatacaaaggaattatcatggtttttcattgagtagatgcccggataatctctgaagggaggagcatttagtccaacttattgaaaccgttatccttcgcgtactgacggaaccattggcggcacaatattgaggccatatttccgggatcagaccgtgccggttttgaccaggcacgcaaggagccagacccctggccgaattttcgcgggtggctccagtacaagcctcgtgccgaatttcggcacgaggttaaattgttaatttaggcaaaacagggggtaaagaattagccatcatctttcgcctgagagc

SEQ ID NO: 3741 - DNA, 280 bp, Homo sapiens
gtctaactgaaatttctcttcaccttgtacaattgacagctgaaaaaaaacaacatgggagtaataatgggtcaaaatttgcaaattaaggtactgttttggtgtgggagttgtcatgaggctgttttgaggtgcctaatctatgtggggaattgaggtatccattgacatggatttgttcagccatttaccattattgagcatttaaatgcaccagatatcatttcaggtgacttaacatgaatgattaaaagtcactgctattggattgttaaaaaaa

SEQ ID NO: 3742 - DNA, 206 bp, Homo sapiens
gttgaaggacaccagcttgcggaatttgcggctttggcagattgaaatcatggcaggtccagacagtgatgcgcaataaccagttcactggttttaaaaaaatatttcacctcttttaactttcacaggtgggatgaacctttttcctggcccacatatggcagcatgccattgtattgtccttatattgcaagttcgaggttcca

SEQ ID NO: 3743 - DNA, 322 bp, Homo sapiens
cagagtggtggctacagtgaccggagctcgggcgggtcctacagagacagttacgacagttacgctacacacaacggggtaaaaaccctttcctgctcaaggatcggtccttccaaattggcttgtgttgtttaaaggattgttgggggctttcgcttgaaccgttaaatgtgtaggtaaaatgcaccctccttgtaattcccacctttcggtagtcaatttcgggttctggatctttgtcaaacccagcctgaccgctttttgaggccggggatggcctcgttactagacttttctttttaaggaggggctgttttttttt

SEQ ID NO: 3744 - DNA, 298 bp, Homo sapiens
ggagactcaccaatacctggagctggagcctattctgacgatacttcagggacagccgcagccactgggaattggtgatatatttatgcgcttcctgccaagctaccaagctgtaggatacatgagaagggggagaggtccaaccatagctttccaaacagtgatttcaagagtccagaagcattttccagaattcttttggggctgttatatgttccaatgtgacttgagggtacggtgctgctttcaataaactttcacatttactcaggttagggtcatggggtatatttcggaa

SEQ ID NO: 3745 - DNA, 256 bp, Homo sapiens
ccactcttaatcagtggtggaagaacggtctcagaactgtttgtttcaattggcattaagttagtagtaaaagacttggttaatgataacaatgcatcgtaaaaccttcagaagggaaaggggaattttttgtggaccctttgggtttcttttttgcggtttgcagtttaagtattagttttaaaatcaggacttttaattggaacaccttgccaaattttcacacaattttgggccccttaaaaggttaatggga

SEQ ID NO: 3746 - DNA, 295 bp, Homo sapiens
cttggatgctatcagatcactgttctagaacctgcctcagcacagcccagccggccacatgcaggccatgagggcagggggctgctattcacggtcacccgcagggcaaaggaaaacaaggccagacccttttccagggcggccttgggcccaaagccgggcttcagggaccttgggcttgggccaccttagggttccccagtctttaggggaatttcccaacccaacccaaggttccgccaaggcccccaaattagcacaagcccaggcattggtagaaaccagctcctgagga

SEQ ID NO: 3747 - DNA, 233 bp, Homo sapiens
gatcaatcccactctaatatcagtttctgagttacaagacttttgaggaggaggagagatctcactttcctgccaaccgaaaaaaaaaggggatttgaccaaaattgaccagttgggttggtccctccaagtggaaagtagggaaaaggacccctcaaggcacaccaagccagtgtggggaggaccttcccatataatgtctatactttacaatgggttgagattgctcccct

SEQ ID NO: 3748 - DNA, 319 bp, Homo sapiens
tgataatgcctgtgttctttttgccgtctctgttcttatgtttataatcagttcaatgctggtttatggagcaattttctttatcaagtggggttggctgattccattcttcttgttacccacttttttgacttcgtgccccaagttgcccgggttgctattagttctctcacccattttgccaagagtcaaaagggtatcttggatcaactacccctattttccctacaaaagttgacctcctcgggcctttggctccagctgcctccccttcatagtgctcgtggtgcttctgcctcattcatcatcatttgagggg

SEQ ID NO: 3749 - DNA, 387 bp, Homo sapiens
catgctggagccaagtgctaacatgccttggttcaagggatggaaagtcacccgtaaggatgggcaatgccagtcggaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggagtgaaatctgtcggaatgcaccatgaagctttgagttagctctttcctgggggacaatgttgggcttcaatgtcaaggatgtgtctgtccagggatgttcgtcgtggccacgcttgcctgtg

SEQ ID NO: 3750 - DNA, 241 bp, Homo sapiens
cacagagggaagtttaacaccacacttcaaaggtttaactacctcacaacactttcccatgagtgtgatccacattgttaggtgctgacctagacagagatgaactgaggtccttgttttgttttgttcataatacacaggtgctaattaatagtatttcagatacttgcaggatgttgatggtgctagcaggaatttgcagaaggcatactcctgtattgagttgtatcgtgtggtgtat

SEQ ID NO: 3751 - DNA, 504 bp, Homo sapiens
tgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgaccaagctgcagaccaaggagcatgtgattgaggccctccgcaggccaagttcaagtttcctggccgccaagaggatccacatctcaaagaagtggggcttcaccaagttcaatgctgatgaatttgaagacatggtggctgatagcggctcatcccagatggctgtggggtcaagtacatccccaatcgtggccctttggacagtggcggcctgcact

SEQ ID NO: 3752 - DNA, 235 bp, Homo sapiens
cggcacgaggtcaaattttagtttaattggcattgcttgttttttgacactgaaattacctgagtttcattttttctttgaatttatagggtttagatttctgacagcagcatgaatatatcacctaacatcctgacaataaattccatccgttgttttttttgtttgtttgttttttcttttcctttaagtaagctctttattcatcttatggtgcagccaattttcaaatttg

SEQ ID NO: 3753 - DNA, 329 bp, Homo sapiens
gaaatctcctggagttcctggcgccgcgggacccggcgcaagacctgcttgctggtgacgtaattgtgcatgcgcggcccatccgcacgcgggctagcaagtactacatccccgaggccgtgtacggcttgccccgcctatccggcctacgcgggcggcggtggctttgtgctttccgggggcacgctgcaccgcctggctggcgcctgtgccaggtcgagctcttcccatcgacgacgtctttctgggcatgtgtcttcagcgccttccgctcacgcccgagcctaaccctgccttccgaacctttggcatcccccagccttcagccg

SEQ ID NO: 3754 - DNA, 121 bp, Homo sapiens
gaagaacgcagctagctgcgagaattaatgtgaattgcaggacacattgatcatcgacacttcgaacgcacttgcggccccgggttcctcccggggctacgcctgtctgagcgtcgcttga

SEQ ID NO: 3755 - DNA, 211 bp, Homo sapiens
ctcgtgcgaattcggcacgagttgatgactaaaattatttcaagtttgatgaaagtttcacacccacacagcacaatcaacttattcaaaacctgtgataaagggaaagtcttaaaagcactctgatagacaacacatgctatacataggagagcaaaaataaagataacagtagattccatattagggacaatgcaagagagaaggcaat

SEQ ID NO: 3756 - DNA, 301 bp, Homo sapiens
ctgcaatgtattggcatctaaaaactcccttatgaaactgccagacttgttctggaacatttcaattacatgcaaaattcaggttctcaagttggaacaagtctaattgacacacctgcataggttttaaccttgccctccccctacttcccaacagatttccaagttttttgagaaggaaccttgctctggcccaggctggagtgcagttgcgccatcttcggctcactgcaacctctgccttcctgggttcaagtgattctcagcctctgaggtagctgggattgcaggcacctgcacc

SEQ ID NO: 3757 - DNA, 202 bp, Homo sapiens
agggtttctctaaagcagttgtatctaagtgctaagttgtttccctggcctaaggtggtgctgtttatttagagcttgttaggttttaatatttcatggtttatcatgtaccctcttatttttgattagccttggtgacaatttcttaccatttaggatattattacaatggtgctaacaagaagctagataaagatataga

SEQ ID NO: 3758 - DNA, 242 bp, Homo sapiens
acggccaaaatccataaagattataaaagcaaactaagttgtgaagctatagtacatgtaggcatttagttaagtatagcaattcaaactgacctgcatccatccaaaacaaattcctccttcaaccttatttttacttgacatttgctagaaggaatagccaacccgaaatttgttttatgcatgagttaataccactggctcagcaaatacaaggttaggttgctttaagcaaggtacct

SEQ ID NO: 3759 - DNA, 240 bp, Homo sapiens
ccggaacaggaccgccagcagcttggaggaggacttgttcgccaagattcccttgccttgaggcagcagctttataaactctacgaggccgactttgttcttttcggctaccccaagcccgaaaaccttcttcgagaacttaaagcttttcgcgttgctttttytcgcgtgtcctttgaaccttaacgaacgcgcacttcacgtttttttattagcctaccgttttttgaatcttggctt

SEQ ID NO: 3760 - DNA, 242 bp, Homo sapiens
cttggatgggagctcgggctgagccggtgctagagcttgtatccatcactgaccacaaggacaactgtccttgagaccgagagtgtcccattacacacggggcgcgcgctgcgcgctctgtggggccccacgacctctaactctctcgcacagagttccgctgtaggggtgtactctccgcgagagagtgtgtgactcttatgatgatataagggggtacaacactatggctctagagagtg

SEQ ID NO: 3761 - DNA, 227 bp, Homo sapiens
ccaaaatgtacaaggccacaccggatgtcatctttgtatttgggatcaggacttaattttgttgtgcgcacagacacactctgctctttgcactatatattatatatatccctctgatatatatcacaagagaaaatagagacccccaacatatgagctctgcacagcagcatatggcctgcttatagtagagagagaagagagctctaagaagaagcgaccgcgag

SEQ ID NO: 3762 - DNA, 162 bp, Homo sapiens
ctcgtgccgaattcggcacgagcttgtgcttaatttggagctattcaagcagccaaaaacctgagtccttccatgtagtaatacaatgagatctctagagtttggttatatacgttttgcgcaaggagtgtcacattgtgtggggaatatgagaagagctca

SEQ ID NO: 3763 - DNA, 122 bp, Homo sapiens
cacttggaagatttctctctgggaatttgagggtttgaggaaatgttgcccttggaaagtttcatgcactatatgtctgtctatctttctgccagagagagctttccacagagagagtaatg

SEQ ID NO: 3764 - DNA, 295 bp, Homo sapiens
catttttgcaagccaaaagtcgatcaatcgcattcattttaaggaattataactttttagtacttgcttgagagagatgattcagagggtaaatcacatactcttgttttagagagagcgagaggggtttataccccagtcacaccagactctgtgcttctataacataagacacgacactctgtggaagggatttgaaatgtcagggttacacagtgtgagggggagaacgtgtgacaccatctctcactcgagacatcatcagagatcattttatgagctgatatacaaaatt

SEQ ID NO: 3765 - DNA, 245 bp, Homo sapiens
gtgcggcagccacccctgaggcctgttgcttgaactcttgacccaggcctttttcttcaggccttcctttacttcaaacctcttctctgctctcttttcctcgagatagtgtctttggctttcctctgtgtgtccagaaagagaggcactcaccacaagagagccctctctaaagcgttttcagagcaaacacgctttgagagtgcctctagagggagtgtgcgaagcgctcaatatcaaactac

SEQ ID NO: 3766 - DNA, 503 bp, Homo sapiens
  misc_feature 490, 493: n = A,T,C or G
gtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaacaccaactgcccttggtggcaagtgggtggagatgggatgcgtgccaacctcagatgccaactcaagtcatcaaggccaaggacagtggcgaaagtgagtcttggggtaccttaggccttggctagtctgcgttcctctccctgcatgctgtgtatcctaactccctacaacaacccctcaaataaatcacatctagtgactggtaccaacaaggnggnaaaaaaaaaa

SEQ ID NO: 3767 - DNA, 170 bp, Homo sapiens
tgcaaccttccgggaaccatcttctcgggacatcttcctgccttcttggaacctgccagcaccggttttgtaggtagagttcctcttgggccaaccaaccatgagagtctccagagatcgcgcagagattatattccacacccgcgcgtgagagcacgacccctgcaaac

SEQ ID NO: 3768 - DNA, 158 bp, Homo sapiens
gctcaagaggtatctctcagccacagagctgtgttggttgtgctgagtgcggattacaaccatcttaaggctggccggcgtacaaaatttaggcaagaggaactctggcaaggttaccgggtttgccatagatctgtgggcatcctttggggtgcaac

SEQ ID NO: 3769 - DNA, 370 bp, Homo sapiens
ggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgaggggcctcaataaagtttgtgtttatgccaaaaaaaaaaaaaaaaa

SEQ ID NO: 3770 - DNA, 372 bp, Homo sapiens
cgccgcgccgccatcatggacaccagccgtgtgcagcctatcaagctggccagggtcaccaaggtcctgggcaggaccggttctcagggacagtgcacgcaggtcgcgtggaattcatggacgacacgagccgatccatcatccgcaatgtaaaaggccccgtgcgcgagggcgacgtgctcacccttttggagtcagagcgagatgcccggaggttgcgctgagcttggctgctcgctgggtcttggatgtcgggttcgaccacttggccgatgggaatggtctgtcacagtctgctcctttttttttgtccgccacacgtaactgagatgctcctttaaataaagcgtttgtgtttcaaaaaaaaaaaaa

SEQ ID NO: 3771 - DNA, 410 bp, Homo sapiens
cgaagatggcggaggtgcaggtcctggtgcttgatggtcgaggccatctcctgggccgcctggcgcaatcggtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggccccaagccgcatcttctggcggaccgtgcgaggtatgctgccccacaaaaccaggcgaggccaggccgctctggaccatctcagggtgtttgacggcatccaccgccctacgacaagaaaaggcggatggtggttcctgctgcccttaaggtcgttcgtcttaagcctacaagaaagtttg

SEQ ID NO: 3772 - DNA, 377 bp, Homo sapiens
attttttcttgagctgtaagggttttaaaaataaatacattctgaatgcaattatcatcagatcataatttgcagagttctcctactctgcagttgtcttttcactttcttgatagtgttttttgaagtgtaaatgtgattttcattaagttcaacttaatatttcttttatcactgttgcttttggtatcataactaagttattactgtctaattcaagatcatgatttactcccataaatccttttcttccaaaaaatgtatagttttagctcatacatgtaagtctatgatacacattaacttttatgtatggtgtgagatagaggaccaaatcaattcttttttatatggatatccatttgtctcatcaactt

SEQ ID NO: 3773 - DNA, 408 bp, Homo sapiens
cccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtgactcccccagcccaggccagaagacctcctttcaggtgccgggcgcaggaactgtgtgtgtcctacaacaat

SEQ ID NO: 3774 - DNA, 215 bp, Homo sapiens
ctcgtgccgaatttcgggcacgagaggaaacctggggcaccaggactggagccccctccggagacccaaactcacatcccctacagtccctccccaaacaggggtactaggactgcagccccctgtagctcctctctgcttacccctcctgttgacaccttgcactctgcctggcccttcccagagcccaaagagtaaaaatgttctggttctga

SEQ ID NO: 3775 - DNA, 411 bp, Homo sapiens
gcacgagcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacctttgaaaggcttactgctgcatggctgtctgcatgaaccacgccttggtgaaggagccttgggtaagaaccaccatccaaagcttggggcaaaggatgattaccttcagcatgattacattgga

SEQ ID NO: 3776 - DNA, 324 bp, Homo sapiens
tctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaagcacagcagaacaatgtggaaccacaaggttgaaactttttctggtgtctataagaagctcacgggcaaggatgttaattttgaattcccagagtttcaattgtaaacaaaaatgactaaataaaaagtatatattcacagtaa

SEQ ID NO: 3777 - DNA, 384 bp, Homo sapiens
catcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatctttcgtgaagacccttactggtaagaccatcaccctcgaggttgagccagttacaccatcgagaatgtcaaggcaaagatccaagataaggaaggcatcccttccttatcagcagaggttgatctttgctgggaaacagcctggaaggttggaccggaccctgtcttacatacaacatccag

SEQ ID NO: 3778 - DNA, 229 bp, Homo sapiens
cccaaacccactccaccttactaccaaacaaccttagccaaccatttaccaaataaagtataggggttagtcctgcctatattatgccttgggtataaattttcatctttccttgcggtactatatctattgcgccaggtttcaccttgtgccgaattcggaacggggcttaagggggaatccagcgggtggcacgagccttgcttatggagcccaattcccctaggac

SEQ ID NO: 3779 - DNA, 329 bp, Homo sapiens
ggatggccatttatttaatatccattcatttcatgttagtggactattaacttgtcaccaagcaggactctatttcaaacaaaatttaaaactgttttgtgggccataatgtgtttaattcctgggtaaagataaagcttcataatgctggtttttattcaacaaattaaccagctgttaaacacagactttatcaagggtagggcaaggttttcagggttccatacagagagagtctatagtgcagtgatttgtgaagcagagtttcacatataagagctctctaggctcttgatgccctactctttaaggggtgtatagtgttgtga

SEQ ID NO: 3780 - DNA, 385 bp, Homo sapiens
ctggatttagcaaagatcatttttaaaaggcaagaaacaaagaagcacagctttatgctgcccaggcacatcttaaactcggagaaggtaggtgttggatcttaaaactatgttcaagctgttgaggagttcccgtcctgccttaacctgcaggaacagtacctggaaggccacggccgtcttcttgcagagaacccactatccagctgggctttgcttatgggtacaactctcagtatgatgagggaggtggcacagatcagcacatctatttgatgtgatttggcagcagcagtgtctgtgctcacgcgcagcgggagggggctgcggggtcgtcttctgcattacaacgaagaagttttggggctacggggctcctcccccc

SEQ ID NO: 3781 - DNA, 284 bp, Homo sapiens
ggaaagtaaaagtacagaaaatttgttaaaggaaattaaatgagatcatgtctcaataatctctgagcagacaaaattagttaggtctcataagtgtatctcaacctccgctttgatttgcaaatacaaacaaaacttacatatatttcttgtagctcgcatattgaaaaaagagagatgaagctcaaccagtcagaagtagccaacaacctctatatatatagagactgtccccacacaggtgaacagacacacacaaaacactataaaaaagttgtgcttcc

SEQ ID NO: 3782 - DNA, 342 bp, Homo sapiens
tcacattccaagattgatgtgtgggaaatagggattacaaacatattgtatttaaaaggatccaaacttgattctacatgaaagtatctatattattacaatggccaaggcctactctctgggcaactttgacccttagtattccagggatacttgaggtagagaccagaaaagacttgagctattctgtcactctagtaacatggtgctcatcatgtccagagcaattttgcaatattcacatacaagacctgtctcagtattacttccatgtgggttttttttggccacaatttatatttatttttgctactttccttcaaggccacccctccatatctt

SEQ ID NO: 3783 - DNA, 288 bp, Homo sapiens
ccacccatgccagcgcaggccagggctcagatggggcctggctgttgtgtctggagcctgcaggcaggtgggggctgcgtccctgctcagcccatcccctgcctctatccctgggcacctgccagggctccctcgggctggtgtcttgagaccagcctgccaggccttccagcaggaggacagagttcccttgggaatacaccttcctgcccaagggacgtggcgttgttggtgtttgaggtgctgccccctcgcttttgcggccccaaaggccctcaaggtttccca

SEQ ID NO: 3784 - DNA, 242 bp, Homo sapiens
cgaacggcatactaacggctcaaacatttttttgtaggccacaaggcttcccacggacttcacgtgcattattggctacaactttccctacactattctgccttacattccggccaacctaattattttacactttacaatccaacacatacacttttgggctttcggtaggccggcccgccttgaatacttggccattttttggatggtatgtgggtttggacctatttcctgtatgtcct

SEQ ID NO: 3785 - DNA, 250 bp, Homo sapiens
  misc_feature 193: n = A,T,C or G
cgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtangtctccatctattgatgagggtcttaaaaaaaaaaaaaaaaaaaaaaaaaaaaaaaa

SEQ ID NO: 3786 - DNA, 330 bp, Homo sapiens
ctcgtgccgaattcggcacgagggggaaagcggactggatgctgctggacacgggctctaccagttcctgggggaggagggaccgggcagccctcttgccagctgttggcgggccatcatcctccgggacgacgccgccataaggccgaacgcagccgaactgggggtgcaagactacctcctgttcgccgagatgctcatgcagcgcccgtgcgctggggcagctgtggggctcgcacctactgagccgcgagaggcggcctacatggtggacatggcccccgagcgcttcgaggccgtatggcggtcctcagggagctccgcgcccat

SEQ ID NO: 3787 - DNA, 274 bp, Homo sapiens
tgagaaaggtcctggtccgcgccagagcccagcgcgcctcgtcgccatgcctcggaaattgaggaaatcaagggacttcctgcttcacagcccgacgaaagggattgccaaatctgtcaagatcaagaaaaataagggcaacgtgaagtttaaagttcgttgcagcagttaccttttacaccctggtcatcactgacaaggagaaggcagagaaacttaaggcagttcctgccccccggtttggcagttaggaactcaattgaccagacacact

SEQ ID NO: 3788 - DNA, 246 bp, Homo sapiens
ctcgtgccgaattcggcacgaggtttgtttcaattggccatttaagttagtagtaaagactggttaatgataacaattgcatcggtaaaacccttcaagagggaaagggggaatttttttgttgggccacttttggttttctttttttccggtatggcaagttttaaggttattagtttttaaaatccagtacttttttaattgggaaccacctttgaccaaaaattttgtcacaggattttgggg

SEQ ID NO: 3789 - DNA, 220 bp, Homo sapiens
cccgtgtgaagctgccctccggctccaagaagggttatcttctcagccacagagctgtggttgtgtggtggctggaggtggccgaattgacaaacccatcttggaggctggccgggcgtaccacaaatataaggccaagggggaccttcctggccacgagtacggggtttggccaattaatcctgtggagcatccttttgggaggtggcaaccaccaaca

SEQ ID NO: 3790 - DNA, 243 bp, Homo sapiens
aaatagttttgtgatttatttcttgccccatatgtaaatatttagagtctcatttcttgcaacttattttgaagctgagttgtgggtttgggttttgtttgtttctttggttgcagggtggggtggggggttgcagggaaggaaggaagggattttttgtaccctggaggatggagataatcttgtggtttaaagcaattctccactgaagttattcaaattatcaccagatttttccaggtt

SEQ ID NO: 3791 - DNA, 260 bp, Homo sapiens
aaatattttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaaaaaaaaaaaaaaaaaa

SEQ ID NO: 3792 - DNA, 194 bp, Homo sapiens
tcagattcagcatttgttctttgccagtctcattttcatcttcttccatggttccacagaagctttgttttcttggggcaaggcaggaaaaagtttaaatttgtaccctattttttgtatattgtgaggatggtttaaaataaaattgttggaaaaaaaatggaaataaaggcatgttttgggttttcccaaag

SEQ ID NO: 3793 - DNA, 173 bp, Homo sapiens
cttggacaaaactgtcgtcaataaggatgtcttcagagatcctgctcttaaacgcaaggccgacgggaggccaaggtcaagtttgaagagagatacaagacaggcaagaacaagtagttcttccagaaactgcggttttagatgctttgttttgatcattaaaaattttaagg

SEQ ID NO: 3794 - DNA, 267 bp, Homo sapiens
gatgcaagcatctaagagagaggttaatcacactatagaggcataagtggtatcagttttcatttttctaattgtttaaacttgtgttttataccagtcgttttgcaagtaatttggggtgtttagcttgagattggttaaaggttggttttggggaggggacttccgtttttaattggtttttcttttaaaaaatgttttcccacctcccctgaaatttttcctgaaaagcattgggcttggaacaagttcaacaatccctgggct

SEQ ID NO: 3795 - DNA, 393 bp, Homo sapiens
caacattcttgtactgtggcatgtatgggaccacccctccaaagattgtggtcacagcagcccccaggaaaccagattggtgcggcaggacaaaaacccaattccaaggcctttttgctttccattgcccaacaattttttcccacccaggtagggcaagggtattgtccaacttgccttaagcctttatatttatgggtttcctgaccctgccaattaggggtatctccacttgttacagctgttctgtcagtcctatcacaatggctgtcctggtctgccaggacatatgctctgtcctctgtttgatggagaccccttatgatttcgtaatacctcttcctccctgtagtgtactgtgtgtagaatgcagtatataggctaggctcagtg

SEQ ID NO: 3796 - DNA, 514 bp, Homo sapiens
caacattcttgtactgtggcatgtatgggaccacccctccaaagattgtggtcacagcagccccccaggaaaccagatggtgcggcaggacagaaaccaatccaagccttctgcttccatgcccaacatctgtgccacccagtaggcagggtgatgtccaccttgcctaagcctctcactctcatgggctcctgcacctgcacattgagggttatctccacattgctacagctattctgtgcagtcctctaccaatgactgtcctgatctgccagggcactcttctctgtccctctgtttgatggagaaccccttatgattttcttaataactttttcttccctctagtgtactgtgttgtaagaatgcagtatataaggctaggctcagtggctcatgcctctaaccccagcactttaaggggccaacgtaggaggttcacttgagcccaggagttcaagaccagcctggacaacatagggagacccttctctacaaaaacaaacaaacaaga

SEQ ID NO: 3797 - DNA, 394 bp, Homo sapiens
cctggctctgctgggtgctcctggcaaagatggactcaacggtctccctggcccattggtcccctggtcctcgcggtcgaactggtgaatgctggtcctgttggttccccccggccctcctggacctcctggtccccctggtcctccaagcgctggtttcgacttaagcttcctgccccagacacctaaagagaggtctaacgatggtggccgttactaccgggctgatgatgacaattgtggttcgtgaccgtaacctcgaggtggacacaccctcaggagcctgagcaagcagatcgagaacatccggagcccagagggcagccgcaagaaccccgcccgcaccttccggtgacctcaagatgttccattctgactggagattggagagtac

SEQ ID NO: 3798 - DNA, 244 bp, Homo sapiens
gtttgtttaactaaacacagaaaaggtacaactaaaatgtattattttatggacactgtcatatatgtgggtcatcactgaccaaaatgttatataggatattactgtaccctggttttaacctcagagctttgtattttacatattattaaaccaaattaaatttaggggggtaattcttaaaatcaccaaccaggtttctgtcccccggccaaaaggcttacacaggctctggttttccccc

SEQ ID NO: 3799 - DNA, 121 bp, Homo sapiens
cctggacggtgcggccatgagggcctcatgttacggcattgccttttcttctgtagatcagtatcttcctcggctttttagggagcaaggaaaaatgcgtcttagaaccaacttttttttt

SEQ ID NO: 3800 - DNA, 316 bp, Homo sapiens
gattgatcagagcattgtgcaatacagtttcattaactcctttccccgctccccaaaaatttgaattttttttcaacactcttaccacctgtaatggaaatggtcaacccttgttaggaaacccaaattaaaatttggaaaattaaaaccccttaaaccatttgcaccatctgtgtggctttgtgtatatctccccaaagggggaaggtttaaaccccactctcccaggggtttaactctccctcacacacttctcccgtgtgtgtgctccacattgtggggtctgacctagacagagatgatctgagctcctcgt

SEQ ID NO: 3801 - DNA, 212 bp, Homo sapiens
atctctcgggacaactggcacaagcgccgcaaaaccgggggcaagagaaagcctacacagagcggagtatgaagttggggcgccaacttgcaacaacaaggtttggcccccgccgaatcccacacagtccgtttccggggggttaccaggaattaccgtcccttaaggttgggacgtggggatttttcctggggttccagagtttttttttc

SEQ ID NO: 3802 - DNA, 265 bp, Homo sapiens
cggaggcgttcagctgcttcaagatgaagctgaacatctccttcccagccactggctgccagaaactcattgaagtggacgatggaacgcaaacttcgtactttctatagagaagcgtataggccacagaaagttgcttgctgacggtcttgggtgaaaggattggaagggtttatatggttcccgatcagatgttgggaaccgcaaaccaaagtttcccccttagagccagagtgttttttacccctaggccctttccccctcc

SEQ ID NO: 3803 - DNA, 292 bp, Homo sapiens
ttttcattgaagaataggatgtggttctctagtgatcacaaattgtatggtgtatagaagagagtgaaatgcttttcttctccattattacaaggacataggttcttttgcctcaaagacaatctgcttcttcgctcaatcaatgccatcctacaaccagaggtattttccaccctgcagtcttctctcctactggcatccctggccttgagacccgcagatctgacctcatccaattctgtgtctctatgtaattgctatctctggagtggcatgatctgtttgtcatcat

SEQ ID NO: 3804 - DNA, 229 bp, Homo sapiens
cgcgcctgcaggtcgacactagtggatccaaagaattcggcacgagttttcattgaagaataggatgtggttctctagtgatcacaaattgtatggtgtatagaagaaagtgaaaatgcttttcttctccattattacaggacatagttcttttcctcaaagacatctgcttcttcgctcatcatgccatccttcaaccagagtattttccaccctgcagtcttcttcc

SEQ ID NO: 3805 - DNA, 291 bp, Homo sapiens
cgaataacttcgcttcaaggaggacctcctgaactatggccagccgaggttaacatacgagatagattgctcgtcgactgctaggtgctgacagtgcaactgtctttaatattcaggagccagaggaggaacagctatcagggatacaaagtctccagctgtgaacagagacttatcagtgaaatagagtacaggctagaagggctccctttggatatcaggggatgagggctagatttgagagtgcccttgggaatggagtgcacactctctgagtagtagtcgtagaca

SEQ ID NO: 3806 - DNA, 192 bp, Homo sapiens
gtaggacccacaggacttcagctggatctggttggttgaagctcaagattggtgaatgatctctgtagcacatgtcagtattgtacatttgccttacagccccatacaatgatttgacctttacctttggaagggtaaggctcacaagtcttacctcaggatgaggatgaacccctcattccaggtggtttt

SEQ ID NO: 3807 - DNA, 550 bp, Homo sapiens
gaaggacccacaggacttcagctggatctggttgggaaaagctcaagattgggaaatggaactttggtaggcacatgtcagtatgaaacatttgcctcacagccccatacatgattaacctttactttggaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcctgttcagcaaaaccttaaggcagaaagctcctaaggcatgattatatatttcattctttcagtagcatttgccaaacatttttaccatattgttgctaagtaggtaaa

SEQ ID NO: 3808 - DNA, 300 bp, Homo sapiens
cttggtctgaggtccagagacagctcagcattgtggtgacagctctggaggtgcggcagcacctgaggcctgtggctgatctctgatcccagctctctttcttaagccctcccttactccaaccctctcctgcctgctttcctgagatgtcctggtcttcctgggtgccagagagggcactaccaaaggacctcttaagcttttagggaacagctttaggtccttaggggagtaggcagccctaatgcacttacctaatccgggtcttaggtagcagaggttggcagcaggaacaggatt

SEQ ID NO: 3809 - DNA, 335 bp, Homo sapiens
ctctgctctgtggggctctggccgcgcctggtctggtcgggaccatgttcgcgttcgggacgactgcgctgtgcggcttccatgcacgagtttttcgccaaggacatcgacgggcacatggttaacctggacaagtacccgggcttggtgtgcatcgtcaccacgtggccttccagttaggcaagatccaagtaaactacactcagctcgtcgacctgacgctccatacgctgagtgtggtttgcggatactcggcctctccgtgtaacacatctgggagcagaggctcaagtgtatcgcagagatcacagagtctcgcggctacaacactaaca

SEQ ID NO: 3810 - DNA, 245 bp, Homo sapiens
ccatcttcttcctcagaagaagatgatcctatcccagatgaattgttgtgtctcatctgcaaggatattatgactgatgctgttgtgattccctgctgtggaaacagttactgtgatgaatgtaagaagtgctgaatcttggaagatgtatattttaggatatttgtatttacttggaatggctctctccaacctcatatgttttaataataaaataaataatgttgaaaaaaaaaaaaaaaaac

SEQ ID NO: 3811 - DNA, 333 bp, Homo sapiens
ctcgtgccgaattcggcacgaggatttactaacttttccaagctcacagagctagggacttgtcgctaaaaagttcaaacattttactatcaattgccttgtctatattttctgtgcctagagtgtagcacagtgcatagtcaaatagacatatagcttgagagagtatattgtgtgaatatctcacacatatatgccctgtgtcacacaacagattataggcatatgcagtatttcactatatttgattaggcagcagcatgatcatatatagtagctactgtagtcgtcgacggcgtcaacatcgtagtaagatgatgcagctagttgtct

SEQ ID NO: 3812 - DNA, 180 bp, Homo sapiens
ctcgtgccgaattcggcacgaggatttactaacttttccaagctcacagagctagggactggtggctaaaaagtccaaacattttactatcaattgccttgtctatttttctgtccctagagtgtagcacagtgcatgtcaaatgacatatgcttgaagaatatttggtgaatattccac

SEQ ID NO: 3813 - DNA, 283 bp, Homo sapiens
tggaaatcctatgacaataactatgacaataactatgacaagtctttcttcaagtgcatgcagtcttttgcagtacctcattcagccaagtatttggttctctacctccattcagtataaggcagcctttaatttgcttaggaaggcaacatatagagaggttagagttcagcagggacatagagtttttaaaatgtgacttcactgtatatatttgagtttctctagggggtgtagagtcacacacctcttttgtagactctgcaatatgataattattttt

SEQ ID NO: 3814 - DNA, 260 bp, Homo sapiens
attggattttgtcacgtagaagcagaagtttactgtgggaaaggaaaaggcaagaacaaattgagtttttgagttcaggcttcagggagggaatggagccatgcctagcacagatcttgagtgtagtggttggaaataatattcagctgtcacaactcggtctgaaagtgtgtctctctatcattcaatcttgccaggttcatgccctgtgaaaggcagtcagggagtctcttttatgacactaggctcattgtcgccag

SEQ ID NO: 3815 - DNA, 146 bp, Homo sapiens
cttaactgtttttaaagatttttagggatcttaacacatttctctccattaaacatatggcatatgtatattcattccgttccttattaaatttcctgaaggttttaaaagggagggtcacccaggattaggaaccctttgccccc

SEQ ID NO: 3816 - DNA, 219 bp, Homo sapiens
gcggcgctcgcgccaaggggacgtgttttctgcgctcgcgtgggtcatggaggcgctgtcgctgctagccgcgaaaacttccggaccagggccgcaaccaaaggcttgcttctgcttgccgctacttcctgttcctccctgccggctggggctgttccagggctgggaggaaaaagggagagggccccggacctcgcgaggaggggtttccacttctac

SEQ ID NO: 3817 - DNA, 226 bp, Homo sapiens
ttaagcttcccaagtgtctggtctttgctacagagaagcattgttctgctttcgtatcctttatatgaattcttcaaagagactcaaattttgtcactaatttcatgtttcatgctgtgggctaagcagtttatagttttaccatatttaggctaggtttagaattttacgaatggtttgcttggtcttctgtctcctgtcccccagtttcagagaaaaaaaaaaa

SEQ ID NO: 3818 - DNA, 278 bp, Homo sapiens
gccatggctcgtggtcccaagaagcatctgaagcgggtggcagctccaaagcattggatgctggataaattgacccggtgttgttttgctcctcggtccatccacccggttccccacaagtttgaggagaagttttttccccctcaattcaatttttcctgagggaccaggactttaaggtatgcccctgaccagggggatgaagtaaagaaggattttcatgcagcgggttcatttaaaatcgatggcaagggccggaccctttatatccccccccc

SEQ ID NO: 3819 - DNA, 274 bp, Homo sapiens
ctgggacgtctagtccacaggaagacctgcaccacttgtcggcttcacacaggtgactcgggagacaaaggcgcttttgcttaagcttggttggagcttattcagggccccattaccaattgaccagattaccgttgaggattccgccgtcacttgggggttggcaatgttccctgggtcccaaggctttgtgctcgtgatcggccaagcgttggaaaaggcaaaaggtttaaagggctttcccctctaactctggggtaaaatagcacactgt

SEQ ID NO: 3820 - DNA, 355 bp, Homo sapiens
ctcgtgccgaattcggcacgagggcaatacctgatggagggcagctacaacaaagtgttctggccagggtaacaatccccgccgagagcctacaccttcttcattgacatcctgctcgacactatcagggatgagatcgctgggtgcatcgggaggcctacgagaaaatcctttcaactgaggccaccggatccttttcttaaccacacccaaaggttgacagttacgccaaggagcgaggtgggtcctggccccaaacaacttctactagttttcccagccagcagcagaggcgggagacacaccattccctccaaagtactggccaacaggtctcgagtatcccggcagctgg

SEQ ID NO: 3821 - DNA, 344 bp, Homo sapiens
cccaaacccactccaccttactaccagacaaccttagccaaaccatttaccaataagtataggcgatagaaattgaaaccctggcggcaatagatataggtaccgcaagggtaaagatgaaaaattattaacccaggcattattattggcagggaccttaaccccctattaccttcctgcataatgaatttaactgggaaatacctttgcaagggggaagccaaagcttaagccccccgaacccaggcggagcttccttagcacagcttaaagagcacacccgtttattgggcaacatggttgggaggttttatggtagaggcgacaccctccgcgccgtggta

SEQ ID NO: 3822 - DNA, 265 bp, Homo sapiens
gtcctctccgtccggagaggggaacgtgaaggaggtgaggagggagtagtgcaggaggatttgggtctctccttctttcccttttccaattctcccgaggggcttaaccaagcttggtgaagggttcttaaccaagcaaaaggagggaagcaagcccggggccccgttaagggttaaggcccccaaccaaggcaaggaaggcaaccaaggaaggagggaggaacccgaaggccgcaccttctttaaagcgccattcctaaatata

SEQ ID NO: 3823 - DNA, 310 bp, Homo sapiens
cgaaaagtgactgttcacagacctcagtgatgtgagcactgttgctcaggagtgacaagttgctaatatgcaggaaggggatggggtggataactttcttggctttcttcatggatggcatggttttctggtatgttaatgacttttttcgggtagctattaaggtactagaaggttgataaatgtgtacagggtccctttgcaataaaacttgggtatgacttgatccaagtgtttaacaattggggctggttaaggctgacacacatcactctgatagagtgtggggcttttcaggggggagagacac

SEQ ID NO: 3824 - DNA, 304 bp, Homo sapiens
gaaagttgacacttcaaattgctcacaaggactttaaactctacaataggtaaaatgtggagtaccttatgttttcagaccaaatgattttgtaatttgaattcaaaattttttttagtcttcacagtagtcttagcattaaaagcatagttatttttaaatattttgataaaatattctatttcattaattttgtataagggcatgtgtgagaagcattgatatttttaaaatataaaaatacagcccctctcttaataagccagagcactttttgagttttaaaatttgtgtttttgggggc

SEQ ID NO: 3825 - DNA, 378 bp, Homo sapiens
gaaagttgacacttcaaattgctcacaaggactttaaactctacaataggtaaaatgtggagtaccttatgttttcagaccaaatgattttgtaatttgaattcaaaatttttttagtcttcacagtagtcttagcattaaaagcatagttatttttaatattttgataaaatattctatttcattaattttgtataagggcatgtgtgagaagcattgatatttttaaaatataaaaatacagcctctttctaataagcaagagcaattgttgatttttaaattttgtgtttttggaggcttccattcacaaatctgattgtttaaataaatctgtctccagtaaatatgttggcacttaaaaaaaaaaaaaaaaaa

SEQ ID NO: 3826 - DNA, 265 bp, Homo sapiens
gattacttcactcctggactgtgactttcagtgggagatggaagtttttcagagaactgaactgtggaaaatgactctccttaacttgaagctactttttaaaattttgaggggtcttggaccaaaagaagaggaatatcaaggttgaagtcaagatgacagataaggtgagagttaatgactaactccaaagatggcttcactgaggagaaggcattttaggattttttaaaatcttgtcagaggtcccagagaggtctaattt

SEQ ID NO: 3827 - DNA, 218 bp, Homo sapiens
ctcgtgccgaattcggcacgaggggaattcggtgtggacataggggccggtctgcttcttgtaaaacctgaaccagaacaacaacaattccgtttgcaaaacccaaaggacccaaggacttttccaatctcaggtcaactctagggcctcttcacttgatggcctgaccctcaccctgatgtccattcaatccacctctcacagatcggacttttctc

SEQ ID NO: 3828 - DNA, 226 bp, Homo sapiens
gccaagaaggttgatgctggtggcaaggtgaaaaagggtaacctcaaagctaaaaagccagaagggaagcccattgcaggccgcaacccttttccttttaagaggaatttggaaggtatttcccgatcctgccatgtattccagaagggccatgtcaagaggaggtactcagccgctaaatccaaggttgtaaaggaaaaggaggaggaggtcttgcactctacaa

SEQ ID NO: 3829 - DNA, 242 bp, Homo sapiens
aaatacatcaacaaccgaaacgtgccggagattgctgtgtaccctgcctttgaagcacctcctcagtacgtttggccaccctatgaaattgggccggtgaaaaatcgccttaaaaaaggacccacccaccctccttaccttacccttgccttaaaggagattcttgcctttgacaataaatcctatacccagcttttggtttggtttatggttacaggaatgctgcaattcagggcgctctc

SEQ ID NO: 3830 - DNA, 270 bp, Homo sapiens
gagaagagtaagctttcatgggggttgcacctgcaggagcagctaccactccagggctggagaacctaaggaagagttttgaagggaggggtttccagaagcctctttaacccagacatactgagggagggcgggctcaaactcaagcggggagctgggggtcgttccgcggtgtttaagaaaaggacttcctgcactcagacctctgcgggagggggcacatacagactggttgctggggtcgtctcatgtcctccctctattcaataa

SEQ ID NO: 3831 - DNA, 580 bp, Homo sapiens
gagaagagtaagctttcatgggggttgcacctgcaggagcagctaccactccagggctggagaaccctaaggaagagttttgaacgagggttccagagcctgtgacccagacatctgaggagggggctcaactcagcgggagctggggtctccgggtgtgaagaaaggactcctgcacccagacctctgcggaaggggcacctgccagctggtgctggggtctctcaggtcctgccttgaatcaaaaggaaggagactgagcctctcagaggaccaggaaccaagccaaggcttgacaaaaccagcctctctctctctgctgtctggaaaggtactgcccaccacccaccacccccatcactcctctaagattttccactgttggtcatatgtgcagagactgccagcagctttcatggtgaccgagctttgctgaggaggatcaacactttctcatgaccaaaagcaataatgtctccggaaaagcggctgtcacacatcctaccagactatgaccaacttatttgcctttcctaatattaatggttgccttagatccagcacctaacatcatagcagc

SEQ ID NO: 3832 - DNA, 255 bp, Homo sapiens
gccgctccgccgcagacgccgccgcgatgcgctacgtcgcctcctacctgctggctgcctaggggcactctccccagcgccaaggacatcaagaagatcttggacagcgtgggtatcgaggcggacgacggcccgcttcaacaaggtgatcaagttaactgaattggaaaaacaattgaaggcgtcatttcccagggtatttgcaagctttccaatttacctcttgtggggctttagcccgttcttcttccccag

SEQ ID NO: 3833 - DNA, 254 bp, Homo sapiens
cctctgccgccatgccgttcctggagctggacacggaatttgcccgccaaccgagtgccgcgggctgagaacgacctctcggcggcggtgtccttccaatcctggggcaaacctgcgggacccgggtgaaccgtaacggttacggccgggcctggccatgggcgttgagcgggtccaccgagcctgcgcgaagttgtccatcttcctctatcggcgtagtgggcacggcggaggacaaccgaagcacagccgcc

SEQ ID NO: 3834 - DNA, 150 bp, Homo sapiens
gagagagagaggccaaagaatgaatgttgtgtagtgaagttgagacctcaatcctgcagccagtaatttctaactttgggcctttaatgatgccttatatacttttaaaaaattatttggggacccaaagggattttggtgttcaatggt

SEQ ID NO: 3835 - DNA, 175 bp, Homo sapiens
caacgctggcttcaacatcaagaccctggagcaccgaggattcaagctgaacatctgggatgtgggtggcagagtccctgcggttccacttggcgggaactaacttttgagagacacaccatgggcctcaatctggggtagatggacaaagcagaccgccaagcgcaatgcaaga

SEQ ID NO: 3836 - DNA, 220 bp, Homo sapiens
agatgttggaggatgaggacgacctggcctacgcagagactgataagaagacgaggacagacttccacggtcccacgggcgccctgccttggattgcggacacttgaacaccaccgcgttccaacttggcttgcaccttattcccccagacgcttgagccaccttaagcgcaccgtggagattattcaaggattcctttgtttcagggttcttttgagaa

SEQ ID NO: 3837 - DNA, 255 bp, Homo sapiens
gttggagcgagcatcccccaaagttcacaatgtggccgaggactttgattgcacattgttgtttttttaatagtcattccaaatatgagatgcgttgttacaggaggtcccttgccatcctaaaagccaccccacttttctctaaggagaatggcccagtcctctcccaagtccacacaggggaggtgatagcattgcttcgtgtaaattatgtaatgcaaaatttttttaatctgcgccttatactcttttatt

SEQ ID NO: 3838 - DNA, 256 bp, Homo sapiens
ttctggggagtgttggatccacatcccggtgccggggagggaagcccaacatccccttgtacagatgatcctgaaagtcacttccaagttctccggatattcacaaaactgccttccatggaggtcccctcctctcctagcttcccgcctcttcccctgtgaacacccatctgcagtatcccctgctcctgcccctcctactgcaggtctgggctgccaagcttcttcccccctgacaaacgcccacctgacctga

SEQ ID NO: 3839 - DNA, 256 bp, Homo sapiens
aaacttctcctgccccaggaagttctggtggtgctgagagcacaggacccagccctcacggtcagcatgggcggtttcctccctgtcgtcaccacctatcttcgggtgaccaggagttgccttccttgtgtctccagagggctccagcccctggcgtcagggtcctgtgggcatagctggggtggccctcctgccggtgcaaggctgatgcccgtcaaccttctgaccatcaggagagactagaaaaagagaagaa

SEQ ID NO: 3840 - DNA, 522 bp, Homo sapiens
aaactgctcctgccccaggaagttctggtggtgctgagagcacaggacccagccctcacggtcagcatgggcggtttcctccctgtcgtcaccacctatctccgggtgaccaggagttgccttccttgtgtccccagagggctccagcccctggcgtcagggtcctgtgggcatagctggggtggccctcctgccggtgcaagggctgatgcccgtcaaccttctgaccatcaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagtgcgtgcctggcgccaaagcagggcgggaggagtcgagctgccgggagccctggggaggcaggaccgggagaagcagagctgggcggagtcgtcaagctgctgggagcgctgggctgggagccccaggggaggcaagagctgg

SEQ ID NO: 3841 - DNA, 120 bp, Homo sapiens
ccgctgtccagcctccctggacggccctcgcggtccctgcagcccaagatgggactcagaccctgtgccccagagctcccctgccgcagaatggggccccaagccggccccgaccgggtc

SEQ ID NO: 3842 - DNA, 260 bp, Homo sapiens
  misc_feature 144: n = A,T,C or G
ccgagcaggaattcggtgtggacatagggccggtctgcttcttgtaaaaacctgaacccagaaacaacacaattccgttgcaaaacccaaagggccccaggtacttttccaattttaagtcaactctgggggcttcttcacctnaatgggctgacctcacctgatgtccattcatcccaccctctcacagttcggacttttctcccctctcttttctaagacaccctcaactgggcagactgcaaaataaaatctcggtg

SEQ ID NO: 3843 - DNA, 110 bp, Homo sapiens
  misc_feature 79: n = A,T,C or G
ctcgcaggccgtaggaggaagatggcggtggagtcgcgcgttacccaggaggaaattaagaaggggccagataaacccnttcgaccgcgtagaaggacaatgcccacttt

SEQ ID NO: 3844 - DNA, 263 bp, Homo sapiens
gccatcatgggtcgcatgcatgctcccgggaagggcctgtcccagtcggctttaccctatcgacgcagcgtcccacttggttgaagttgacatctgacgacgtgaaggagcagatttacaaactggccaagaaggggccttactccttcacagatcggtgtaatcctgagagattcacatggtgttgcacaagtacgttttgtgacaggcaataaaattttaagaattcttaagtctaaggagcttgctcctgatcttctgaa

SEQ ID NO: 3845 - DNA, 261 bp, Homo sapiens
ccgaaaggaaagaaggccaagggaaagaaggtggctccggccccagctgtcgtgaagaagcaggaggctaagaaagtggtgaaatccccctgtttgagaaaaaggcctaaagaattttggcattggacaaggacaatccagcccaaaaagagacctcaccccgcttttgtgaaattggccccgctatattaaggttgcagcggcagagagccatcctctataagcggctgatagtgcctcctgcgatttacagttaaccca

SEQ ID NO: 3846 - DNA, 313 bp, Homo sapiens
gtacaagtccagggcaagcagaaacttgctttgcggaaacccctgtggctccgatgatgtcaataatctttttgtataagggggcgaccggggcggttactaccgaatgtttaggcaccagtatctacaagaaaattcaatgtctttacccctaactgttcattctgaacataggctctttcggggtccttgagcccggtccccctcagtccaataacccttctgccaggttgagcaggggccctttctccttgtcttgagactcttgctccgagtcaccttgttttctttttagctgagggaatttgctctt

SEQ ID NO: 3847 - DNA, 235 bp, Homo sapiens
aaactctgccacctgagtggaagagtggagactactggattgacccaaccaaggctgcacttggacgcatgaggttttctgcaacatggagacttggcgagactttcggtttcccaattccagcaaacgttcccaaggaggacttggtggagcagcaagaccaaggagaaggaacacatctggtttgagagaaccattaattggtggctttccattcaagttatgagattacaat

SEQ ID NO: 3848 - DNA, 115 bp, Homo sapiens
cattgatcctaggttcttcctgactgctttctccaactgttcacagcggatgcttggatttatgcagtaggcattactacagtacatggctaatcttccggaaacttagctcatt

SEQ ID NO: 3849 - DNA, 157 bp, Homo sapiens
gaaagaaagctgtgggaccatcctggcaaccccggtgtttgcttggttctagcgtagcgtcttgtgtgccgtggggggacctgcggtcggagttgggaaggccaatctttcaaccaagaagtggaagaggacggacttttaaggccgtaagcgccct

SEQ ID NO: 3850 - DNA, 248 bp, Homo sapiens
cgcaatcctcagcaacatcttaatgcacagccacaagttacaatgcaacagcctgctgttcatgtacaaggtcaggacctttgactgcttccatgttggcatctgtccctcctcaagagcaaaagcaaatgtttgggtgaacggctgtttcctcttattctaagccatgcaccctactctttgcttggaaaaatcataggcatgattgttgatgattgataattcagaactccttcatatgatcgacg

SEQ ID NO: 3851 - DNA, 245 bp, Homo sapiens
ggtccctggtgtgccttggtgtcatcatcttgctgtctgccttctccggacctggtgtcaggggtggtcctatgccaagctggctgaccggaagctgtgtgcggaccaggagtgcagccaccctatctccatggctgtggccctttcaggagctatcatggccccgcacttccgatttctgtaccacttcaccgcggggcagtggtggtatgatgctctccagatgtagggggctcgggcgggct

SEQ ID NO: 3852 - DNA, 229 bp, Homo sapiens
cggaggccaaatgaagtttaatccctttgtgacttcgaccgaaggaagaatcgcaaaggcatttcaatgcacttccacattcgaaggaagatatgtcttccctctttcaaagagctgagacagaaggtacaacggtgcgattcactgcccattcgaaaggattattaaggttagggtgtacggtggacacattataggtcagcaaatttggaaaagaggtcagggttta

SEQ ID NO: 3853 - DNA, 349 bp, Homo sapiens
tttcaaaatcaacaccgatgagattatgacttcactcaagtctgttaatggacacatagacagcctcattagtctgatggttctcgtaaaaaccccgctagacactgcagagacctgaccttctgccatcctgaactcaagagtggagaatactgggttgaccctcaccaaggatgcgcaattggatgctatcaaggtattctgtcatatggccactggggacacatgcataagtgccaatcctttgaatgttcacgcatacactggtggacagattctagtgctgagaagacacacgtttggttttgagagtcatggatggtggtttcagtttagctacggcaatctg

SEQ ID NO: 3854 - DNA, 380 bp, Homo sapiens
agcccaggacgctgattccagcagcgccttaccgcgcagccgaagattcactatggtgaaaatcgccttcaatacccctaccgccgtgcaaaaaggaggaggcgcggcaagacgtggaggccctcctgagccgcacggtcagaactcagatactgaccggcaaggagctccgagttgccacccaggaaaatgagggctcctcttggagatgtatgcttactctcttaggcctttcattcatcttggcaggacttattgttgtggagcctgcatttacatgtacttcatgcccaagagcaccatttaccgtggagagatgtgcttttttgattctgaggatcctgcaaattccttcgtggaggagagcctaacttctgcct

SEQ ID NO: 3855 - DNA, 331 bp, Homo sapiens
ctcgtgccgaattcggcacgagcaagccagcccgggggatacccagccacaggagcagacgtggccttcagtgtcaaccactttgctgcagggacccaaatggccaaatgttggcttattggcctattggcaggcttccatcggcaatcccattgggaagggacaatggtgcacaagggagccttcacccgtttttttgtcttttgagcaaacctcaagtattttttttcctgtggacacagccctacgttgccaagaagctagggcttcctggtcttcccctacacacaaccaaaacctggggaggtgcagtacagtcgtgatgctccty

SEQ ID NO: 3856 - DNA, 243 bp, Homo sapiens
ggcctgtccaaggcttccccaacactcgcagttgaacccgccgttcttcgcgcattgccaccaccacagcccaggcggcggccacttcttgccggccatttggtgccaccccctcgaggccaaggggcaagggcaaaggcacttaaaggggcccagttacccagttagttgggccccaaccctgttgttccccgattgcttgccgttcaccttggtccttccggcttactttgtccctttcag

SEQ ID NO: 3857 - DNA, 225 bp, Homo sapiens
gagaccagtacctgggacacctgcagcagtatgttggccgcctatcagcagctgacctctgagagggaggtgctggcataatcaagctactgcttgcaagacccaagctcgtgggaccaagctgcaagcaagcaggaagcgctcaaggggcaaaggcgggtggcccgcgtatggccccgcccaaaggagtttgcaggaaaccaagggcgcgccttggaaggcttc

SEQ ID NO: 3858 - DNA, 137 bp, Homo sapiens
gcctgcccttccttgatattgcacctcttggacaatcgggtggtgctgaccagggactctctgtagacataggccagtcttggcttcaaataaactgaacttcaatcttaaattgaagcgagggacgggacttttga

SEQ ID NO: 3859 - DNA, 310 bp, Homo sapiens
tcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtggggtacatggtgatggccacaagtcaagaaaggcaaaccagagctcagaaaaaagggtacatccagcagtggtcattcgacaacgaagtcataaccgtagaaaagatggcgtgtttcttattttgagataatgcagggtcatagtgacaataaaggcggatga

SEQ ID NO: 3860 - DNA, 380 bp, Homo sapiens
ctcgtgcgaattcggcacgagccgaaagcgaagaagtagctcctgcccctcctaagctgaagcaaagcgaaggctttaaaggacacgaagggcaggtgttgaaaggtactcacgccccaaaaaagaaggaagatccccacgtcacccaccttccgggcggccgaagacacttcgaacttccgagacagcccaaatattcttcggaagaggcgctcccaggagaaacaagcttgaacctatgctatcatcaagtttccgctgaccactgagtctgccatgaagaggatagaagacaacaacacacttgtgttcattgtggatgttaaagccacaagcaccagattaaacaggctgtgaggagctgtatgacatagatgtgg

SEQ ID NO: 3861 - DNA, 331 bp, Homo sapiens
actcacttccattctttgatttaaagttttataggtagaagagaaagtagatgtttgtaaagggctgtgaagtttccctgtcacacagaaataccccacgggggaggggttgtgggttttccctgttgcttttgtctgctgattttctggaattgagattgtggtccccgtctatgagaagtgtttctactacgaacgctgcacaattggtgaagacagatgtaaaactgcagagttctcacgttgggagcacgatgtccagctctagaaagatgtctatagagccgggcatggaaaagccaaggagacttcaagacacattgagcatcct

SEQ ID NO: 3862 - DNA, 139 bp, Homo sapiens
gatcaattcactcacttccattctttgatttaaagttttataggtagaagagaaagtagatgtttgtaaagggctggaagtttccctgcacacagaatacccacggggagggttgtggtttccctgtgcttttgtctgc

SEQ ID NO: 3863 - DNA, 394 bp, Homo sapiens
ctactgaccgctggccagaaaggtgacagtggtcttccagggcctcctgggctcaggtcacctgtaagtcattcagcctttaccaatcttgtcctccaaaaaaaccgagaagacatactgaaggcatgcaagcagatgcagatgataatattcttgattactcggatggaatggaagaaatatttggttccctcaattccctgatacaagacattgagcatatgacatttccaatgggtactcagaccaatccagcccgcacttgtaaagacctgccaactcagccacatgcaagttttgaataaggatggtatagacacaccgctgcatatacaggtaccatttagggatacgctgcctttgtgggggcagaatcacatggcaaagctttgaa

SEQ ID NO: 3864 - DNA, 225 bp, Homo sapiens
gtggcgcatgcctcattcacgtacattggagagtctacaaagtcacacgtattcataggctaaggcacattctgacacaatgtgcacataggaggacccccatcacatttttatacccttgggcgcgtatctttccctcagatgtcacagcgtctcttgtcacagagatgtgactctagactctatcatcatgatgtccagagatgtgcacacacatctgttgts

SEQ ID NO: 3865 - DNA, 168 bp, Homo sapiens
ctcgtgcgaattcggcacgagaagacaatcattgatcacagacaatagcatacgctgcctcctgataattgaacctgcagacatcggtggtgctgaccaggatttctttgtggacattggcccagtctgtttacattaaatgactctcattctaaatgaaacagggag

SEQ ID NO: 3866 - DNA, 205 bp, Homo sapiens
cttgtgctaagggcacaaaaatgcagacacatacacacgggagtgggtttcagagcgtaagtttataggcacaagcaatgggaggaagagagacaccgcgtttcctattgcagaggagggggattgtccaggcggattctctgggttttggggagagagatgtgtgcccatttatatagagggctctaacgcgagcccgatattt

SEQ ID NO: 3867 - DNA, 530 bp, Homo sapiens
cttgtgctaaggggaacaaaaatgcagacacatacacacggagtgggtttaagagcgtaaagtttaataggcaaaagaaaggagggagagagagagcgcgcttcctcatgcagaggaaggggatgttcaagcggatttctgggtttggggagagatgtggtccattttatagaggggcttaaggaggccgtatttgattcacatagggcccaggagattggattgaccaggtgtcaggtgtgccatttacatagcccgtgaatcttttattatgcaaatggggtttacctggccgttgccatgacacccacacacgggggcgacaaagagaagagaggagatatcctccatgttgaatgtacctggcttctgacatagctgccggcatttacctatgcaaacttctagcttgcttatctatgtttgcagcttgatttctcagggtgctttttgttagaaatgttttaggggctgctttttattaaagaaaaattccactgagaactcctttaacctcactaactgcctaa

SEQ ID NO: 3868 - DNA, 191 bp, Homo sapiens
agatgcaggtctggagatgtatcacggaagaagctttgctctcacactgagcctcctggctactttgggagacaagatcaccccttgccgcccaaggttaagtaagcccaaagcctaaggaaccccttgtccccgcgtcctctctttataaccctctttcccattttgggagcgtatgttttgcccaaaag

SEQ ID NO: 3869 - DNA, 640 bp, Homo sapiens
gagatgccaggtcctaggagatgtatccacggaagaagctttgctctcacactgaagccctccctgggctactttggggagacagtaccaccccctgccgcccaggtgaagtaagcccgaaagcctcaagaaaacccctagtccccggcgtccttctcttgataaccctctttccccatttgggaagcctaagtttagccgaaaagcaactgcaataagtttcccaagggcagataggtgatgttggggggagagggtagggagcacgagagtgccagagaggtcttcagctgcgcacaaaatcagcaagctaaagtgcatcttacttaccaaggatttggtctccgggtttcccatcggcgaactgaaactggtccgtgaagaagtggcaaagtaacataactcctgcagcggccaagtcggccttcgggaacctcgccatgccgccgccgccacctccctaccccacccgccagtccttcgccggtgctcgggggctcccgatgcaataggcacgaccgggccaaacgctgcgggatcggtctcggtaggacccggagggcctttgtaaatgtcgctgcgatttcacagtagggaaccgagaagagggaagaagcgaacgcgagtaggagcgcaacgc

SEQ ID NO: 3870 - DNA, 191 bp, Homo sapiens
aagaacctcccacaaaggttttttgttggttgatttgagcccggatcacttctgaagaacacttacagaatatttgtgaggctttgtgagagatttatcgatatctcagactctcccattggatcacacaccacacatatatcgaggagagggagtttcgtttttatatacatatactctatataagagac

SEQ ID NO: 3871 - DNA, 245 bp, Homo sapiens
ctcgtgcgaattcggcacgagggagaacttgttctacacgcgagctgctttcacagcgcggcacctgtacttcggggtggtacgctgacgtagctctcatagaccacagatactatgtgggggacgtgcagagaaaacgcgcgtgtatatcccaggagcactctcagagcgagggctctcacagaggtgtgtggccccccgcgtgtctctcacagcgcctctgagggggtctctaaaaatatgtg

SEQ ID NO: 3872 - DNA, 147 bp, Homo sapiens
aaagaatcatgctcatgagcatttcctggatcttggagaattcaaaaaggaacagcaaatcaacacaattatcgtacaagatcttcattggagggacttctaggccctcagagagggatagagcacatgtgcgagagagagttttta

SEQ ID NO: 3873 - DNA, 181 bp, Homo sapiens
ctgataatgaggcagagcgggttaaaatgatggaagaagtggaaaaactttgtgatcggcttgaacttgcaagcttacaagtctttgaatttacacaatcacatcatgcacaacagagagtgaggggcagggctgctttttgggaacacagagtatagaggacactacaatttggcgcaat

SEQ ID NO: 3874 - DNA, 192 bp, Homo sapiens
atttaataactgttaaaatgttgtatcttgtaaacaaaagaaagattgcctgctaggatgtgcatcttaaatttgactattgggcatttgcaggacagtaaattctttgttttttggacagagggtctctttaccagtgtctctatctattccttctttaatatccacgggtccctatggtatagggacttt

SEQ ID NO: 3875 - DNA, 370 bp, Homo sapiens
gctgtatgcgccattagtgttgaaggtaataacgaattatttggccatgcagttttaaaccatgtgtgaataacctgctaatcatactttggtttttctgttttgtgctcttgcacgccgaattgtttatggtttttwattygcgggagttttttttgggtgggtccgagaattctcaagccagatttttgttacagcccagggtatgtcacaggcgctgagagactttgagtcacatatatcccacaggttgcgcaatggttctcctcgagagcctagagtatcacacagcactctccagtggctcatgttcctcgcacagcagagtcctgagaagagcctgtgagtcagactccaggaccgggcgtag

SEQ ID NO: 3876 - DNA, 270 bp, Homo sapiens
atttaacatggtgctgagctagccaggactgatggagccccttggggtgtggtatggagaggtctcagcagtcattcccagggccccatcttgatgggccaagggctaaacatgcatgtgtcagtggctttggagcaggttaggctggggctcatcgagggttctcaggccgaggccacttcggtgccagtgcccccctgaggtatacggcagtcagctggggccactgggtccatggagcctggataaacagtgctcttgaggctctgg

SEQ ID NO: 3877 - DNA, 248 bp, Homo sapiens
caaagatgtaattatcacaaaccgttcatcttgggatgacagataacctagctctgaccctagttgagatagaggactctacctaggagacaacttggtaaagcctaaggctatgtggtaccaggcattctaggtgtctgggtgaccaggctgtctttcttccccactgggcctcaatttcctctatatcaagtacacaggacttggctctaaataagtttcccgagtattgtctcttctagacacat

SEQ ID NO: 3878 - DNA, 129 bp, Homo sapiens
attcactggataattgtttttatattaagtcggtcagaggccaaactgaggctggacctgcattcaggctggacttggattttggttaggttttcggaggattcaacaataccgctttccttgaaccga

SEQ ID NO: 3879 - DNA, 570 bp, Homo sapiens
attcactggataattgtttttatattaagtgggtgagaggccaaactgaggctggaccctgcatctcagggctggagcctggactgtggcttaagtttctagaggtatcatcaatacccctttcctgcagccagagagaccacaggtccaacaacaggaataccacctacaaaggaatctatgggctcacatagtgaggctgtgtaacaagaaggggagagcaataaattatctacccattagaaacaggaagggagacagtgtgtgatagccaaaaagcagaacagaaagaacagctgagaaggcctgagaaccaagtgaatggcctggaggaaggatgggggcaagcaatgtggatagctggactcaggggggttgaccatttaatattgtaaactgctgaaacacaagggctcagggaactctgattatttttgtaggcaagcaaatatactgcatgaacaaagaatagttcctgtattaatttgaatttaaaatgtaattcctaggtaacaatataggaattctgtggatcctcatgaactagtttctgtatcaagtttgactaca

SEQ ID NO: 3880 - DNA, 135 bp, Homo sapiens
aacccgatatggctgagatcgagaaattcgataagtcgaactgaagaagacagacacgcagatgaaatccatgcttccaaggaacacgttgaaccagagagagcgcagcgcagcagatcgtattaagaggctcgc

SEQ ID NO: 3881 - DNA, 278 bp, Homo sapiens
agcggtgtaatgattgagccttttggcctggcttgtttgcaaaggccttggcaacgtcacattggagctatcttcaattgagggggccgttggacctcttccagcagctggtgctccaccaccagagaggtcctcccccttcacactgctgttctctccacttagaggagaggagtgtggagccagagagagaagattccgaggagtctcatgatgacatgggtctcgggtctgtgaactacacctctcatatacatgytacactaagcgctgcatct

SEQ ID NO: 3882 - DNA, 190 bp, Homo sapiens
cttattcgcagaatgggggtttattaagttgttaagaataggcctactttaagagatacagtaaattgagacggcgagaaggtaaaacctattattattctccgcaccgtttgtgataccaggtaaacataaataccacacacacccattcacagttgtaggttcgtgttgccacagagatatccttgtc

SEQ ID NO: 3883 - DNA, 145 bp, Homo sapiens
gcgtggaggatgagctgagggaaatagcctcagagcctttgcagagcactacttctacacggctgacttcaggaccatcaaccagataggcaagaaggttgcagaaggaagatctttgtggaggaggaccgtgtgcctccgagtc

SEQ ID NO: 3884 - DNA, 113 bp, Homo sapiens
ccggtgggggttgaggcagaggagttcgaggatgctcctgatgtggagccgctggagcctacacttagcaacatcatcgagcagcgcagccttcaaggtggatcttcgtcggg

SEQ ID NO: 3885 - DNA, 185 bp, Homo sapiens
accccgcccgcacctgccgtgacctcaagatgtgccactctgactggtggagttggagagtactggattgacccaaccaaggctgcaacctggatgccataaagttttctgcaacatggagactggtaggacctgcgtgtaccccactcagcccagtgtggcccagaggaactggtacatcagca

SEQ ID NO: 3886 - DNA, 159 bp, Homo sapiens
cagctacaggccaaacccagaccagaggaggcctcagtttacacttcagccactgcctgtgaccctatcagagaaggcagtggcaaccaatatttcttagggtccaagggcttctggagaattgagacagttttcccagtccttagacatggcttcagg

SEQ ID NO: 3887 - DNA, 140 bp, Homo sapiens
ctccacgcagcgcgcttcgctcgcgagctccaccgagagaagggggtagtaggaggtttgtaccatggctcgtacaaggagactgcccccaatcgcccgtggtaaagcacccaggagcactgctacaaagccgctcgcag

SEQ ID NO: 3888 - DNA, 187 bp, Homo sapiens
ccgcgccggtgagtagcactctctgagagctccaatttcatccgtctgccatcggcacccatcctgcaatctaagccacaatggtgcgcatgaatgtcctggcagatgctctcaagagtatcaacaatgccgcagagagaggcaaacgccaggtgcttaattaggccgtgctccaaagtcatcgtcc

SEQ ID NO: 3889 - DNA, 192 bp, Homo sapiens
accagacttcgctcgtactcgtgcgcctcgcttcgcttttcctccgcaaccatgtctgacaaacccgatatggctgagatcgagaaattcgataagtcgaaacttaggaagacagacacgcaagagaaaaatccacttccttccaaagaaacgatttaacaggagaagcaagcaggcgaatcgttatgaggc

SEQ ID NO: 3890 - DNA, 168 bp, Homo sapiens
ctgcctcagcctcccaagtagctgggattacaaacatgtgccaccaagcctgattaattttgtatttttagtagaggtgggttttcaccatgttagttaggctggtttcgaacttctgacctcaggtgatccactgtctttgcctcccaaagtgctggcattacaggt

SEQ ID NO: 3891 - DNA, 208 bp, Homo sapiens
gaagactgaccaacttccctttgaaaagcctattaaaagctccagattctcaaaccagaggctaagatgaatgaggggtttgagtggcaactgaaattataccaggcaatgggatacgaggggatacctctagtgcaatttataagcaatatcgtttacaaaaggttacagagaagtatccagatttgcagagtttacctcaaggact

SEQ ID NO: 3892 - DNA, 242 bp, Homo sapiens
ggcaagatgaaagtcctcaagttttgcctgcaagtacaaaaagaaggatcccaaggaatgggcagctcagtaccgagaggcgatggaagcggatttgaaggctgcagctgaggctcagttggaaagccaaggctagggccgagattagagctcgaatgggcatttggctcggctcggagaatgctgccgggccctccaacctgggacgagcttatatcggaccctggcccaaagccggatcc

SEQ ID NO: 3893 - DNA, 241 bp, Homo sapiens
ttcctttcaaccacgtgtgccctagggagcagacaacatggcgctgggcaagtggaaagcccacttgcgtaataagatgagggtggggtggccagcttcccccatgctatgtaaacgtcacacctggttcactgatctttggatctatgtaaatcagacacacctctcaaacctgtctataaatccggtgcactctgtcgcaggccagaggtcacatttggggttccctctctgtcgcagg

SEQ ID NO: 3894 - DNA, 130 bp, Homo sapiens
cagcagcattaacatcaactgggattttcttagacatgcagaatatcaggccccacaagagtcctgctagatcagaacctgtgtttttcacaagaaccccagctcatttatgtgcacattaatgtttgac

SEQ ID NO: 3895 - DNA, 179 bp, Homo sapiens
cagcagcattaacatcaactgggattttgttagaaatgcagaatatcaggccccacaagagtcctgctagatcagaacctgtgtttttcacaagaaccccagctcatttatgtgcacattaatgtttgaaaaacactgatctagaaaacaagtgcctgcctgcctgatttttttttttt

SEQ ID NO: 3896 - DNA, 144 bp, Homo sapiens
tccatttcacagaggaggacaaggctactatcacaagcctgttgggcaaggtgaatgtgggaggatgctggaggagaaaccctgggaaggctcctcggttgtctacccatggacccagaggttctttgacagctttggcaccct

SEQ ID NO: 3897 - DNA, 221 bp, Homo sapiens
ccttaagctgatggggtcaaatgaaggtgaattcaaggctgaaggaaatagcaaattcacctacacagttctggaggatggttgcacgacacacacttggggattggagcaaaacagtctttgaatatcggacacgcaaggctgtgagactacctattgtagatattgcaccctatgacattggtgggtccccatcaagaatttggtgtggacgttggccc

SEQ ID NO: 3898 - DNA, 200 bp, Homo sapiens
tgcatatctgcttctgtgtttttctgtaattacagttctcctgtgacccaagtctgtgctttgccttgtcctgtgtctggtgcactttcccttggccctcggtggtctcaggctccagcatttggtaacggcccctgttccagggtgctgtgctgatggcgcaagtggccccctttaggggaatccctccatgtctaact

SEQ ID NO: 3899 - DNA, 450 bp, Homo sapiens
tgcatatctgcttctgtgtttttctgtaattacagttctcctgtgacccaagtctgtgctttgccttgtcctgtgtctggtgcactttcccttggccctcggtggtctcaggctccagcatttggtaacggcccctgtgccagggtgctgtgctgatggcgacaagtggccccctgtaggtgaatgccttcatgtctaactgtgtgtgtgtctggtgggttgagcattttcaaggctttgatacatatcaccttccaccaagattacacttttaaaaccattgccaaaatacgacttttgggaatggataccattctaaaggaagaaaatcgtgtctagttttaagttgcatttctttgagtgaaattagacctcgttcatgcggatgttggctatttattctcgccaactgtgcctaattgtataagcgcgttcttgtttttttccttt

SEQ ID NO: 3900 - DNA, 168 bp, Homo sapiens
ggaaggcattccccccgaccagcagaggctcatctttgcaggcaagcagctggaagatggccgtactctttctgactacaacatccagaaggagtcgaccctccacctggtcctccgtctaagaggtggtatcagattcttcgtgaagaccctacccgccaagcccat

SEQ ID NO: 3901 - DNA, 130 bp, Homo sapiens
ataagattcaccaatccctacatttggctacttgaactctattaataatggtagtattatatatacacggccaatactctattctcaagtgggtaaggccactgcacttattttatgcacaggcctttca

SEQ ID NO: 3902 - DNA, 550 bp, Homo sapiens
ataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaa

SEQ ID NO: 3903 - DNA, 200 bp, Homo sapiens
cgctctcttgcccaggctggagtgcaatggcacgttctcagctcacggcaacctccgcctcttgggttcaagcaattctgctgcatcagcctcccgagtacctgggtttcacaggcatgtccccaccacgcccggctaattttgtatttttagtagagacggggttttcccatgttgcgccaggctggctctcgaactct

SEQ ID NO: 3904 - DNA, 105 bp, Homo sapiens
taatgatcaggattgagattaatactgtagtataaattgggacattataccagattccatattttatttcctaaaatctaaattcagtctataatgaaataatat

SEQ ID NO: 3905 - DNA, 121 bp, Homo sapiens
ggaattacaccattcagtcttaaattttggcccatgaggggaggaaattttggaggaagaggctctggccccaatggcgtgtggaggccattacttctgcaaaaccacgaaccaacggtgg

SEQ ID NO: 3906 - DNA, 285 bp, Homo sapiens
cggcacgagcagaacatgatcaagggtgttacactgggcttccgttacagatgaggtctgtgtatgctcacttccccatcaacgttgttatccaggagaatgggtctcttgttgaaatccgaaatttcttgggtgaaaaatatatccgcaggtttcggatgagaccaggtgttgcttgttcagtatctcaggcccagaaagatgaattattccttgaggaattgacattagcttgtttcaaattcagcggctttgattcagcaagccacacagttaaaacaggat

SEQ ID NO: 3907 - DNA, 265 bp, Homo sapiens
ctcacagaaagttctccgctcccagacatgggtccctcggcttcctgcctcggaagcgcacagcaggcatcgtggggaaggtgaagagcttccctaaggatgacccgtccaagccggtcacctcacagcctttctgggatacaaggctggcatgactcacatcgtgcgggaagtcgacaggccgggatccaaggtgaacaagaaggaggtggtggaggctgtgaccattgtagagacacaccatggtgtttgtggcattttgggc

SEQ ID NO: 3908 - DNA, 400 bp, Homo sapiens
aggtcgacactagtggatccaaagaattcggcacgagtgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagacagcattgcatacatggatgaggagactggcaacctgaaaaggctgtcattctacagggctctaatgatgttgaacttgttgctgagggcacaacrggttcacttacactgtcttgtgatggctg

SEQ ID NO: 3909 - DNA, 315 bp, Homo sapiens
ctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtagggaggttcccacctataaacttataaccccagctgtggtctctgagagactgaggttcggggctccctggccagggcagcccttcagggctccttaggtaag

SEQ ID NO: 3910 - DNA, 285 bp, Homo sapiens
ctcgtccaaatttcggcaggggggggacatataaaggcagctgtgtctggtgtgctgtcttttcagactcacttgataatgctagtgtcagtttcaactgaagcgtgttccagattccagacagcttgagctggcatttcagagaggttaattgtgaacttgaggaggaaattggcacattctctctaagatggctattcaaatatagtctctctcctccccccagagctttctggggctcagctcacttttgtctgctccacgtaaatgcatagggacactgcg

SEQ ID NO: 3911 - DNA, 580 bp, Homo sapiens
ctcgtgccgaattcggcacgaggggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctcccccccagagctttctgggtctcagtctcacttttgttctgcttccacgtaaaatgcatgaggaacactgagccttttccccttggcagctcctatattgccatctttgctgggactgctttgccttgttaaaatgtgccccgtgtattaaaatggaattgtcactgctgggtggtgcagcgtaacatggtttgacactaagcgccggcagctacagaaaacagacttttattgcatttaatccttcagagacgggagtctctaaaggctcacagcagacattcacttagttaaatctgaatgaacccaaaagtgaacaatctactctgctgtctttgtgttcatagaaacagcccccatc

SEQ ID NO: 3912 - DNA, 245 bp, Homo sapiens
agcagtggcatttaaagacagggagaaatcccatgccatttagggctttgtgtctgaaaggcatacgcctccgttctgtggccatttgcacttacacagaagccctcactttcctctaatgaactctactcattatccaagtggataagccatcgttcgatcagcagatgtttcccgagcacctactggatgtcagctttctgcaggcatttcaggcacaacttttaagtaaacatatggggctt

SEQ ID NO: 3913 - DNA, 250 bp, Homo sapiens
aaaaagcttggaactccatcacgtggaaaaactagatcctgttggttatagcatttgtgagttctccacgtctgtctctctcgctcatgtaatatactctgacccccagtggaaggggtttttgttctgtttttattttacctacatgtactatttagcttcagtgtactagtcctgccacctgtgtattttgagggtgctatggaaataatgaaaagaaacggggatttcagaagaaattgtcaccaat

SEQ ID NO: 3914 - DNA, 215 bp, Homo sapiens
ttgttcgtgttacccagaggagtcgcttggtgatttgggagctcaaccctggttcagtgctcttcttcatcaagtggtcttggaggagggaggttgccagcattgtgcaggatacacaccccggcaggcacattcctccttattttgtggctttggtgccacaggaaggaagagttggatgaccacgacaattcaggtactcctccaggcttcca

SEQ ID NO: 3915 - DNA, 186 bp, Homo sapiens
tcatgatccgcctgcctcagcctcccaaagtgctgggattacaggcatgagccaccgcgcttggacaactttgtcttcttaattgcataagattgtcttttaaacatgaaaatggaggtcaacataataaaactgcaattcatattttcccaatgtgtgttctgaggagacacggtaaactagaga

SEQ ID NO: 3916 - DNA, 361 bp, Homo sapiens
aaacatcccagccaagaactggtattaggagctccaaggacaagaaacacgtctggctaggagaaactatcaatgctggcagccagtttgaatataatgtagaaggagtgacttccaaggaaatggctacccaacttgccttcatgcgccttctggccaactatgcctctcagaacatcacctaccactgcagagcagcattcatacatggatgaggagactggcaacctgaaaaaggctgtcattctacagggctctaatgatgttgaactcgttgctgaggcacagcaggttcactacactgttcttgtagatggctgctctaaaagacaaatgaatggggaagacaatcattgataca

SEQ ID NO: 3917 - DNA, 117 bp, Homo sapiens
tgatgggtggggtggggagggaatcactggtgctatagaaattgagatgcccccccaggccagcaaatgttcctttttgttcaaagtctatttttattccttgatatttttctgtct

SEQ ID NO: 3918 - DNA, 227 bp, Homo sapiens
attccatgaaaaaggaattgtgtggacaagtaacctgttggaacacagcatttcattttatattcatctcttggagatccacagcacacattagcacttttatgactggtaagtcctgcatgcctcattaacattgtttaattcagcatttgtaaattaactctaatatggtatttttaaaatagggacatgtgaggagtatgcttctcgagatatcgtgagcacay

SEQ ID NO: 3919 - DNA, 284 bp, Homo sapiens
tgacggacctacgacacgagaacatgctctcgcaaaggatctccttcatcctctccagaagaggagaagaggaaacacaagaagaaacgcctggtgcagagccccaattcctacttcatggatgtgaaatgcccaggatgctataaaatcaccacggtctttagccatgcacacacggtagttttgtgtgttggctgctccactgtcctctgccagcctacaggaggagaagcaaggcttacagagggatgttccttcagagggagcagcactaaaagcactct

SEQ ID NO: 3920 - DNA, 232 bp, Homo sapiens
ggtgaaaagaaggcacggaaggctatttcaaactgggtcttcggcaggttacaggagttactagagtcactatccggaaatctaaggatatcctctctgtcatcacaaaaccagatgtctacaagagccctgcttcagatactcacatagtttttgggggaggccaagatcgagatttatcccagcaagcacaactagcagctgctgagaaattcaaagttcaaggtgagct

SEQ ID NO: 3921 - DNA, 130 bp, Homo sapiens
acaggttctaggactgtagcaggaactgaccaaaacaacatgtaaatcaaagagattttaaacatatgagaagttagaacactcacatgcaaacaaattttactggtatgtcaattcttccagagaaaca

SEQ ID NO: 3922 - DNA, 534 bp, Homo sapiens
acaggttctaggactgtagcaggaactgaccaaaacaacatgtaaatcaaagagatttttaaacatatgagaagttagaacactcacatgcaaacaaattttactggtatgtcaattcttccagagaaacaaaaaaaaaaattaacttcttaactgagggaaagaatgtgtgtttgttcattgatgatttggccaaactataggcatggtgagtctcaggcttagctgttgaactatcttgagtaggttaaagaagtcaacatgaaattctattatgtttttaactaatgaattctgatatggaaaactgcactggaaaacattttaatgcatttatctcacatatacttagaaattgtcttaaaagatacaattactctgtacttctgaatattagcgcttattacatataagtaaacatggatacaagagacagttcatatgtttgataccgacataaaaaagtaatcattgaagtggactatgttcatcttgccaagaactcatctatacacagagtttgagacctctgtc

SEQ ID NO: 3923 - DNA, 280 bp, Homo sapiens
gttcgacaagtcagccgcatcttcttttgcgtcgccagccgagccacatcgctgagacaccatggggaaggtgaaggtcggagtcaacggatttggtcgtattgggcgcctggtcaccagggctgcttttaactctggtaaagtggatattgttgccatcaatgaccccttcattgacctcacctacatggtttacatgttccaatatgattccacccatggcaaattccatggcaccgtaaggctgaggacggggagcttgtcatcaatggaatcccat

SEQ ID NO: 3924 - DNA, 338 bp, Homo sapiens
gcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatctccgatgtgcagcccaagctctgggcccgctacgcatttggccaagagacgaatgtccctttgaacaacttcagtgctgatcaggtaaccagagccctggagaacgttctaagtggtaaagcctgagcctccactgaggattaa

SEQ ID NO: 3925 - DNA, 334 bp, Homo sapiens
gatgatggcggccggcgcggccttagcccctggccttgttggctactaatgccaccagttggaggttgggaggggcgggggccccgccaaattccaggacggttgagttcacgttccttttgccggcggggaggaagcagttttttctaccagttccgcgccggcccaacgcaagcctcgagaccatattaccaggtgatcggaggtgctggactggacgtggactcacgttggagaacctcaggcgtgctgttggtcagcaagtccgcaggcttatggggacaaacggtgagcaacgaggccgggactcagttttctttacactcttagacat

SEQ ID NO: 3926 - DNA, 280 bp, Homo sapiens
ggaaagttcccttccctgctcacacacaacgacaacatggtggccaaaggtggatgaggtgaggtccacactcaggttccacattgaggagggtgttatgtctggctgtagctgttggtcacgtgaggatgacagacgatgagcttgtgtatacattcacctggctgtcacttctggtgtcattgctcaggaaaactggcagatgtccggccttatatatcaggagcacatgggcaggcccagcgctatattaggcacatttgataattctatacagtaa

SEQ ID NO: 3927 - DNA, 253 bp, Homo sapiens
ttagaggtgtctgattattggccgaatccttctgctgtggctataagctacctggccactgacataggtactatgcaggacagaattaccactaccacgaggggatctatcactctgaacaggctatctatgtgcctcctgatgccttagctacccctccccttctactacggttcccattttggtgctacctctgactttcgggtgcattctgacctggcatctatcacctgtggagctctaggctcactct

SEQ ID NO: 3928 - DNA, 386 bp, Homo sapiens
gtggaagtgacatcgtctttaaaccctgcgtgggcaatccctgacgcaccgccgtgatgcccagggaagacagggcgacctgggaagtccaactacttccttaagatcatccaactattggatgattatccgaaatgtttcattgtgggagcagacaatgtgggctccaagcagatgcagcagatccgcatgtccctcggcgggaaggctgtggtgctgatgggccagaccaccatgatgcgcaggccatccgagggcactggaaacaacccagctctggagaactctgcctcatatccggggatgtggcttgtgtcaccaggaggcctattagatcaggacatgtgctggccataagggcactgctgccgtctggtccatcccca

SEQ ID NO: 3929 - DNA, 280 bp, Homo sapiens
ccggcacgagcggcacgagggacgtgggacccactcatggttcatgaggaagagaaggcaggacccgcaactgattgaaaaggagggcttgttcagtgtggaggaggattcagaaggggggattaggttaccatctcccagcctgcaggaccaaaaaacaaaaggcaggaattaaatcaggtttcactgctatttatatattgtcccttccccaaatgatttttctaagctgggagtggagcaggagggagaacagcaggtgagcagggaggctctttag

SEQ ID NO: 3930 - DNA, 307 bp, Homo sapiens
gttttcttcctccttcttcatccgataatattcatcaatggcatattggtactttggggtgctgatacccaaaacagatgcatcttctctccaaggaagtcacacactgagagagttgatgtagcagcccgaagcatgtaaaaccataagtagggaccccaggtaagttttgtcggatcaacagtaggcaaaacatctttccttctccaggccatcaacttcgtcttcaactgtctatatcctcccattgttcacactaacaaagtggatgactctctggggcttctctttttctatgctccagtct

SEQ ID NO: 3931 - DNA, 274 bp, Homo sapiens
gtccgccaagctacttctaccgccagcaccttcgtgaagcccattttcagtcgggacatgaacgaggccaagcggagggtgcgcgactctaccgcgcctggtatcgggaggtgccgaacactgtgaaccaattccagctggacataactgtgaaaatgggacgggataaagtccgagaaatgtttatgaggatgcccatgtaacagacccagggtggttgatctctggtcattaagggaaaggtcgactggagaacattaagtatggagcagcg

SEQ ID NO: 3932 - DNA, 325 bp, Homo sapiens
tatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacacctttcctgggcaacccccaccatgaacctgtcagcctctttcccatagctaatagacatttcccaggccttgaggggccccaccctgtctctttatcaaacctgatggtccaggctgggcatcctctcctcctccatcccagcaatcaccaggtctatgtt

SEQ ID NO: 3933 - DNA, 220 bp, Homo sapiens
ttacttgcgaggaatgaagacttatttcttcagcaaatcagacttgtcggaccattcccagaaaaaatgtcgacatttactctgaaggggacgcacagtttatctgtgaagggcccccagaggaacccttgcgggaggggacttcaatcacatcaatgtagactcagccttcttggaagaaaaaaaagaggctccgggttgacaaatggtggggtacaga

SEQ ID NO: 3934 - DNA, 235 bp, Homo sapiens
tccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagacctcaagacactcctgctttatacagaacaaaaagagcttaacaggaccaaccagggcttagccagacttg

SEQ ID NO: 3935 - DNA, 232 bp, Homo sapiens
gcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaccatcaattgatatt

SEQ ID NO: 3936 - DNA, 220 bp, Homo sapiens
aagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaacatgaacttttttgagtaataaaattgaaaagacgctga

SEQ ID NO: 3937 - DNA, 134 bp, Homo sapiens
ctcgtccaatttcgggcaggtttggtttatcttttgttcattgtaaaggaactatgtgggatgcatttggtgatctttttaaaaaatgtataaatttcttgagtaattcctggattaaagaatatgcacttttt

SEQ ID NO: 3938 - DNA, 237 bp, Homo sapiens
gccgccgtcgctctccaacgccagcgccgcctctcgctcgccgagctccagccgaagagaaggggggtaagtaaggaggtctctgtaccatggctcgtacaaagcagactgcccgcaaatcgaccggtggtaaagcacccaggaggcaacttgctacaaaagccgctcgcaagagttcgccctctactggaggggtgaggaacctcatcgttacaggcctggtactgtgggcgctcg

SEQ ID NO: 3939 - DNA, 230 bp, Homo sapiens
caattcaggtgctaggggttattccgccccttaagtagatctgaggcagacccttggggttgtaaaagagagtcacaggtaccccaaggagtagatgccagggtcctaagttgaaaatgatgtcgattgggggcggggaacactgtatttgatatttgtgatcagtgatcattgttcaactgcgaaatagagtgtttgcttttgataatggaaaattgtattcgtttgaa

SEQ ID NO: 3940 - DNA, 200 bp, Homo sapiens
caagaccaccctggccaacatggtgaaaccagtctctactaaaaatacaaaaattggctgggcatggtcacgtgggcctgtagtcccagctacttgggaggctgagataggagaatctcttgaacccaggaggtggaggttgcagtcagccgagattccaccactgcactcagcctggtgacagaatgagactctctctc

SEQ ID NO: 3941 - DNA, 226 bp, Homo sapiens
tgacaatatacaaataacttgttttcctgaacatgctacatcggagtccctaaatttggtattgagcgcccctacacagatgcagcacctggagtgattagtgcccaagtaagatttagccatttaaggttcagaatgtcctctctttatagaatcaggtgaattaatacccacttgactctatgatttgagtcatattggctaatgctatatggacaggtctatc

SEQ ID NO: 3942 - DNA, 506 bp, Homo sapiens
tgacaatatacaaataacttgttttcctgaacatgctacatcggagtccctaaatttggtattgagcgcccctacacagatgcagcacctggagtgattagtgcccaagtaagatttagccatttaaggttcagaatgtcctctctttatagaatcaggtgaattaataaccaattgactctatgattttagtcatattggctaatgctatatggacaggtctatcataggaaggcaagggagttgacaactactttaagaaatatttacaaaccattctacagtttcttcatagggcatatgggagcctgatgcttcttaccagaaataggtgaataaaataggactcagatagatgttcatataggtttttagaaaagaaatagtctttgcccagagagcagaaaagattacaaataaattaagactacagataaagccctttttaggattatgcaggaaccatggacaagaatctgagaccatactttagtcctatacaattt

SEQ ID NO: 3943 - DNA, 262 bp, Homo sapiens
ggagaaagagaacttagtcttcgagttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctatataaagtagagcacacacattgaaagcttctgatcaacggtc

SEQ ID NO: 3944 - DNA, 205 bp, Homo sapiens
gggaatccctcacctggtgactcatgatgctcgaaccatccgctaccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccacagggaagacatcctggt

SEQ ID NO: 3945 - DNA, 209 bp, Homo sapiens
ctcgtccaatttcggcaggggccgaggagcagtgtcaggagttgatggaggctcttcgtcgggccagctacgagttcatgcggagaagcctcatcttctacaggacgaaatccggaaggtgacgggcaaggacccctggacagttcggcatattcgaggaggccaggttccagctgagttgctttcaggcgttacccagggcacggttg

SEQ ID NO: 3946 - DNA, 157 bp, Homo sapiens
  misc_feature 17: n = A,T,C or G
ccggggagcggagtccngcccgccgccgccatgccggacagcttgtacaaggatgtgtaccctgagcccccgcgccgcacgccggtcagcccaatcccatcgtctacataatgaaagcgttcgacctcatcgtggaccgaccgtgaccctcgtgaga

SEQ ID NO: 3947 - DNA, 117 bp, Homo sapiens
catcaacattcacaagcgcatccatggagtgggcttcaagaagcgtgcacctcgggcactcaaagagattcggaaatttcccatgtaaggagatgggactcacgatgtgcgcattga

SEQ ID NO: 3948 - DNA, 174 bp, Homo sapiens
cttggtcagagtgggcagtccaggctctgctttgggttgtgagtggacacccaactgggcacaggctcaggcacccatcctttttccaaacagggatatagaagtggtggaagcagacagaagaggtaagggagtctatgtgggtaacacccagcatcagggtcactgtcgcac

SEQ ID NO: 3949 - DNA, 133 bp, Homo sapiens
gtggtgacgagcggagtcctttgaggctggagtacaatgatgtgatctcggctcactgcaacctcccactcccgggttcaagcgattctcctgtctcggcctcctgagtagctgggattacaggcgccgacca

SEQ ID NO: 3950 - DNA, 215 bp, Homo sapiens
gatttcttagggtctaagcttataagataaattccttcacattctttgagtgaaagggagccacaaaaccagcgcagactcatgggaagggaaatagattccactctcttgatgggagaggtgggatgcatgcacaaaaatgaggggatttttaatggtggccacatttagagacgctatgacattatccaaattattcattattgcggtgagct

SEQ ID NO: 3951 - DNA, 610 bp, Homo sapiens
  misc_feature 253: n = A,T,C or G
gatttcttagggtctaagcttataagataaattccttcacattctttgagtgaaagggagccacaaaaccagcgcagactcatgggaagggaaatagattccactctcttgatgggagaggtgggatgcatgcacaaaaatgaggggattgttaatggtggccacatttagagacgctatgacattatccaaattattcattatttcgtttagctttttctccttttaaagaagtattttgaatattgtttantattattattacctctaaagtggttttgtgtttttaaatggctccatatcacttttttgtggttattcaataatttaattaattatgccctaatttatggatatgtaggttgttttccatttggggctattccaaacaatgatgggaagaatacctttgtatatatgtttatagggaaacatatatacatcaatttgctgcatcaaaagatgtaagcaatttttaacattgatagatattgttaaattacccttcctctaacaatgcatgagtactttgtctatatgcctttgaaagcacagtgtatcacagaaattctacgtcctttctcataagaatactgctgtattacagttt

SEQ ID NO: 3952 - DNA, 188 bp, Homo sapiens
gaaagacaatcattgaatacaaaacaaataagccatcacgcctgcccttccttgatattgcacctttggacatcggtggtgctgaccaggaattctttgtggacattggcccagtctgtttacaaataaatgaactcaatctaaattaaaagagagagatatttgaaaacactttctctttcgccatt

SEQ ID NO: 3953 - DNA, 244 bp, Homo sapiens
ctcgtccgaaaaaaataggggacagaaatcaggtattcgcagtttttccattttcatttgtgtgtgaatttttaatataaatgcggagacgtaaagcattaatgcaagttaaaatgtttcagtgaacaagtttcagcggttcaactttataataattataaatccacctgttaaatttttctggacaatgccagcctttggtttttttaaaacaagtaaatttcttattgatggcaactaaatg

SEQ ID NO: 3954 - DNA, 352 bp, Homo sapiens
cggcacgagccagcacaaagttgcattcctcccccctaatttattctaatttattaactttgacccaccctttctgagcctgcagccttcccgtgtggcctgagggctgtcgagtgagctgccccagcccctcccagcccttgcccagccttggggagtggggaaggctttggcatggcccgttggaggttgatttgctgttttgtttcttgtctttgtgtctgtggacttgctgagagaaagaaagtagcaagcagaaggaggtggaaacggaccaaacccagtgtgcctgcccatgctttctttagtggtggaaccctatgtgcaagtaattttccctcccacctctgtg

SEQ ID NO: 3955 - DNA, 310 bp, Homo sapiens
ctggcctcttgcacaggcacttgtccctcaacacactgagctccccactttcccatgcaagtttcctgatgattacaaagagatgcaggacctatgggcttagggtctgtgacaaaactaccaggcttgggtaaagttccagcaaacagccccaccgtgcgcttcatcatttcataaatgcgtatcagtccagatgctaaattctgaaactggagaggaaagagggataaccaacttaaaaaacaaaagcagttctagcatgccttttagcacatacttactgattatgtgccaaaaaatatgctgtgga

SEQ ID NO: 3956 - DNA, 255 bp, Homo sapiens
cttgcagtatgatagtggcatgatatctgggaggagaaatttggaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggggcagtatttttccttaagacctcccctaaggcgaaagctatgg

SEQ ID NO: 3957 - DNA, 350 bp, Homo sapiens
tcaacatttaattgaatcgtgtatcctgataggtggattaggaacaggattcattcctttaactttaacttttggctaaacgacatgccttggattgagtgtatatgtcttccccaaattcatatgttgaagcttaaatcctgaatgtgatggttcttggaattgggccctttggaaggttattgggtcttgagggcagaccttcacgaatgggattaaggcccttataagaagagacatggggccaggtgcagtggctcacacctgtaatcccaacattttgggaggccgagaagggtggatcatgaggtcaggagatggagacctcctggccacatggtgaacctcgt

SEQ ID NO: 3958 - DNA, 102 bp, Homo sapiens
atatgtcgaagcgaggacgtggtgggtcctctggtgcgatattccggatttccttgggtcttccgtagagctgtaatcaattgtgctgacaacacaggagcc

SEQ ID NO: 3959 - DNA, 270 bp, Homo sapiens
gctcggtccttccgaggaagctaaggctgcgttggggtgaggtcctcacttcatccggcgactagcaccgcgtcccggcagcgcaagctcctacactcgcccgcgccatggcctctgtctccgagctcgcctgcatctactcggccctcattctgcacgacgatgaggtgacaatcacgggggataagatcaatgccctcattaaagcagccggtgtaaatgttgagcctgtctggcctggcttgtttgaaaggccctcgccaacgtaaa

SEQ ID NO: 3960 - DNA, 180 bp, Homo sapiens
ttactacatgctgggagacggcatccaagaggaaaaagattatgagcctcacacaatttgtgagcatctccagtacttgtttgccttgttgcaaaacagtaataggcgatacattgatccatcaggatttgttaaagccttgggcctggacactggacaacagcaggatgctcaagaatt

SEQ ID NO: 3961 - DNA, 220 bp, Homo sapiens
agatgctctccccggtcttctgctgcaatttagattcctttcccttctctccagttctccttcccttaccaaggagaggggagcaaatggttttgggcaaggtytttggccattcatgtcaagctggttgtgggtttttcaaggccccatacccaacccaaatatgttttttaagagcgtggggttttttaatctctcccacccttgtcaagggtgtttt

SEQ ID NO: 3962 - DNA, 172 bp, Homo sapiens
ccttgatcagtgtccatccggctaatttgcatcatgaactgaacagtgtgtgagttggtcacctactaaacccagctcttgggggcagactgtcttccccaactcttggtgtcccaaacaccgtgagatggtgcctcgtcgagaggataggaaccccatagagagagtttct

SEQ ID NO: 3963 - DNA, 226 bp, Homo sapiens
aggtcagggatcagtgaattgttttcattgaaagtctaaaactgtttgtgttactaaaataatggaaaaattttagagggtgatgtaagaattcatttgtaggctgctgtgtacagagtgtcagttgaagtgaggatagacgtcggagacacgttaacgttggggtgggattttactaccaacgtcttacgctgatactcgtacaccggggggtggggtacccgtg

SEQ ID NO: 3964 - DNA, 288 bp, Homo sapiens
tgtgttggcgagtgagatggtgtttcaaaaaggtatggtggtaaatttgttaagtcaaggttaaaagggagtaaaatttgtggcaatgaaccatgcaggtttgagtgaagttgttcctggggacaatgtggggttaactgtcaagaatgtgtgtgtgcaaggatgttggtggtggaacagttgttggtgaaagaacaaatgacaacaactggacggagatggttaactgttaggtgattatattgaccattaagggaactaagcgtggttatgtgctgtattggattg

SEQ ID NO: 3965 - DNA, 144 bp, Homo sapiens
ccttgatcagtgtccatccgcgctaatttgcatcatgaactgaacagtgtgtgagtggtcacctactaaacccagctctgggggcagagctgtcttccccatctctggatgctcctaacaccctgataagatggtcctatcagg

SEQ ID NO: 3966 - DNA, 380 bp, Homo sapiens
agagagagtgtgtgtgtgtttgtatgagtgtgtatgtatgtgtgtgtgaatgtgtgtgaatgtgtgtgtttgtgtacgtgcatgaatgtgtgtatgggtgtgtttacgtgtgtctgtgaatggtgtgtgtatgtgtgtgtatgagagtgtgtgtgtgagagagagagggagcctgcatacacacgtgcctatgtgggtgaagggttaccaaaagagggcgaattcaggaggctagctatggctttgaaactatccagaggtttcagaaatccaagaagtaccgggatttcttagagaacattaccagatgcctaggatgtggcctggtctactcagaaacctgtctggaggagtcaatgggaaaggagtggtacaagagt

SEQ ID NO: 3967 - DNA, 355 bp, Homo sapiens
agcgccgctcggcttgcaccgcgctcgctccgagtttcaggctcgtgctaagctagcgccgtcgtcgtctcccttcagtcgccatcatgattatctaccgggacctcatcagccacgatgagatgttctccgacatctactagatccgggagatcgcggacgggttgtgcctcgaggtggaggggaagatggtcagtaggacagaaggtaacattgatgactcgctcattggtggaaatgcctccgctgaaggccccaggcgaaggtaccgaaagcacagtatcactggtgtcgatattgtcatgaaccatcacctgcaggagacaggttcacaaagagcctcaggagtcatcat

SEQ ID NO: 3968 - DNA, 380 bp, Homo sapiens
ggtccttccgaggaagctaaggctgcgttggggtgaggccctcacttcatccggcgactagcaccgcgtccgggcagcgcagccctacactcgcccgcgccatggcctctgtctccgagctcgcctgcatctactcggccctcattctgcacgacgatgaggtgacagtcacgggggataagatcaatgccctcattaaagcagccggtgtaaatgttgagcctttttggcctggcttgtttgcaaaggcctggcaacgtcaacattggagctcatctgcaatgtggggccggtggactgctccagcgctggtgctgcaccagcaggaggtctgcccctccatgctgctgttcagctgaggggagaagtggagcaagaag

SEQ ID NO: 3969 - DNA, 310 bp, Homo sapiens
gcggaggccgcacgatgcctggagttactgtaaaagacgtgaaccagcaggagttcgtcagagctctggcagccttcctcaaaaagtccgggagctgaaagtccccgaatggtggataccgtcaagctggccaagcacaaagagcttgctccctacgatgagactcgttctacacgcgagctgcttcacagcgcggcacctgtacctcggggtgcgctggggttggctccatgaccaagatctatggggacgtcagaaaacggcgtcatgccagccacttcagccgaggctccaagagtgtggccgccgg

SEQ ID NO: 3970 - DNA, 360 bp, Homo sapiens
cacactcaagtccctcaacaaccagattgagagcatccgcagccccgagggttcccgcaagaaccctgctcgcacctgcagagacctgatactctgccaccctgagtggaagagtggagactactggattgaccccaaccaaggctgcaccttggacgccatgaaggttttctgcaacatggagactggcgagacttgcgtctaccccaatccagcaaacgttccaagaggaactggtggagcagcaagagctaggagagaacacatctggtttggagatacatcaatggtggcttccatttcagctatggagatgacaatttggctccacactgccacgtccagtgaccttcctacgct

SEQ ID NO: 3971 - DNA, 385 bp, Homo sapiens
ctcaaggctgcccacacctatgtctcagaagagcttagggcattggggatccccttcttgagtcgtggggctggcttcttcatctgggttgacttgagaaagtacctgctcaagggcacctttgaggaggaaatgctgctctggcgccgcttttttggacaacaaggtgctgctgtcctttggcaaggccttcgagtgtaaagagcctggttggtttcgctttgtcttctcagaccaggtccaccggctttgctggggatgcagagggtcagcaggtgcttcaggcaatccaagtggcagagaccccgtccttagagcaggagcaagtacacgaggtagctgtatttttgtgcaagccagagcactttgactgggcgtttgggct

SEQ ID NO: 3972 - DNA, 320 bp, Homo sapiens
actactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacaaagagactttatcaaaacatgattacagggccatctcaggctgactgtgctgtctgattgttgctgctggtgttggtgaatttgagctggtatctcaggatg

SEQ ID NO: 3973 - DNA, 165 bp, Homo sapiens
gtcaaactaatctgaatatggttaattgggttaatatttaaaggttagaatttttgtgttgttagctaagttgtttcatgtcacttcctttgcctgatagcagtgacaatttggggttgatttagatagaggaacattttgaatttgacctaggagagcggactt

SEQ ID NO: 3974 - DNA, 265 bp, Homo sapiens
aaatcactcacctcttccagagcacgcccctcacccccgacctgagaggagaggctcgtggtttgcgatccctctccccattagggtctgtcaccctggggctgagtagtaggtatctatggcgggtgtcttcatggaagccctggccacgcatcttgaagtggctttcatcttgtccctcscaacttaagcggagatgcatcttggagagggtcggaggtacacttagaagcatgtgtgtacgtaaaccgttgtcgtggggtac

SEQ ID NO: 3975 - DNA, 285 bp, Homo sapiens
gaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtcgaaatgtaaagtaggccctaacgctgatgggtcaaatgaaggtgaattcaaggctgaaggaatagcaattcccctcccagttctggaggatggttcccga

SEQ ID NO: 3976 - DNA, 210 bp, Homo sapiens
cgccttctgggcaggtagcagtccctggcctctccccctggctgatcactctccctcaggcagtggagatctgcgtctggacaccctcagatcctgtcattgcctgcccagagtccttcaggggcaccctctgccttggtgtgcagtccagggcttaaccaggtgccgaaccctctggggtcttctgtccagctcccttgcccatggtgc

SEQ ID NO: 3977 - DNA, 385 bp, Homo sapiens
atggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccagcttggggagcgtgctcgtcccctattgccaaggggctcaggctgtccgccaaaggcaaggccaaggccaaggccaaggccaaggtcaaccaaggccaggttgcgcccagtttagttccgtt

SEQ ID NO: 3978 - DNA, 325 bp, Homo sapiens
cctcagcccagtttgtgtctcggctgctccctgtgctgttgagcaccgcccaagaggcagaccccgaggtgcgagaattgccatcttcgggatgggcgttctggcagagcatgggggccacctgcccaggaacacttccccaagctgctggggctccttttttccctcctggcgcgggagcaaattgatcgtgtccgtgacaacatctgtggggcacttgcccgccttttgatggccagtccaccaggaaaccagagcccaggtgctggctgccctactgcatgcccttccactgaaggaggacttggaggagttggtcacattt

SEQ ID NO: 3979 - DNA, 255 bp, Homo sapiens
aagtatctcagtctagaatcacatagtcatttttttttcattggtcgattaatgtttatctcccttctgaactaacagctcccagcgaggatcaggcctttgattccccctgttgatgtccctacccacagcacagtatttggcacggcatcggaggcactcaggggatatatttcgtgtgagtgagtcccccttctgtgacatctccgagaatgaatcactcttgtcgttgaggactggtacagttttcttctc

SEQ ID NO: 3980 - DNA, 360 bp, Homo sapiens
gccggccgggcgcgacccgctccggggacagtgccaggtggggagtttgactggggcggtacacctttcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaagttaccacaggataactggcttgtggcggccaagcgttcatagcgacgtcgctttttgatccttcgatgtcggctctcctatcattgtgaagcagaattcaccaagcgttggattgttcacc

SEQ ID NO: 3981 - DNA, 230 bp, Homo sapiens
ggaaaaaggaaagaatgtcactttgagaactattaagaagaagcagaaacacaagggacgtgggacagttcgtactgtgactgagacagtttccaatgactctttctttgacttttttgcccctcctgaagttcctgagagtggagatctggatgatgatgctgaagctatccttgctgcagacttcgagattggtcactttttacgtgagcctatgtcccgagatcagt

SEQ ID NO: 3982 - DNA, 218 bp, Homo sapiens
agcagctggaggatgattgttactacattaacaggaggaaacggttagtgaaacttccatgccagaccaacatcataacgatttgggattcctatgtgaagcattttgctatcaatgcagccttttcagccaatgagaggctcgtcaccatcacgtatgcacatgccacatgacgtgcatttttccagcagagaggtgtggccctctgtaggagatgg

SEQ ID NO: 3983 - DNA, 161 bp, Homo sapiens
gcccctcttcccttggttcccacagttttagcgtccctgaaaggacattattctctctaaagcattaaggggttgacgggcccgggggagtgtttgctgttgttggcccccagctccccttccttcttggccaggtgttgggggagacttctgttgtgact

SEQ ID NO: 3984 - DNA, 184 bp, Homo sapiens
ggctgggagttctggcttctaggcctgccctgtcaccaggcctctgagtggccaggcccttccacctccccatctgtaaacgaggcagctcccggccagccttggggtccttagtggcccttcaggccctcttggcagctcttctgaccccacctctcccggccttcccttctgtcccagaggg

SEQ ID NO: 3985 - DNA, 186 bp, Homo sapiens
ctttgaaggtggataagacttcagaagaggaaaggccagactttgcttaccatcagcatctcaaatgggccaaacacacctcaaattggctgagttgagaaagcagccccagtggttccattcttgccagcactttctgcattccaaccagcatcctacctgggttttatccacaaaggtagcgcc

SEQ ID NO: 3986 - DNA, 153 bp, Homo sapiens
gtaatcctggggaacctggcttgagagggcctcagggagtcggggccttcctgggagtggaaggaccaagaggaccacctggaccccggggtgtgcaggaggacaggtgccaccgcctccctggtgtccaggccctccgggtagagcacgaca

SEQ ID NO: 3987 - DNA, 163 bp, Homo sapiens
attttgcaacaataggtgggaaatatatataaaggagttatttttctgtccagcaatatcgggcagtggactttgccagaattcagtacttcagataactgaggataatcattcttaggagccacttaagaattgtgaaggagtgtttgctgggatcactcta

SEQ ID NO: 3988 - DNA, 189 bp, Homo sapiens
agatagaggtagagagagtaatgctgcagttttgacttaggtaactcagttaggggctgaagcatgaacctgtggtagggagatggtggttaacaaccgtggacttctggataaaccctgtatgcgttcaaattctggttctaccattctgtctatatgactgaatgaattatctactcactctaacct

SEQ ID NO: 3989 - DNA, 191 bp, Homo sapiens
ctacttgggggaacaagatcggcaggccccacactgtcccttgcaaggtgacaggccgtgcgcttctgtgctggtacggctcatccttgcacccaggggcactggcatcgtgttccgcacctgtgcctaagaagctgctcatgatggctggtatcggtgactgttacacctcatgcccgggctgactgcca

SEQ ID NO: 3990 - DNA, 204 bp, Homo sapiens
gaggaagtggatgagctgtacagagaagcacctattgacaaaaaggggaatttcaattacatcgagttcacacgcatcctgaaacatggagccaaagacaaagatgactgaaagagctttagctaaaatctcccagttacattgtctcactctcttttacttctcagacacttccccaccctaatagaacctgttgcatgcact

SEQ ID NO: 3991 - DNA, 155 bp, Homo sapiens
ctgagcccaggctgctatgacacctacaatgcggacatcgactgccagtggagtcgacataaccgaacgtgcagcctgggaactacatactcaaggtgcacgtgaacccaaagtatattgttttggagtctgacttcaccaacaacgtggtgaga

SEQ ID NO: 3992 - DNA, 200 bp, Homo sapiens
gtggattgttcatcaattggcggggttccatttttccagcataaaaaatcacatgggaaaggacaaagaaaacagaggcattaacacactggagaggtttaagtggaagatactacagagcacttggttacaagagcaggttacctctgacgggcccgatcaacctttaattcacttgggggttggcaattttattttta

SEQ ID NO: 3993 - DNA, 175 bp, Homo sapiens
tgacggcccggcgacgcgacgtctctttttgactaaaagacagtgtccagtgctccagcctaggagtctacggggaccgctcccgcgccgccaccatgccaacttctctggaactggaaatatccgtcggaaactcgaggattgctcaagtctggcggtgaatttattctaggag

SEQ ID NO: 3994 - DNA, 205 bp, Homo sapiens
aaaaaacgggagctatttcacagagctgagcttctgccaaatttcattcctcaaacctttcaggaggggtggttggcgtttctaaaatgtttatgggatttgagttgcaggtgtccccttaactgactagctttgataaccaatgtcagattttcactatgaacacgacattcccttgtgcatttttatattgagtcctattttt

SEQ ID NO: 3995 - DNA, 250 bp, Homo sapiens
ctctgccaaggaaataatatggaccatttacctggcaggcagtctgctctctctcaggatcaccacgcatctcaggattggtctaaacttcaagtctcaaccaagtgtctaaggtgaactttgcattgaataaatttttgccatggaaagcacatcacacaggccactcatctctacagagataagagaacaggtttggcagacaagagacagagcccgtggagattcagagggggcacagtcagtttag

SEQ ID NO: 3996 - DNA, 270 bp, Homo sapiens
gtccaccagccccatcacagtctgtcatggctccggtatctcctgtggcaatgcacaaagtgatgcagctcacaatgctttgcagtatttaaagataatagcagaaggaagtaaatctggagcaacttaaaaaatctttcagtagcacataaaaagttcccctctggccccttycccaagtaaaacttttaccctagtgtttatgtctgtttctaaatctctcatagattccctccacactccagatttaattatctcccatagttgtat

SEQ ID NO: 3997 - DNA, 215 bp, Homo sapiens
gtgggtcctgctggtcctaggggccctgctggtccttctggccctgctggaaaagatggtcgcactggacatcctggtacagttggacctcctggcattcgaggccctcagggtcaccaaggcccttctggcccccttggtcccctggcccttctggacctccaggtataagcggttgtggttattatttggttacgatggagattttcacaggt

SEQ ID NO: 3998 - DNA, 190 bp, Homo sapiens
gtcggtctgggtgttaagtgctccaaggaggtggccaccgccatccgtggggccatcatcctggccaagctctccatcgtccccgtgcgcagaggctactgggggacaacattcgcaagccccacactttcccttgcaaggtgacaagctgctgcggtttgttgctggtgcgcttcttccttcaaccggg

SEQ ID NO: 3999 - DNA, 185 bp, Homo sapiens
cgactcctctcagatctatgcacacttgaggaaatctcggtgggcagcgacctgccagggtctgtccctaaggaggtggtccgctgacctctcaaggggtgggggtggggtcagagcttacaggtttctgtcttcttgtgcttttagatgcagtttctctcccctacccaggatcacccgcccct

SEQ ID NO: 4000 - DNA, 114 bp, Homo sapiens
agtatgccaggtacctgcctcacagtgcagggcggtatgcgcaaaaccgcttccgcaaagcttaagtgtccaattgtggagcgccttcactacctccatgattgattgacacgc

SEQ ID NO: 4001 - DNA, 119 bp, Homo sapiens
cgagaatgaagactattctcagcatcagactggtcgacattccagaaaatgtcggccattattctgaaggggacggacagtgatccgtgaggggcccagaggaaccctgcggagggact

SEQ ID NO: 4002 - DNA, 194 bp, Homo sapiens
ggactccccaatgctgctggctgacctgcctgacctccaggacccctgaaggcccccaagcctgtgccttgctgccacagaagacctagttccaggatccatggaagcattctaaagggcttaggcctggaccagaaggtaaggctcgcttggataattctgaaggttaatctaagaccacctttaagcctaag

SEQ ID NO: 4003 - DNA, 175 bp, Homo sapiens
gccaggcgcgcagtggctcacgtctgaatcccagcactttgggaggctgaggtgggcggatcatgaggtcaagagattgagaccatcctggttaacatggtgaaactccgtctctactaaaaatacgaaaaattaggtgggcgtggtaacctgtgccttagtctcagctactcgg

SEQ ID NO: 4004 - DNA, 210 bp, Homo sapiens
gagatgactttcaggttgcagccagaaggggttttttaaatgacttctactggatttcaggtttcttgactgttgaaaaaaggaacaaagcgttactgaaaagaagggtaacctttgttggatgtgggacttagactacaggtacagactactactctatgttctccagaagggtgctaagtcacctactgagagagaaccaactgactt

SEQ ID NO: 4005 - DNA, 282 bp, Homo sapiens
gggcggcggcgttggcggcttgtgcagcaattgccaagatcaaggctcgagatcttctgcgggaagaagaaggaggagctgctgaaacagctggacgacctgaaggtggagctgtcccagctgcgcgtgcgccaaagtgacaggcggtgcggcctccaagctctctaagatccgagtcgtccggaaatccattgcccgtgttctcacagtgattaaccagactcagaagaaacctcaggaaattctacaagggcagaagtacagccctggacctccgcctaa

SEQ ID NO: 4006 - DNA, 259 bp, Homo sapiens
gtttttgcatattttcttaggtcacagtgacaggtttctgagttgtttcccttttcaagtctctgggaggccagtgcagcagcaggtctgtgtttcaccttcttcccatgtgagcttggaaaactttggcatcttaattagtcttgaatcatacacctgatccccaaacattgcctgctctcaatgaaacatgctttggagatggagggactcagaaagtcgaaatcccaggaactccacgccaaaagtgttaggtttt

SEQ ID NO: 4007 - DNA, 312 bp, Homo sapiens
cccaggggtggcaggaattcctggagtgcctggacccccgggacctcctgggcttcccggtttctgtgagccagcctcctgcaccatgcaggctggtcagcgagcatttaacaaagggcctgaccttgaaaggcttactgctgcatggctgtctgcatgaaccacgcctggtgaaggagcctgggtgagaaacacatccaaagctggggcaaagatgattaccttcagcatgattacaatgtattaccttcagtatgattacagaggtcctacttgacaatcacatatagaggacggtgctattcagtaggt

SEQ ID NO: 4008 - DNA, 286 bp, Homo sapiens
gagaaagtatgtgcttaaatgatgaacactctcttaggtagtctatggaaagaatgattgtttcaggaacaaccatcctcctagtttaagagtataaaaagaacgcctacattttaaatgttttcccttatactcattattggcacactttactcaggacttagtagtcagttttaccatgtattctaacttcaccttcacctttgtactctaaaatttccttgcattaggatcagtttagaggtatcctcttatctcaaagtcaattctacacctatgttttcag

SEQ ID NO: 4009 - DNA, 425 bp, Homo sapiens
gagaaagtatgtgcttaaatgatgaacactctcttaggtagtctatggaaagaatgattgtttcaggaacaaccatcctcctagtttaagagtataaaaagaacgcctacattttaaatgttttcccttatactcattattggcacactttactcaggacttagtagtcagttttaccatgtattctaacttcaccttcacctttgtactctaaaatttccttgcattaggatcaagtttagaggtatccttttatctcaaagtcaattctaccaactatgttttcagagagaaatgttatcataagcctgaaatcttatgccagataattagaggggctcttaatgctgttttctttttccagcaaagtactttaaataaatgcttcataaaagtagttcttatgtaaaaaaaaaaaaaaaaaa

SEQ ID NO: 4010 - DNA, 265 bp, Homo sapiens
gaaaaacaagacataaaagataattcacaccagaggttttcaaactgtatcccaggctctatggccaacaaggtcaaaataacttccattataattcctgtggggtggttcatcttttcactctcatttcctcacgagcttgcagcaggctctccatgaacttggtgccttgacacggcacctgcaccatgatggctagtgtgtgttggtgctttcacagctctctgtttaacattccaacatggtaagtagctggagatagatt

SEQ ID NO: 4011 - DNA, 648 bp, Homo sapiens
gaaaaacaagaaataaaagataattcacaccagaggttttcaaactgtatcccaggctctatggccaacaaggtcaaaataacttccattataattcctgtggggtggttcatcttttcactctcatttcctcacgagcttgcagcaggctctccatgaacttggtgccttgaaacggcacctgcaccatgatggctagtgtgtgttggtgctttcaaagctctctgtttaaaattccaacatggtaagtagctggagatagaatttatccacagacactctttgaaatcctcaactttttaaaagtatgaagagatcatcataacaaaaagtttgaaaactgctggcttatattttgattgaacacaggagtaacatttatgagatagaaaagataaggtgggaaatgaaattgtgggaaagtcaagagttccaagagttctgccaaatatcatgaagcaaaaacattatgtaatatattctgaatggaccttagacaagttgtgtgttggatattaggttttactgtccttattaatgtagccaatacaaacccatctacctggagcaaagatatagtgggtcccagccaaaatatagtcagcactgctaaatatgtcagacatatgctggtttctagggacaaaa

SEQ ID NO: 4012 - DNA, 281 bp, Homo sapiens
tcggtccttccgaggaagctaaggctgcgttggggtgaggccctcacttcatccggcgactagcaccgcgtcccggcagcgcagccctacactcgcccgcgccatggcctctgtctccgagctcgcctgcatctactcggccctcattctgcacgacgatgaggtgacagtcacggaggataagatcaatgccctcattaaagcagccggtgtaaatattgagcctttttggcctcgcttgtttgcaaaggccctggcaacgtcacattggagcctcatct

SEQ ID NO: 4013 - DNA, 306 bp, Homo sapiens
cggcacgaggaagaagggacgacctggaggacacaggctcatgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttatcttctagagaatacacacttttcaggagacacctgagcatgattttggattctcacctcccccagtctctgcacctgggattcagctcaaggattcagtgtcttcattttacaaag

SEQ ID NO: 4014 - DNA, 185 bp, Homo sapiens
ggtgaaacccatctctactaaaaacacaaaaaaattagctgggcatagtggtgcctgcctgtaatccagctacttcggaggcggaggcaagggaatcgcttgaatccaggaggcagaagttgcagtgagccgagatcaggccactgcactgcagccctggaagacagagcaagactccatctcaa

SEQ ID NO: 4015 - DNA, 118 bp, Homo sapiens
tttaaatttaaaatccctaaaaaccgtttattataaacgcgagtttcgcgtaacgatggggttatcggtaggattttcggtagcgagcgcgggaaaagggtttaaaatttttccggat

SEQ ID NO: 4016 - DNA, 290 bp, Homo sapiens
tacatgggttcaacttcctccctggccaatttttagctgaattaccttgaacctcaattccctcatctaaattgggataataatttgtatcatataggagtgacatgaagatgcatgggagatgaaatgaaaattaaagcagatccagagatagaatagccacacatgatgatgatgataaaggctattattatgaactatgtgacaggcactccatcaagggctacacatacacatttggatctctcaacacccccattaagtggcgtttactatcccagacttacaca

SEQ ID NO: 4017 - DNA, 510 bp, Homo sapiens
tacatgggttcaacttcctccctggccaatttttagctgaattaccttgaacctcaattccctcatctaaattgggataataatttgtatcatataggagtgacatgaagatgcatgggagatgaaatgaaaattaaagcagatccagagatagaatagccaaacatgatgatgatgataaaggctattattatgaactatgtgacaggcactgcatcaagggctacacatacacatttaaatctctcaacaaccccattaagtagcttttactatcccaaacttacacaaggcaaataacattcaaggacattttaaaaaactagtcaaggtatcaccattattagttgaccatatgggattattgaacccatgcctttgtgataccaaaagttgagcttcttattaccatacttatacaaaacctcaggtgcagtatctgggatagaatatatactcagcaaaagtagactagttctgtgtaagtgtatgcgtatgtattttactaga

SEQ ID NO: 4018 - DNA, 192 bp, Homo sapiens
ccttcagctcctcttattggtctattcagagattcacactctctctcctggtttagtcttgggagagtgtatgtgttgaggaatgtatccacttctctctagattttctagtttatttgcgtagaggtgtttgtagtattctctgatggtagtctgtatgtctgtgggatcggtggtgatatccccctatca

SEQ ID NO: 4019 - DNA, 247 bp, Homo sapiens
ggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaggagggtgct

SEQ ID NO: 4020 - DNA, 265 bp, Homo sapiens
caagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaggcagctggctagtggcttatttacttgtgactggacctctggcctcaaatcgagttcctctacg

SEQ ID NO: 4021 - DNA, 122 bp, Homo sapiens
atcagcaaaattagcacttctgggtcagctgacaaacaggcagacagccttactccactagagagacagacaactttgtcatcgagttaggttctatttctttcaagtgctatttagagtca

SEQ ID NO: 4022 - DNA, 370 bp, Homo sapiens
tagaaaatcagcaaaattagcacttctgggtcagctgaaaaacaggcagacagccttactccactagagagaaagaaaactttgtcatcgagttaggttctatttcttttaagtgctatttagagtcacacaaaggaaatacaaagccaaacaaacacataagtatattttgaggtgatgcgactccgatgacaggacctgtacttctgaagggcaggctctgcacatctggggagcccctgctgcaatattaggcagtgaggctggggctccaagactccagctacgggaggggctgctgagtgtgggcttcctttagggaacagtgagtggctttcaatcaaggtatgggattttatgagtcgctgga

SEQ ID NO: 4023 - DNA, 187 bp, Homo sapiens
aaaaacctttgacctgattaacatttatagaacactcaacaactgtggaacacacctacacattcttttgaagttcacatggaggatctaccaaggtagaccatattttgggtacacagaaaaaggtctcagtacatattagaggatagagttatacaatggatgtcccaagactgcaatagattta

SEQ ID NO: 4024 - DNA, 460 bp, Homo sapiens
ctcgtgccgaattcggcacgagcaacttgacctgattgacatttatagaacactcaacaactgtggaacacacctacacattcttttgaagttcacatggaagatctaccaaggtagaccatattttgggtcaaagaaaaaggtctcagtacattttaaaggataaagttatacaatggatgttccaagactgcaatagaattaaattagaaatgaataacagaaaaatccttagaaaatcccaaaatatttaggaactaaatatcgtacttctagataactcatggatcaaagaagatattagaaagtagtttgaggctggacatagtggctcatgcctgtcatcttagcactttgggagactgaggcaggcaaatcacttgagctcaggagttggagaccagcctggccaatgtggcaaaaccctgtctctactaaaaatacaaaaaaaaaaaaaaaa

SEQ ID NO: 4025 - DNA, 244 bp, Homo sapiens
cggcacgagccggtttttggctctagactggtctcatctccattgccttaatgccaggtggcccaggagtacccatgcacagcagctgtggggtgtgggcatcttcaggtggtgttctggtaaaatcgttagaatagctgtatgaaggacaccagtgggaggaaatgaagttttcaggatggtggggatgtgatttagacagtccacatgctgttagggctctcactagggagtcgccttcatg

SEQ ID NO: 4026 - DNA, 224 bp, Homo sapiens
gatgcctggagttactgtaaaagacgtgaaccagcaggagttcgtcagagctctggcagccttcctcaaaaagtccgggaagctgaaagtcccccaatggtggataccgtcaagctggccaagcacaaagagctttctccctacgatgagaactggttctacacgagagctgcttccacagcgcggcacctgtacctccggggtggcgctggggttggctccat

SEQ ID NO: 4027 - DNA, 231 bp, Homo sapiens
ctccctgggctatgacctgcccatggtggaggaaggggacctgaccctgagttcgaggcaatctggacacgtgatccgaacagagattggccatgtcttccttgcaagaataaatggcttttaatgattcaagcccgcgaaacttaggaaccgtcaagttccaggcgaggagaattgggagcgcccttccgggccctcagctaaaaggggaaagaccttaggtgaacccag

SEQ ID NO: 4028 - DNA, 224 bp, Homo sapiens
aggcagtcatggatcaggtaatgcagtttgttgagccaagtcggcagtttgtaaaggactccattcggctggttaaaagatgcactaaacctgattagaaaaggaatttccagagggattgccaatggcaccagcattaaggattttgtctataatggggattcaattggccttctttgtgaaaattgatccatcatttccatttaataaaccaccaatgttgg

SEQ ID NO: 4029 - DNA, 144 bp, Homo sapiens
cacacctgtagtcctagctgcttgggaggctgaggcaggagaaattgcttgtaacccaggaggtggaggttgcagtgggccaggattcacaccactttcacttccaaccttggacaaaacagaggcgaggagcttccattcttc

SEQ ID NO: 4030 - DNA, 210 bp, Homo sapiens
ctgaggtgagttggggggtatctatattaggggtagggtattacagaagataattggcttgatgtcctagaagttctttgatcccagaaggtgggttccagctgaaaagtaaaccaagaattgggatttgccagtttacaatagtatttccctcccccagttccccttttttattttgcagaggctgttaagttttgtttaacaaattag

SEQ ID NO: 4031 - DNA, 231 bp, Homo sapiens
gagaaatgaccacaggatgagtcccagggcccactggacccactgtaagtcaacctgagctaaactcattaattaccttacctccatatgcctttactttaactggggggccaaaaattacattttgggtcccctggaattcaaagtcaaactcaaaagccaatttcaaaattcataattggcattaacataccttgtagttggcaaaaaccccccaattggttccctact

SEQ ID NO: 4032 - DNA, 265 bp, Homo sapiens
ggagttgaagccaaacagccaaattctgccattagggagtgtgtaagggtccagctgatcagatggcagaaatcacagcctttgtacccaatggacgggttgctttgaactttatttgagggaaatgatgaaggttcttggttgctggatttggtcgcaaaggtcaagctgttggtgatatcctggagtccgctttaaggttgtcaaagtagccaaatgtttctcttttggcccttacaaaggcaagaaggaaagcccaagatca

SEQ ID NO: 4033 - DNA, 203 bp, Homo sapiens
cagatgatgcagccaccaaaatcatcaattgaggtatcaaagcctctggcccaccacatcctgtggagagatctgtgagaagcttaagaaggagggccagccagatatgttgagcttaagtatgacaagcagatcgacctgagcacagtggaccctaaggagctccgagttaaagagctgaggagatctggatgacttggggg

SEQ ID NO: 4034 - DNA, 248 bp, Homo sapiens
gaacagctaaaagagcacacccgtctatatagcaaaatagtgggaagatttataggtagaggcgacaaacctaccgagcctgggtgataagcttggttgttccaagataagaatctttagtttcaacttttaaaattttgccccacaagaacccctcttaaaatccccctttgttaaaattttaacttttttaggtcccaaaggaggggaaccagcctcttttgggacaactagggaaaaaaacccty

SEQ ID NO: 4035 - DNA, 236 bp, Homo sapiens
aatttttgtattcttagtagagtcagggtttcaccatattggtcaggctggtctcgaactcctgacctcgtgatttgccctccttggcctcccaaaagtgctggggattacaaggcggtgagcaaggcaaatgccctggcccagtggatccttaatttgtagccttttgaagggatggccctgtgttagatcaatcattgagtgccacaaattgaaaggcttccacggtttaatgt

SEQ ID NO: 4036 - DNA, 185 bp, Homo sapiens
atgatgtgtaagtatgagatagatttgggactttaagctggggaaggacttcttaatatgatcacagagcactaccatagggggagaatggatagatttgtctacatcaaaatagaggatttctgttccacgaagctccccacagataaagtaacagacagatgggactgacttgagagggttgc

SEQ ID NO: 4037 - DNA, 272 bp, Homo sapiens
gccgtctctggagagcagcagccatggccctacggtaccctatggccgttggctcaacaggcacaagtgacagacgttagcaaggccaggcacagcgacggcgcgggctcttgaccaacacaacagttcgttcgggacattgatcggaaggtgtgttgcttttgcccgtacggcggcgcgccattgagttatcgtaggtcttcagggcaaacgggccttaattatctagggaaggtttggagcgaaatccggcaagggaacgcgagatctag

SEQ ID NO: 4038 - DNA, 157 bp, Homo sapiens
cagtaacggagcttaatcgtgacctttaaatttcaaacatgctcagattcttgaagtcagatgcctcatacttgcttgcttgctggtgtaatggacagggatcaggatatacttgactttgtcaaggtgccttgcttaaaggctaaaggttgcatag

SEQ ID NO: 4039 - DNA, 645 bp, Homo sapiens
cagtaacggagcttaatcgtgacctttaaatttcaaacatgctcagattcttgaagtcagatggcctcatactttgctttgctgctgtgtgatggaaagggatcaagtatacttgacttttgtaagtgactttctttaaagctaaaagttgcatagaacacatttgttgaaacaattagaaaactttatctgtaattctctttgcaaattacatgattctgcaagcctcattgttcccagtttctgaaatgggaataatcattcatcctgcatatctcttctatttattataaaagtgaagataacttaaaatattataaattaatgtgtaagtgtaagaaaatattaactgtggagtgctacactttctgaccttgtgaacgtttgattttctttaccggaaacactgaaatatactgaatatcaggtacctctccagagcatgcatgtggttctacagttgcttgcctaaaaatggtaaaggtcaactatccagaggggagaaatggagaggacagaaatgctgttaattaattagcataggaaacacatagagtcatagagttttctgtcagctgaggaagtgccttctctcctctttctcacacatgcatatatgctcacatatgcatcaatataaatcct

SEQ ID NO: 4040 - DNA, 202 bp, Homo sapiens
ccacctcgtgcctcaagatggcagtcaccttcatttggcaattagcacagccatccaggagctcttcaagcgcatctcgagcagttcaacttccatgtttccgccggaaggcctttcctcccacttggtacacaggcaagggcattgacggagatgggagttacacccgaggcttgagagcaacatgaccgacctggtctct

SEQ ID NO: 4041 - DNA, 308 bp, Homo sapiens
gaacgcctcggctgggaagtcagttcgttctctcctcttcctctcttcttgtttgaacatggtgcggactaagcagaaggtgttccaggcactttacagaaaagtggtggctgtctcgagcccccagaaagggtgcttggttctgccacctctgccactaattcgacatcagtttcatcgaggaaagctgaaaatgaatatgcaggagggacccccgtttgcgtgcgcccaactcccaagtggcaaaagggatttgagaattctttaggttgctccctaaagattctgaaaaagagaatcagattccg

SEQ ID NO: 4042 - DNA, 142 bp, Homo sapiens
agctcgtgccccttctgtgtgggctgcacatggtgacttccttcaagaagcacagatgtggagtaggcaagcgttccacagtgggagagcccaacccactgtctcagcccaaaggtcaagccttgacccataaccgagaggt

SEQ ID NO: 4043 - DNA, 164 bp, Homo sapiens
cttttcatccttctgtctctttgtttctgagctttcctgtctttccttttttcctgagagatacaaagcctccacgactcttgtttccccccgtccccttctgaattttaatttcgcactaagtacaatttgcactgggttgggagtttgtgggagacggccct

SEQ ID NO: 4044 - DNA, 270 bp, Homo sapiens
tgggactgagctgactgctgccacggcccaggctctggtcctaggggtcctttcagtctagaggttaggcagagcccaggttgggccagttccatgcgagtcccttcctgtggccccacagattcgtccagtccagccagttggccaatcatattcgccaccacgacaacatccgcccacacaagtgcagcgtgtccagcgaggccttcgtgacactggggccctgtccaagcacatcatcattcacactggagagagcttacctgtgtg

SEQ ID NO: 4045 - DNA, 267 bp, Homo sapiens
ctgaactggctccttccagtcaaggttatctggtttgattgtataatttgcaccagagtaaatgtttatgactctctgttcctgcctgaccaggcagagagtacacattgggttaattcaatttcagtcaagtcaattagatggcatccctacatcagggttgcccagatgggtgataacagtttagggccttgggctctagggcatccacgactgggacggcactactgatgtcctgtgatacatcaggttcagcacacacttaca

SEQ ID NO: 4046 - DNA, 183 bp, Homo sapiens
gttctgtttggagcccatttctgtgagacctgtatttcaaatttgcagctgaaaggtgctgtacctctgatttcaccagagttggagtctgctcaagggaccggttgtaatgtgtacaatctgtgtccatgtgtgaccatgtgtctgtgcaggcagggacatgtaatctctgcatgcatagta

SEQ ID NO: 4047 - DNA, 300 bp, Homo sapiens
ttataggtaagttcgctcgggtggactcctttttttttttttggctttraattraggattagtttatgctgtgagacagtccatgacccttttgtgggtttacaagtgggctgaacaagtcattggcaagaagctcagttttttgctttggctggggttcgggggcccaatccctttaaccccagcactttgagagggcaggggggatttctttagaatcagccttgccaacaaagcaaaaccccgttcttctaaaattacaaaattggccaagtgtggtggtgcgcccctataatccca

SEQ ID NO: 4048 - DNA, 230 bp, Homo sapiens
cttgggccacgcgtcagagtcggctgggccttggagggacggtgcccgcccttgtgagggcgttgcctctagggtcaagccaagcgcagagggccttaggtcaccccggtgagagagccacacgcggggtgtctcagagagcaaagcgccccttcccgaggctctgtgcgagccagttatgtcctctcacgggccacatgtgagctgcgttttagagcagtgtcacacac

SEQ ID NO: 4049 - DNA, 234 bp, Homo sapiens
cttggggccaccgcgtcagcagtcggcggggccgtgggagggacggtgcccgcccgctgtgaagggcggtggcccttctagggtcaggccaagcgcagaggcctgaaggtcaccgggtgaggagccagcgcgggtgcctcagaagccaagcgccccgtcccgagccctgcgcgaaccagtatgaccttccaggaaccagatgagaactgcgttttcaagaagcagtgccagaca

SEQ ID NO: 4050 - DNA, 308 bp, Homo sapiens
aagtttcctgaggcctccccagtcatgcctcctgtacagcctgcagaactgtgagttcattaaacctcttttcttcataaattacccagtctcaggtagatctttataacagtattgagaattggacggatacggggtacacatcaacataaaggtttgggaattcaattggcacttggggcttcccaaagggggaagggttgggagattgcaacggttaaaaacgtaccccattggtacactactcactacttttggggatggggacactagtagaacctcattccaccactattctatataccccy

SEQ ID NO: 4051 - DNA, 220 bp, Homo sapiens
caggagttgaccagcctgggcaacaatagtgagaccttgtccttattaaataaataataataggttgggcactgtggcgtcatattcttgtcacttcccacgcactttttcggggtttgccacgtgcacggggggggtttgctttgaggcccccgggagttttggagagccccagccttgggcagagattaggcacaggttcccaccttctaccaaatta

SEQ ID NO: 4052 - DNA, 209 bp, Homo sapiens
cctaccccatgttttcataatattcttctatggtttatacattatattttgattttgacatttaaatttccatctcatattaaagttttgtttaaagatgttgaggttaaggttcgagatacatacatagacatagcagttttattgtatatgaacacagcccctgacatatatcgctgaacctcaaaataaaaacttagagagataca

SEQ ID NO: 4053 - DNA, 210 bp, Homo sapiens
cctaccccatgttttcataatattcttctatggtttatacattatattttaatttttacatttaaatttccatctcatattaaattttgtttaagatgtgaggttaaggttgagatacatcatgacatgcagtttatgtatataacaaacctgcacatatatcgctgaacctaaaataaaacttaaagaaatacaaaaaaaaaaaaaaaa

SEQ ID NO: 4054 - DNA, 185 bp, Homo sapiens
gaaaataatcccacattgtgtatgcaccactcacctcaatcagcaacgatctaattgtcgcgaatgccaagcaagcaaactttttttacccttgggctgagtttggggcattcttcaatttccctcgtggccttacagggcccgttccgggccaggggagaggggggggatttagtttatgaggg

SEQ ID NO: 4055 - DNA, 249 bp, Homo sapiens
gaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcaaaaaaaaaaaaaaaaaaaaa

SEQ ID NO: 4056 - DNA, 195 bp, Homo sapiens
aggaactaactggtgtgagtcaaatgccccctgagtgactgccccccagcccaggacagagagctccttcaggtgcgggcgcaggaacttttgttgttttcctacaacaatggtgctattcttgtgttaaaacaacctctgtatttttttaaaacatcaattgatattaaagctgaaaaggttattgggaaggta

SEQ ID NO: 4057 - DNA, 239 bp, Homo sapiens
atactgccattcgtcaggacaccacccacccagtgttatattctgcctcgccgagtggtgttccggggcacttgccgaccagccccttgcggtcccaaggtttgcagctctccccttgggccattaaccaatcctggccccggggcttgcctgtctgaccttcgtggcctaggtcgggggctctccatcttgtctcctcccctgtggtccccaatgtcttcaaggggggggcccctctt

SEQ ID NO: 4058 - DNA, 292 bp, Homo sapiens
gaaagtcgggatcgtcggtaaatacgggacccgctatggggcctccctccggaaaatggtgagaaattgaatcagccagcacggccaagtacaacttgctcttttctgttggcaaaacccaagatgaaggagacgagctgtggggaatctggcactgtggttccggcataaagacagtggctggcggtgcctcgacgtacaataacacttcgctgtcacggtaaagtgcgccatcagagactgtaggggttgtaagaccactagacgctcctctactctttgagacatcact

SEQ ID NO: 4059 - DNA, 289 bp, Homo sapiens
cagaaaccgacaagggccaggcgcccggtggctccgaagcggggaagtgggacaagatggttacatctcgaacggacaagtgttggacagccggagttcagtctccatggagattatctttgataacagattttcttctggggaatagctgagtttgtggttttgtttttcaaaactctgcttcagcaagatgtgaaaaaccgaaggaggctatggagactcatctgattccagatattagtgatggaggaggggcaccacgagaccctcccccaggaatgggtaggad

SEQ ID NO: 4060 - DNA, 205 bp, Homo sapiens
cagctggtcactccccagagaagctgggccttcatggacacatggaactaagcctcccaaatggagttctggctgagccagggtgggggagatccttggaaggggaggcacttgagggaagacggcacctctttccccattggaagggttgttaaggagggcaggttttgaatttgtggcagtatttgcaatctaaagcaagggg

SEQ ID NO: 4061 - DNA, 201 bp, Homo sapiens
ctttactgggcactctgccaaataactggagtggcacttgtactttagtccaattggctatcctttcaccctggcatttcatcaaccagaagggaaaaaaagaagacaattttaaaagcggaggagaagcccccctatttggggtcttttcgagctctcaagtctattttagagtgcaatattgggggcccccgcaggggg

SEQ ID NO: 4062 - DNA, 177 bp, Homo sapiens
cctgccaggccttagacacagaggcccacctgcgagggggacagctgcggctggacctacctcatacagacaccctccttgtcttggatgaggggccacagagcaacttaaacacaatgtcagagggaggacaactctttgtggtttcccccacccccttgagtgttaaaataccca

SEQ ID NO: 4063 - DNA, 157 bp, Homo sapiens
gacaagctggcccaggttgggctggtgcagtactcaagctctgtgcgacaggagttccctggtcgctcacacacgaaggacatcaaggcggctgttcgggaatattttcctcacataggggaagggcacaaattactctgggcttccttcaaggacc

SEQ ID NO: 4064 - DNA, 192 bp, Homo sapiens
gattagttatgttaaacgctacttgcaagtcttgcttcttttggatatcaaaatgtatttgtgatgtactaagatacttggtcctgaaggctacccaaatattatagggtcaatttaggccaattcaatatctcttatatagtataaaacgatggccttggaaatgggctgaggaatttatgccattgtgat

SEQ ID NO: 4065 - DNA, 155 bp, Homo sapiens
acaagatgtgccctgatggagctgaagttgattcagattggcaccttttcttccccttcctcctggttcctttgttccttgaggtcacggaggaattccatttttttggtaagagacaaggttaaggttaaggaattgccttatatttttaaagg

SEQ ID NO: 4066 - DNA, 261 bp, Homo sapiens
tgaccgtgtgcttacacaaattggtacctcaattcaagactttattgaagcagaagatgacctttcatctttttagaggcagctgccatcacatcggacatattggaggcccttggaagagacggtcacttcacactctttgctcccaccacatgaggcttttgagaaacttccacgaggtgtcctagaaaggatcatgggagacacaagtggcttccgcagctcttatgaagtaccacatcttaaatactctccagtgtg

SEQ ID NO: 4067 - DNA, 380 bp, Homo sapiens
catttctatgtagatgagttggtatgagaatatatggatttttaagggactgtttaaatctttgatttgtagactattaaatataccgtatgcataaagtaagcctttagctctaaggtaaagacgacacgttttcggtttgtgactacaaataggttaacaatagattttcattttattaaaaatataattccatgcaggttgtttgaagcatctgtcttcatatgatggcattagaacaccttggtataataaaaagttaccgtaatttatgattatttgaatttatccattctgaaaattaataagatctaaaactggcatgacaatcaaggatttgtatttagtggaaatttaacattaaatgtaggccatagttt

SEQ ID NO: 4068 - DNA, 218 bp, Homo sapiens
ctcgtgccgaattcggcacgagggcagaggcaggaaactaactggtgtgagtcaaatgccccctgagtgactgcccccagcccaggccagaagacctcccttcaggtgccgggcgcaggaactgtgtgtgtcctacacattggtgctattctgtgtcaaacacctctgtattttttaaaacatcaattgatattaaaaatgaaagattattggaaagt

SEQ ID NO: 4069 - DNA, 338 bp, Homo sapiens
ggctcccaacactgccaacgtccagatgaccttcctacggctgctgttcacggaaggcttccagaacattacctaccactgcaagaacagcattgcctatctggacgaggcagcttggcaacctcaggagggccctgctcatccagggctccaatgacgtggagatccgggcagagggcattagcaggttcacgtacactgccctcaaggtatgtctgcacgaaccataccggtatgtggggcagtctgttatcgagtaccgttcacagagatctcacgtctcccatcattgacattacacctatggacataggaggccccgagcaggtattcgctgt

SEQ ID NO: 4070 - DNA, 320 bp, Homo sapiens
ttcccacaacacttttctcgggcctatccgggaatggcccgacgttactcggactaccccgatgcatacaccacatggaacatcctatcatctgcaggctcattcatttctctaccagcgtattattaataattttcatgatttagagaggcctccgcttcgaagcgaaaggtcctaatagtagaggacccctccataaaccctggagtgatctatatggatgcccccaaccctaccacacattcggagaccccgtatacataaactctagacacaagaggagggtctcgccccccacaaagctggtatcacgccacccc

SEQ ID NO: 4071 - DNA, 341 bp, Homo sapiens
gtttgtgagcctgtggsgcgggcttctgtgggccggaaccttaaagatagccgcaatggctgaaaatggtgataatgaaaagatggctgccctggaggccaaaatctgtcatcaaattgaggtattattttggccgacttcaatttgccacgggcacaaggtttctaaaggaccagataaaacctggatgaaggctggatacctctggagatatgataaaattcaccaggttgaaccgtctaacaccagactttaatgtaattgtggagcattggcaaatccagggcagatctcatggatatcagttaagataacctaaaatcagaggtctccaagcaaac

SEQ ID NO: 4072 - DNA, 341 bp, Homo sapiens
  misc_feature 317: n = A,T,C or G
tcacccccaccagccagagggaacagccagaggaaaagagagttgggtttaggtcgtaccaggggtttgtgcctcctcttgatacctgggcagccaacgcggtgagtttgtttttaagatgatgggaagggctccagcctgggccctggcctgccctaggtgcctttcccctcccgcccccaacatgccctgttggagttctgtttgtttcctgtgcacaggcggcatcacccccacccaagtccccagcgcagatggcagcagccccacctcagagactgcacaagagagagactcctggccccatgttcccttcnctccagccctatgtggtgtctgca

SEQ ID NO: 4073 - DNA, 216 bp, Homo sapiens
gatcatctctccttggggtttttctttaaaaaggggaatctgctataaaggttctgttgcttcaaaccaatgtcaaatagacttgaatttttagagtcaattggattaccaagtccaaccttgaatttttattccccctacttgctaattaggtgtggcaggccttggttaaaattgtatacctccggtttaacttgtgtggtagagtgaatggct

SEQ ID NO: 4074 - DNA, 106 bp, Homo sapiens
tctagagtgcagtggctacagcctcgaacttctgggctcaagagatccttcccatctccacctccaagtagctgcgaactacaggtgcaactgtttctccaatggg

SEQ ID NO: 4075 - DNA, 130 bp, Homo sapiens
ttagaagccatcagaggtgcaagggcttagaaaagaccctggccagaacctgacttcactcttaaaccttggtcttcttccttggcggtgctgttagcagcacagacccatgagcattcccaacccacaa

SEQ ID NO: 4076 - DNA, 118 bp, Homo sapiens
agaaaacgaagagaaagaaattttgaaaaacaaaaggagaggaagaagaagaggcagcaggctaggaagactgcatcagttcttagttaaagatgatgtgggcacctcttcagtgggt

SEQ ID NO: 4077 - DNA, 217 bp, Homo sapiens
gacagactttctaatgaacccaatggttatgatgatgggtcttcctttattgatatttgtgcttctgcctaaagtggtcaacacaagtcatcctgacatgagacgggaaattgagcagtcaatgaatattctgaattccaccatagagttgcctgatgtttctgagttcatgacaagactctttctcttcaaaatcatcttgcaaatctagcagcgs

SEQ ID NO: 4078 - DNA, 228 bp, Homo sapiens
ctgacctgacctgatgtccattcatcccaccctctcacagttcggacttttctcccctctctttctaagagacctgaactgggcagactgcaaaataaaatctcgggtggttctatttatttattgtcttccccgtaagaccttcgggtcaaggcagaggcaggaaactaacttgtgtaagtcaaatggcccctgagtgaacttccccagcccaggttagaagagctc

SEQ ID NO: 4079 - DNA, 219 bp, Homo sapiens
aaaaagaaggattgatcagagcattgtgcaatacagtttcattaactccttccctcgctcccccaaaaatttgaattttttttttcaacactcttacacctgttattgggaaatgtcaacctttgtaagagaaccacaaataaaaattgaaaaataaaaaccataaacatttgcaccacttgttgcgttttgaatatctttccacagagggggagggtt

SEQ ID NO: 4080 - DNA, 165 bp, Homo sapiens
ctgtggcggacgttgccatcctgcccgcactgaagcagaccccgaagaacaactttgccgagaggaagaaagaggcttcaggcaatgcagaaacggcgcctgcatcgctcagtgctttgagccaccccaatctggtcagtgccaggcccaccaacctgcagctgg

SEQ ID NO: 4081 - DNA, 116 bp, Homo sapiens
cagagatccattgccatcagtgatctcactaaaaatatacagctacttcccagctaatctccacccaatgaatgatgatggtatagtatgtgcataatggaaagttaccttactga

SEQ ID NO: 4082 - DNA, 116 bp, Homo sapiens; identical to SEQ ID NO: 4081

SEQ ID NO: 4083 - DNA, 149 bp, Homo sapiens
aggtgacaaaggagaggctggagagcctggcgagagaggcctgaagggacaccgtggcttcactggtctgcagggtctgcccaggccctcctggtccttctggagaccaaggtgcttctagtcccgctggttcctcttgccctagaggt

SEQ ID NO: 4084 - DNA, 108 bp, Homo sapiens
ctcgtgccgaattcggcacgagctttcatcgagttgaacaggacttaaacgaatcatcaggggcccgatatttcttatttctcacacgggatttttaacctttaatca

SEQ ID NO: 4085 - DNA, 200 bp, Homo sapiens
cactcacaacaaaactaactaatactaacatctcagacgctcaggaaatggaaaccgtctgaactatcctgcccgccatcatcctagtcctcatcgccctcccatccctacggatcctttacataacagacgaggtcaacgatccctcccttaccatcaaatcaatttggccaccattggtactttaacctacgagtaca

SEQ ID NO: 4086 - DNA, 185 bp, Homo sapiens
gtgaatctttcattatctttaatgaagacaaaggaatctagtgtaaaaaacaacagcaaacaaaagggtgaagtctaaatgaagtgcacagccaaggtcatgtttaccaggggctttaggggcgtttgaggaggttactcatcttttttggattccgacctagggtccggcatttaggcccagtt

SEQ ID NO: 4087 - DNA, 133 bp, Homo sapiens
taaatcctggataagaagtgactgctgtggtctggctgcatggtcctgaggacctgaaccagggtcaaggggcattgggagggaagagcctacacaagtgtaattggctaaacctggggacaattttgaatgt

SEQ ID NO: 4088 - DNA, 100 bp, Homo sapiens
gcgaggaagggacccctctctcatggttgtctctttccccgctatgtcataggtagtggaggaagccaaggaagttaaccctgaatttcacgcatttctt

SEQ ID NO: 4089 - DNA, 136 bp, Homo sapiens
ctcaggtggtggatccaaaacttaaccacatcttcaggccacaaatagaacgggcaatttatgaggttcctggcgggcccaaaaaaaagcagcttttccagcacccccttccagaggcccgaagggcaaggaccct

SEQ ID NO: 4090 - DNA, 105 bp, Homo sapiens
cgcaggcttaagcgcaaaagaagaaagatgaggcagaggtccaagtaaaccccttagcttttttgcaccctggaggccacaaggggcagaaacattggatttcca

SEQ ID NO: 4091 - DNA, 118 bp, Homo sapiens
ctcgttccgaattcggcacgagaattttattaagggtccagtgaaaaaagacctgtttcaggggctttacgtacttacttgatttgcacccagcattaatcttctggtgtggtatgag

SEQ ID NO: 4092 - DNA, 124 bp, Homo sapiens
cagccttcctgggatacaaggctggcatgactcacatcgtgccgggaaggtcgacaggccgggatccaaggtgaccaaggagggaggtggtggagccttttaccattttggagacaccccccat

SEQ ID NO: 4093 - DNA, 182 bp, Homo sapiens
atccagtgggtgtccgacttcagcgagaggatcaaacagctgcagaacatctcactggcagctgcatctggtggcgccaaggagctaaagaacatccacgtgtgcctgggtggcctgttcgtgcctaaggggtacatcactgccaccaggaagtatgtggcccaggccaacagctggtccct

SEQ ID NO: 4094 - DNA, 158 bp, Homo sapiens
ggcacgagaatcaacatggcagacggtacagaaaagccacggaagggtgggagtctttggctataaaatcaagagggggcctccactgccctgtcctgtttacaaatttttctaataatgttgtctttaaccaggaaattttcatcaaaaccagctgt

SEQ ID NO: 4095 - DNA, 221 bp, Homo sapiens
tgaggctgccaaggaagctctggaggcattggttcctgtcaccattgaagtagaggtgccctttgaccttcaccgttacgtttattgggcagaaaggaagttggatccgcaagatgatggatgagttttaggttaacatacatgtccggcaccttagctgcagtttaacataattggcattaaggggccttggtgcaattttgggcccggccmagggtggc

SEQ ID NO: 4096 - DNA, 221 bp, Homo sapiens
cggcacgagtttctagcaaatgagtgacacttggtaaatgttggttgatagaatgaatgatcatctacattttatgaaatggatgaaaaaataggctagttcatccatagtagacatcagattatagtatagttcttgctgattctaaaatcaaagatctttttattttgctgcatctgggatttccaggaaaatcaattttaagggactttatttcccaa

SEQ ID NO: 4097 - DNA, 154 bp, Homo sapiens
gttacaatgttacttcagcccacagtttatttctatacttgagttcttaagtacagaagatagaagtgatttaaatggcatagtatatatatcattttctggcccttttaaaatttatttgagacctcttgatgaaatggacaaaatatatatt

SEQ ID NO: 4098 - DNA, 300 bp, Homo sapiens
gtttacaatactgcttctgtaattccagctctcctgccacagctcctcaccccctgacaatgttcgcctgctccaaggtttgtctccactcccctccttgctagggtcaagagcacctcacagctgctgagccgtccgctatctgcagtggtgctgaaacgacccgagatacttacagatgagagcctctaacagctttgcaatgtctaagtgccctttactaattgtgtctagggccgagttcccaaaccgagcgctattttgggggaaatcgacacaagagccaagtttatggggagc

SEQ ID NO: 4099 - DNA, 305 bp, Homo sapiens
aggtcgacactagtggatccaaagaattcggcacggccgctgggcgggcctacctcgacagggctttcccatcatctttcacggcgtaattggcaaaatagagccttaaggcaacagcccatcttcttcaacccttaagagggttccacagttacttcctacccttaaggtgcttccctggcccttcttcaagagaggggaaagcccccttagaccctgcaaggttggggtgaagttccctttcccgaacacaggtgagagaattccctttattattacaccatattagacagggagtttcgagg

SEQ ID NO: 4100 - DNA, 299 bp, Homo sapiens
atgttctaacctttacatgaggactctattctttaactcccattaccatgtaatggcagttatattttgcagttcccacattaaaggaggcctaggatgtattccccaaaagcggtagcttaaaaatacaaggcttccatatttaaattttttggtggcaattaggtctacagtaaggcctataaaaaatgctgggctatagatgtcttttcccatatatctaaatatggactgctcaggaaccgagactttccattacaggtatttttaattaattgggccagcttttcaaacaaaga

SEQ ID NO: 4101 - DNA, 288 bp, Homo sapiens
cggcggcgttggcggcttgtgcagcaatggccaagatcaaggctcgagatcttcgcgggaagaagaaggaggaccttctgaaacaacttgacgaccttaaggttggactttcccaacttcccgttgccaaaagtacaaggcggttccggcctccaagttttttaagaccagagtcgtccggaaatccattgccctgttttctcaagtattaaccagactcagagagaaacctcaggaaattctacaagggcaagagtacaagccctggactccggcctaagagacacg

SEQ ID NO: 4102 - DNA, 291 bp, Homo sapiens
ctcgtgccgaattcggcacgaggcaagatgaagtagagcagaagaagaagcggaccttccgccaagttcacctaccgcggcgtggacctgaccagcttctggacaatgtactacggacaacttatgcaactttacaattcgcgcgcaaggcggccggcttaaacccggggcttcgccgaagagagaatctccctctctaaaggcccctccaaaggccaaagaaggaggcccccccatggagaagccgaagtggtaagacgaccttcgaccattatatcctacccagatgtt

SEQ ID NO: 4103 - DNA, 296 bp, Homo sapiens
  misc_feature 250: n = A,T,C or G
ctcgtgccgaattcggcacgagcttccctcctcctggagcctccagcccctcacactgctgttcccagtgatatttgggatctgacttaagccagaggctctgtaaatcagaccatagttgaagttctcagaccccttggccctttcgcgactctttctctcccccagtttccaaagagagcaatttaaacacagagaggggaatatagacacagggcacagtggacagtagctgacggtagagacagangtacagtttgggttcccttcctggttcccttacagtcttgggttgt

SEQ ID NO: 4104 - DNA, 168 bp, Homo sapiens
tttgctgtaaagtgcaaggaaattttaaattctgggacactgagttagatggtaaatactgacttacggaagttgaattgggtgaggcgggcaaatcaactgaggtcagcagttttagactaggcctgcaaacaatattggaaccctttctttctcttaaaatacaca

SEQ ID NO: 4105 - DNA, 296 bp, Homo sapiens
tgtcatcaggaagttatgacaaagcacttcgcttcctgggatcaaatgatgaggagatgtcctatgacaataatccttttatcaaaacactgttatgatgggtgtgcgtccaggaaaggctattaaaaggccttccattaaatccattcacaccaaaatttgagcaggtaccctatgttggagtgtcatgatcaatgactttgggtgatcagagtcagaggttcggatttgatgttgggccctgtttgttttctgggctaagattaagacagagcacatatcagctccaccagaga

SEQ ID NO: 4106 - DNA, 255 bp, Homo sapiens
tagcagtaggaggactaggctccattataagagttcttacagcaagaaagactgtttaaaaaaaataaaaagactcatgttaccttgagaagaattctgtgatgcccaggcttgtgaagagagggatttacaatggacccacttctctaggactcccaagtaaaacctatttacagagacagtatatttcgtgaaattgtaatttaatttccacgggtggggggaaattcgttcttgtcccaaatcactctttaa

SEQ ID NO: 4107 - DNA, 127 bp, Homo sapiens
agaaaatcggcattttcccacctgcaatttctatctccagcatccccctgctgccttcttccgtccgcagtgcggccttctaggtgcttccattccacccctcttttccacagcggggacccgaaat

SEQ ID NO: 4108 - DNA, 112 bp, Homo sapiens
ctcgtgccgaattcggcacgagttataacaggtttattgcagtttcctgttctgtgggaaagtgtaaagcattccaacaaagggttttagtctagatttttttttttggaag

SEQ ID NO: 4109 - DNA, 185 bp, Homo sapiens
gccgaaatgggcaagttcatgaaacctgggaaggtggtgcttgttactcggcctggacgctactccggacgcaaagctgttcatcgtgaggaccattgatgatggcacctaagatcgcccctacagccatgctctggtggctggatttgaccgctacccccgcaaagtgacacttgccatgggca

SEQ ID NO: 4110 - DNA, 107 bp, Homo sapiens
ggtatttckgtgggacgggtggtaaaagcatgtttctacactttggacacattcagggtcttgggatttggcagaacaagtttggatttttaggacctagagcacga

SEQ ID NO: 4111 - DNA, 114 bp, Homo sapiens
ctggacttgtcttggttacagaacctcacgaccccgcgacgcgacgtctctttttgactaaaagacagtgtccagtgctccagcctaggagtctacgggaaccgcctccggggg

SEQ ID NO: 4112 - DNA, 134 bp, Homo sapiens
cttgggtttgcatgtttacagacttcccctggggcgaggggtcagagctggctcttggggagctggactaggaagaggaggtccagcccagactctttcctagccttctctaaaccaaggtcctttgccatcct

SEQ ID NO: 4113 - DNA, 125 bp, Homo sapiens
caaatggagggaagttttctgggtggggaaggactgtttggcatttaggggaatcacattggctattccaactaatgaattcacacttattaccggggatgtgcttacagggatcacacttaaat

SEQ ID NO: 4114 - DNA, 293 bp, Homo sapiens
ctcgtgccgaattcggcacgagcagccttctctcccccataaggactggctgtaaccttaagcccatcaaagttacttccagcctggagagaacctcaccaaacagcttgtgtggccttagggtggccatggtgggaaatgggcattagaataaatacctccccaaattcaatctgagcccagcaggagaggatggtagggttgccagggctcagaagtgcaagctgattactcaccccaccctgtctctgcgcaactcttctctgtttcccttggtgaatgcagggagagtc

SEQ ID NO: 4115 - DNA, 301 bp, Homo sapiens
ctctggtcctcaatcgagttcctctacgaagaacacaccagaaatttgtcattgccacttcaaccaaaatcgatatcagcaatgtaaaaatcccaaaacatcttactgatgcttacttcaagaaggagaagctgcggaagcccagacacacagagaaggtgagatcttcgacacagaaaaagagaaatatgagattacgcgagcagcgcaagattgatcagagagctgtgggactcacacattttaccacaaatcacagctatttctcagctccacggctacctccgatctgtgtgtgctc

SEQ ID NO: 4116 - DNA, 306 bp, Homo sapiens
ctcgtgccgaattcggcacgagcagtcacgcaccacaacccccagctacttttttttttattttgtattttttctagagactgggtctcactcttttacccagacttgtctcaaactcctggacttaagcaatctgcacacctgggcctcccaaagtgcttggattacaggcatgagtcacacctctatcaatttagtgttttaaaagcatatctttgagccaagcgcggtgtgctctcgactctgtgtgcccgcactctttggaggccacgagcgcgcagatgatcgacgctcatcgaggttctt

SEQ ID NO: 4117 - DNA, 311 bp, Homo sapiens
gccgtgttaggaggggtcggggagaaatcaggctctcgaagctcataaaattcaacgtgaggaagcaagtgacaaggacgcccgaagcacagttgacggtcattaaggagccggggttttgcaagcgggttacgtccaggagagaggagcgcccccttgctttcccctctggccgccgcacttgacgcgcggggccttttccagacgagcacactcatatcggctctcgcgtctacagagtatctctcaaaggggcctatctcttatacctctatgcccagcagttttagagaagagaggagggtgtagta

SEQ ID NO: 4118 - DNA, 253 bp, Homo sapiens
actggcaggcctcggcctaaaggtctggagggtgagcgacctgcgagactcacaagaggggaagctgacagagatacctacagacggagtgctgtgccaaccttgtgcccgacaaggaagccgaggcttgggctgggtcagcaaccgaattccagtttagagagcgcgattttgtcgtggacgtgtgtcagacgacactcagatataaaatttgagagagatctcttgcacattgatatactctcacacccac

SEQ ID NO: 4119 - DNA, 246 bp, Homo sapiens
ggacggccttggagagtactcgggttcgtgaacttcccggaggcgcaatgagctgcattaacctgcccactgtgctgcctggctcccccagcaagacccgggggcagatccaggtgattctcgggccgatgttcttagggaaaagcacaaagttgatgagacgcgtccctcgctttcagattgctcagatacacaagccctctgtgatacacatgtatccaaagagactctgctatcagaagcaga

SEQ ID NO: 4120 - DNA, 224 bp, Homo sapiens
aaagaatgccaaaatcagcagtctcctggaggagcagttccagcagggcaagcttcttgcgtgcatcgcttcaaggccgggacagtttggccgagcagatggctatgtgctagagggcaaagagttggagttctatcttaggagaaatcaaggcccgcaaaggcaaataaatccctgttttgtctctcacccatgtaatataagagtgtgtatatgtgtttgtt

SEQ ID NO: 4121 - DNA, 290 bp, Homo sapiens
cttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccggcaatattgcactgtacatttcacaaggattgtctctcttattttactctctcttagctctgttaactctgtaagatgcacagagggttggagcacgtgtatatagctctgctgtccctgtcaca

SEQ ID NO: 4122 - DNA, 301 bp, Homo sapiens
aatgcatggtaggagataagtttggagaagtagacagagaacagatcacataagccattataaagaatctgaatttaatgaaaatgcaaataagaatttgcagggaaatctgctttttgttcagaaataggctgtaatgagtttggcattttgcatacacactgtgttatttttgaggggagggacagtttaggggttttggaactgctgctttttaaactattttaggtgtaaccagtgcacaggggaaagaggaggaggaaagtggtttggcagagctagggtaaaaatagtgactacc

SEQ ID NO: 4123 - DNA, 296 bp, Homo sapiens
gtgaactcagtttgtgaactcaagataaatgcttaatttgacaccatggtaaatactactgttgagtttaaagttgtctcagaatccagcatattaatgaaaagttactgctttctagtcctttattcatatttttatagcttttaaaattattattctgtagattttgaatgcttaaaactacagacttagaaaataatattcaaatatgtgtgatcaaccatctaaaataatacatgctaacctctgtcatttttgcatcagctattttaaaataattaavatattatacctac

SEQ ID NO: 4124 - DNA, 220 bp, Homo sapiens
gaaggaaagaaaaaaaaaggaaaaaatgcaaggaaggtatttggtgaatctataataataaaaatgtatttgtcatttcccttttctgtgctctcattctataaaattgagtaaaaaatctatatatagtttcaaacacattaatagaattcacacaagttagctgagtcaacattgtagagacataatatttctgtatgtcacagacatagacaccatt

SEQ ID NO: 4125 - DNA, 205 bp, Homo sapiens
agaagtcccatcacttgaaagaaatgaaggtcgaatttctcagccccaccatggtgtgccatatttcagaaatatccttcagtccagaaacttagaaattaacttccacattctacgagtggggacaggaaactgtgatttggacattccagatggaggttaaagagttctttgacacagcagttaggtcaaacaaggtctctct

SEQ ID NO: 4126 - DNA, 250 bp, Homo sapiens
aaaaaaaggtcttggtgaggtgccgccatttcatctgtcctcattctctgcgcctttcgcagagcttccagcagcggtatgttgggccagagcatccggaggttcacaacctctgttgtccgtaggggccactatgaggagggcccttggaagaatttgccattttcagttgagaacaagttgtctgttactatgctatagatgtgtttgtactcttgatcttcatatgctacacacttcttgtagtaag

SEQ ID NO: 4127 - DNA, 254 bp, Homo sapiens
ctcgtgccgaattcggcacgagcacagatccctacctgcctggctaagacccgtggccgtcaaggactggttcggggtggattcaacaaaactgccagcttttatgtatcctcttcccttcccctcccttggtaaaggcacaaatgttttgagaactttatttgcagagacacctgagaatcgatggctcagtctgctctggagccacagtctggcgtctgacccttcagtgcaggccagacctggcagctgga

SEQ ID NO: 4128 - DNA, 301 bp, Homo sapiens
cggcacgagccaagatgtcgttcccaaagtataagccgtcgagcctgcgcactctgcctgagaccctcgacccagccgaatacaacatatctccggaaacccggcgggcgcaagcgaagccggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggattta

SEQ ID NO: 4129 - DNA, 299 bp, Homo sapiens
ggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagag

SEQ ID NO: 4130 - DNA, 299 bp, Homo sapiens
acggagcggacgccatggcgaccaacatcgagcagatttttaggtctttcgtggtcagtaaattccgggaaattcaacaggagctttccagtggaaggaattaaggccagctgaatggtgaaacaaatacacccattgaaggaaaccaggcgggtgatgcagctgcctctgccaggagtctaccaaatgaagagatagttcagaagatagaggaagtactttctggggtcttagatacagaactacgatatagccagacttgtaagagggctccagaaaaaggtagatgcgtatcttta

SEQ ID NO: 4131 - DNA, 254 bp, Homo sapiens
aaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattcccctcaaacctt

SEQ ID NO: 4132 - DNA, 290 bp, Homo sapiens
cttaggcttttgctagttttagaaattagggagcagcccttgatttgtggattaaaagcaaccatttgagcgatgatgcacaacatccaggaaaattgggcggttggacaattgaggctgaggattggagttgacatgagcagggagaggaaggttcgcccttcttatctttgattgttgctcacctagtttgctgattgtttacatccagcagttacaattttttaaaattatacttttacaattaatttaaattttgctaccccaggtaattcctccaagggggttca

SEQ ID NO: 4133 - DNA, 298 bp, Homo sapiens
ttgtcctctyccttttatccaggcaggaggattctatatcctgatgggtaggagacagactccaggcagccctggacttgctagcccaaagaagggaggatgtggttaatctgtttcacctggtttgtcctaagggccatgattaaaaggtaccagctctgcctggggtccttaaggcccaggccaggcagrccaaatttttccttttctggcatacaacccttgcttcaaatttagctatacctcatgagtaggtggctttgccttagagtgggctggggacacttaattcctccca

SEQ ID NO: 4134 - DNA, 312 bp, Homo sapiens
ccaagcgggacgcccaaaatgaagtttaatccctttgtgacttccgaccgaaggaagaatcgcaaaaggcatttcaatgcaccttcccacattcgaaggaagattatgtcttccctctttccaaagagctgagacagaggtacaacgtgcgatccatgcccatccgaaaggatgatgaagttcaggttgtacgtggacatataaaggtcagcaaattggcaaagtagtccacgtttcaaggaggaatatgttttcttcaatgaacgggtgcaacgggaaaaggctataggacaaatcttcccgtggggcttt

SEQ ID NO: 4135 - DNA, 198 bp, Homo sapiens
gtcgcagccgcgccgaggcacgccagaaccgccacatcgacctgcagttcagctacgcgccacggcactcgcgccggaacgagggggtcgttggtggcgaggactacgaggaggtggacaggtacagccgccaggcccgagttggccgggcttggcacttgcggggcccagcagagccgccaggaagcttgaggtacc

SEQ ID NO: 4136 - DNA, 224 bp, Homo sapiens
ttggcctcggcttgggccgttcatgtagcagcaaccggcggcggctgccaaggaagcagcgttcggtttttgttttttaaattttgaaaactgtgcaatgtaattaataacggctttttatatctaaatgtaattctgcacgggaagggtcaacttggtcccagggtgttaaggctttaaggggcaatatatataaatgttaattccctcctgaactagtgcca

SEQ ID NO: 4137 - DNA, 317 bp, Homo sapiens
ccaagcagatgcagcagatccgcatgtcccttcgcgggaaggctgtggtgctgatgggcaagaacaccatgatgcgcaaggccatccgagggcacctgggaaaacaacccagctcttggaggaaactgctgccctaatatccgggggaaattgttgggctttgttttaaccaaggggggacctactaggtccaggggcaatgtgctggccaattagggtcccacttcttccccgcctggtccattgcccccatgtagggacattgtcacaccaagacatggtctgggcccggagagcactcttttcacaggtttggg

SEQ ID NO: 4138 - DNA, 312 bp, Homo sapiens
ctcgtgcgaatttcggcacgagaaaaaacatcaactcctgaagttagaaataagaatggtttgtaaaatccacagctatatcctgatgctggatggtattaatcttgtgtagtcttcactggtaagtgtgaaatagttcttccacctctgacgaacacttccaatcctgtacgtacttcatttccccttgagcaaggtggatgtttaccgtgtgttatatacttcctgggtcctacactgcacatgcctagtccaacatttttccccagtgagtcacatcctgggctccagtgtataactcaatatcatgtc

SEQ ID NO: 4139 - DNA, 325 bp, Homo sapiens
ctttaatgccttcctcttcacccagctgctgtgttccacctgtcagtcccacagcagctccccagccacactcagggtcccagtgttcttgttacaatgagtccagtcactggcatttacccagttaacctgtctaatcctttccaccagggaattgaaattttaaagggacacagggcccccctggagggacccgttaaaaggtccttttgtaatgggcacaggggggaattctctagaacacatctttttacgagacccaatacactgcctaatgataatgtgggctctagagggctctcaacctgcagcttccctatgagga

SEQ ID NO: 4140 - DNA, 239 bp, Homo sapiens
gcacggcgctcccagatgagggccggactgcctccccttaagcagctgtgttggaggtactgcccagaccgctgcaggtccctggggatctgcatttctaacgggctcctgcccccaagactgctctggtggaaaatccagcctgggagcccctggagtggcaggccttttctgggtacaggtggagccacccccaggagttgcgtgtgttttcttaattgaaagacttccccaaaagg

SEQ ID NO: 4141 - DNA, 166 bp, Homo sapiens
  misc_feature 87: n = A,T,C or G
ctcgtgccgaattcggcacgagcttgaatttggaaagtgttcattttttggcctactgttcggggcaggggggctgagccaggttgngcattagaagcaggggttttcccctcttgccagtttttttggggagctgcccaggccacccttgcacccttcccgtttc

SEQ ID NO: 4142 - DNA, 129 bp, Homo sapiens
ggtgatggcggctatagctgcatccgaggtgctggtggacagcgcgggaggaggggtccctcgcttgcggcggcgggagcttggcccgttcagaaaggcgcgaacagagacttcgcaaattccggggag

SEQ ID NO: 4143 - DNA, 110 bp, Homo sapiens
gaacacttgcaggggtccctgctagttagcgccccaccgccgtggagttctgtacccttttccttaggaacttttaccaggaaggccaaggtcttccctgggaggccctt

SEQ ID NO: 4144 - DNA, 149 bp, Homo sapiens
  misc_feature 134: n = A,T,C or G
gcagtgtccgagtctaccactatttccagtggcgcagggcccagacgccaggccgcagaaggaccaagaggacctcaggaatcatgtagaactggggggctttttctcctgagcagaggaggcccaagcgcatnctctggagacacttc

SEQ ID NO: 4145 - DNA, 110 bp, Homo sapiens
cggtggctcacgcctgtaatcccagcactgagaggccgatcacttgaggtcagagagttcaagaccagcctggccaacatggtgaaaccccactcttttacttaaaaaat

SEQ ID NO: 4146 - DNA, 129 bp, Homo sapiens
cctctgggaggtgcagttatgctgttactagtgattttagggctttgttatttaacttatttcaagggtgctgtgctcagccctgcccatggctgtgcagctccctccgtgcctcagatctgctgtagg

SEQ ID NO: 4147 - DNA, 144 bp, Homo sapiens
ctcgtgccgaattcggcacgagccgctgctggtgtggttgacataggtgatggccacagtgcaagaaaggcaaaccagagctccagaaaaaaaggtgacatccagcagtggtgaattcgacaacgaaagtcataccgtagaaaa

SEQ ID NO: 4148 - DNA, 102 bp, Homo sapiens
attttaataaacaaatgatcagcattttacacaatccattttcttgcagaaaatctagaggcaagggataaacttcattacctcagtgccgaattcggcacg

SEQ ID NO: 4149 - DNA, 138 bp, Homo sapiens
gcatgctctccctgccttgggcttttctttccgtcatgttttccttttcgtgttccttctctgatttctcttgtctctgctgctcacaggccttcccatcagtcagtacagatactcagtgtcttgtttccttgccca

SEQ ID NO: 4150 - DNA, 135 bp, Homo sapiens
cagcagtccaggtgccacaggcagccctgggacataggaagcttggagcaaggaaagggttcttagtcactgcctcccgaaggttctttgaaagacttcggggaatttttccaggtttatttattttaataccca

SEQ ID NO: 4151 - DNA, 151 bp, Homo sapiens
gctgttttggagttcctgggggccttcacccctcgatgttcccaagacacacctgccaggggtttgttggagcaggctgaggctcttaagggccaagggaggtccaggtgggtggcctttcttaagttttaatgaatgccctttgttactt

SEQ ID NO: 4152 - DNA, 134 bp, Homo sapiens
ctccaccttactaccagacaaccttagccaaaccatttacccaaataaagtataggcgatagaaattgaaacctggcgcaatagatatagtaccgcaagggaaagatgaaaaattataaccagcataatatagc

SEQ ID NO: 4153 - DNA, 142 bp, Homo sapiens
ccgaaaacctggctcagtgcaatactcccattgccatgggggtccttcaccatggtactgtctccacagccctcagtccccaccccaggagaggcgcctgccacctcctcctcatctccggtggttcaatcgctccggctgt

SEQ ID NO: 4154 - DNA, 142 bp, Homo sapiens
ctgcctgggagttgggttccctccaagggtccctctttcagtgtcctctctctcacctgggtctgccaccctaacaggtggcaactcggcagggctgctggggggcacttcctgcccagtgggggggtgccgcccaaccttc

SEQ ID NO: 4155 - DNA, 139 bp, Homo sapiens
cagagatatcgagcagtactattccactcagattgatgagatgccgatgaacgttgctgatcttatctgaagcagcagatcagtgggatgagggagactgttcacctgctgtgtactcctgtttggaggtatttagata

SEQ ID NO: 4156 - DNA, 165 bp, Homo sapiens
gaagagcctgccctcctatatggattcttcagggccctccacatctgaggtggctcattcccatcacacacagattgtcctgtgtgttcatttcaaggccagtgttcagcagcagcgtttttgaaagcaggttctgttggaccccccgccccgccccccgcactt

SEQ ID NO: 4157 - DNA, 151 bp, Homo sapiens
ccgccttctcccgccaccgccgccgccgccttccgcaggccgtttccaccgaggaaaaggaatcgtatcgtatgttccctatccagaacctccactctttcgaccccttttgctgatgcaagtaagggtgatgaccttctttctgctggca

SEQ ID NO: 4158 - DNA, 110 bp, Homo sapiens
cagcagccatggccctacgctaccctatggccgtgggcctcaacaagggccacaaagtgaccaaggacgtggagcaagcccagagcacagaccgagcggcgcgggggtct

SEQ ID NO: 4159 - DNA, 131 bp, Homo sapiens
atgattgcgagtggaaaaataggggacagaaatcaggtatttgcagttttttcattttcatttgtgttgttaatttttaatataaattgcggagagcgtgaaagcatataattgcaaagttaaaaatgtgt

SEQ ID NO: 4160 - DNA, 200 bp, Homo sapiens
ggcgaacgcggagagcacgccatgaaggcctcgggcacgctacgagagtacaaggtagttggtcgcttccttcccaccccccaaattccacaaggcggccctctatccccgatagcgagatctttgtcgcgctatatcatgtcgtcgccacagtgcccctctctgtgtgatctcttgtatactcacgagtataagagaga

SEQ ID NO: 4161 - DNA, 125 bp, Homo sapiens
gtgccgaggctatcaaggccctcgtaaagcccaaggaggttaagcccaagatcccaaagggttgttagccgcaagcttgatcgacttgtcctacattgtcccaccccaaggttgggaagcggttc

SEQ ID NO: 4162 - DNA, 150 bp, Homo sapiens
gctgaccgttttttgtggtgtactccgtgccatcatgtccgtcctgacggcgctgctgctgcggggcttgacaggctcggcccgcgcggctctccagttccgcggcgcgcaagatccattcgtgtgtccgcgcgcgaggggaagctttgg

SEQ ID NO: 4163 - DNA, 183 bp, Homo sapiens
tcttgactccgctgctcgccatgtcttctcacaagactttcaggattaagcgattcctggccaagaaacaaaagcaaaatcgtcccattccccagttggttcggatgaaaacttggaataaaatcaggtacaacttcacaaaggagacatatgagagagagacccagctctggtctatatagg

SEQ ID NO: 4164 - DNA, 226 bp, Homo sapiens
ggaagtgtgagttcaggtgcccctttgggctcaagtgagagttacccatagagacaatacttcagttttgctcctccattcgccatccagtgcagattatgcaatttgtcttcccacaacctcttccttaacaattcttaccgcaaatctctaactctgctgtgtaaaatctctctctctctctctcaaaaaaccccatgtgctcttatagtgcacgcgtcagact

SEQ ID NO: 4165 - DNA, 120 bp, Homo sapiens
tgccaacatgccatccagactgaggaagacccggaaacttaggggccacgtgagccacggccacggccccataggcaagcaccggaagcaccccggcggccgcggttaatagcttggtgg

SEQ ID NO: 4166 - DNA, 230 bp, Homo sapiens
acactgtggagaggcggaaggcagggagccccaaggtctcagctgcccacgctccccagtgtgatgcctactttagccaaccaagaggagcacaagcaaaggaactgttcatgtgatgaggcagaagaggagcttagaggagccagccttaccactatctgtaccactctgggattgtatcctctctgagctatagtgttctcgctgtgtcgtctagactctgagtgtca

SEQ ID NO: 4167 - DNA, 235 bp, Homo sapiens
ctccaaaatggcgtcagttggtgagtgtccggccccagtaccagtgaaggacaagaaacttctggaggtcaaacttggggagctgccaagctttgatcttgatgcgggacttcagtcctagttgcattttcggagcctttcaaagagagtgtactatcccgtactacacacacagtacactcacatgtgaagagagggggagcactctctcgggattaccatatgtgtctctgca

SEQ ID NO: 4168 - DNA, 160 bp, Homo sapiens
ccaccctgcacctggtgctccgtcttagaggtgggatgcagatcttcgtgaagacccttacttgtaagaccatcactctcgaagtggagccgagttacaacatttagaatgtcaaggcaaagattcaagacaaggaaggcatcccttctctaccagcaga

SEQ ID NO: 4169 - DNA, 185 bp, Homo sapiens
ctcgtgccgttttttttacacaaagacaattatttaagacctttattaacaggtgcttgcagtttgttgacttttttgaaaaaatcaagttgtaaacttttattacaaattaaaaatgaaggtcttaaaaatctcaacttgaccagatatgacacacatttataaaacctcttataagggcgtat

SEQ ID NO: 4170 - DNA, 240 bp, Homo sapiens
ggatgccctgatggcagttagcacactggtggaagtgttgggtggtgaattcctcaagtacatggagggctttaaacccttcctgggcattggattaaaaaattatgctgaataacagaggttgttttgcagctgtgggcttagttggagacttgtgtccgtgtccctgcaatacacacatcatacctttctgtgtacgcgggtgtatgcagactgtctctctctgagaaatttgtgggg

SEQ ID NO: 4171 - DNA, 177 bp, Homo sapiens
ttcacattctgaaggacctctctagctggccagtgctgaggaggttggagagagaaagggtgaaagcagagagaccagttcagggctgttaacagggttgcaggcgagagacttgggtgcttggcttccctagagctaggacttcagtgtcccttctctctccaagagcacaaagag

SEQ ID NO: 4172 - DNA, 175 bp, Homo sapiens
aaatttgcccacagaaccctctaaatccccttgtaaatttaactgttagtccaaagaggaacagctctttggacactaggaaaaaaccttgtagagagagtaaaaaatttaacaaccatagtagggctaaaagcagccacacaattaaggaagcgttcaagctcaacaaccacta

SEQ ID NO: 4173 - DNA, 191 bp, Homo sapiens
ctaatgcccacaaggtactctgtggatatccccttggacaaaactgtcgtcaataaggatgtcttcagagatcctgctcttaaacgcaaggcccgacgggaggccaaggtcaagtttgaagggagatacaagacaagcaagagacaagtgtgtgtcttccagaaactgcgggttttagatgctttgttttt

SEQ ID NO: 4174 - DNA, 310 bp, Homo sapiens
cggcaacgagattactaacagaatgtcccccaatgatggacactgagtataccaaactgtggactccattattacaggtctttgattgggtctttttgaggtaccccgaggtgataccatttcctataagggacattttaattttacataggaggttccaccaggtattcagctctgcctctctaccagttggattttctctggaaaaaagaggacgtatccctatgggacatagggtgtatcccccaaactttacccctggcactgactcttcacggttgtatccgcctgtaccggaagggttacctat

SEQ ID NO: 4175 - DNA, 350 bp, Homo sapiens
ttgaccagtcacagattcaggagttcaaagaggccttcaacatgattgatcagaaccagagatggtttcatcgacaaggaagatttgcatgatatgcttgctctcattgggggaagatccacctgagagtatctctggatgccatgatgattgagcttccaggcccctatcaattttcaccatgtccctaaccatgtttgggtgagaggttatatggcacagatcctgaagatgtcatcagatatgcctttgctcgctttgatgagagcatctcgcaccatacagggagattacttgagagagctgctgacaccatgggggatcggtttacagatgaggaagtggatgag

SEQ ID NO: 4176 - DNA, 95 bp, Homo sapiens
attttttcatagttttaactagatttccaagatattttggtgcatttgtttcaactgaattttggtggtgtcagtgccattatctagcaccctga

SEQ ID NO: 4177 - DNA, 136 bp, Homo sapiens
  misc_feature 136: n = A,T,C or G
ctctattgcttatgctttaaaaaaaggagaaacaaaaaacctactaacccactgcaagctctttgtcaaaattttaggttaaattgggcattgccttgtttttttgaaacctgaaattacaatggggttccatttn

SEQ ID NO: 4178 - DNA, 130 bp, Homo sapiens
ttgggtttgcaaacttctgtggctggtagttgtagtgtgtttttcatgttgtcattgttcattgtttaatcccagtattttggggaaaccactaaaaagggcaaccaggtccaataagattcttttgcca

SEQ ID NO: 4179 - DNA, 144 bp, Homo sapiens
ctcgtgccgaatttcggcacgagttttgcttaggcgcagacgggggaagcggagccaaacattgccabttggccccggagctggggttttgtcggcaaaatcttatggtgaaccccgccggagaacccttcgagaaatctctct

SEQ ID NO: 4180 - DNA, 125 bp, Homo sapiens
ttcgcgtccattactcaaggagacagcataacagatgcagaacaagtcatatttgaggatgttttgtactaaacttcatttaattattcagtttttaaagggaaaaagggcgtgagctcacacag

SEQ ID NO: 4181 - DNA, 125 bp, Homo sapiens
ctaagacggctcttgacttttcgcgggccggaagaaagagggaagacattcagctgaaggacctcgaacctgtactgtctgtcggagtctcaattaataaccacagtggcctgtggcacagtgga

SEQ ID NO: 4182 - DNA, 125 bp, Homo sapiens
cacatttgaactagtcactctcccagacttgcgtgggtcagttctttctgagtagaggacttgctggtaaaggggcagatgcttttaattagtactgataaaacaaactdagggaaacatcccct

SEQ ID NO: 4183 - DNA, 150 bp, Homo sapiens
gcaagcatcgtggaagagctgcccactggccatcagagtcaccaaccccaatgccaggctgcgcagtgaaggaaatgagtaggcagctcatgtgcacggtatactgtttaaataaatgtaaaaactgccctctggcatacaactccttgg

SEQ ID NO: 4184 - DNA, 190 bp, Homo sapiens
atcagactgagaacaaaatcctgggtgtacactgtctccatcacattgtgcttaatgtggctgtgctcctgtgtctgctggatttattccccattcctggggaaaacccttgcaacctggaagggggagtggggtctcgacccaccacccaatgttatgaggggtccctcggcttattcctacccacatg

SEQ ID NO: 4185 - DNA, 190 bp, Homo sapiens
gggatcaaggtgaaaaggagaaccccatgcgggaacttcgcatccgcaaactctgtctcaacaatctgtgtttggggagagtggagacagactgacggcgagcagccaaggttgttggagcagctcacaggtcagacccctttttttttcccaagctaagatacactctcagtccctttggcatccgagg

SEQ ID NO: 4186 - DNA, 194 bp, Homo sapiens
agattaaagccctttagatactgccaagggagcgctgtggcattcatactttgacttaaattattgattaattttcctgtcttttggtaataatctctggttactaaatttcccaagatttcctgatatacctaggatattgccccacaccactcgcattccctttcacactagggttcccattacacacgggg

SEQ ID NO: 4187 - DNA, 187 bp, Homo sapiens
agaatgaagactattctcagcaatcagactgtcgacattccagaaaatgtcgacattactctgaagggccgcacagttatcgtgaagggccccagaggaaccctccggagggacttcattcacatcattgtagacctcagcctttcttggaaagaaaaaaagagaggtctccgggttacacatatgg

SEQ ID NO: 4188 - DNA, 195 bp, Homo sapiens
gtgatgtctcacagaaagttctccgctcccagacatgggtccctcggcttcctgcctcggaagcgcagagcaggcatcgtgggaaggtgaggagcttccctaaggatgacccgtccaagccggtccacctacacagccttcctggatatacaagctctggacatgatctacacatcgtcgcgggaagtgtgcgca

SEQ ID NO: 4189 - DNA, 207 bp, Homo sapiens
ctcgtgccgaattcggcacgagagagtggtgtgaaggccaaaatctgactcctcataggaaggaaccctttgtaggcgacctgcccagcctcaacttggcactttcagtgttcttgttcttggaaggccatcttgggagacggtatattgctttcataggtgaggggtatatattgtatgccgagattcagggtaatttctacgtga

SEQ ID NO: 4190 - DNA, 125 bp, Homo sapiens
ggaaagacgctgggaggcccagggatgcccggcgcaactgagacgctcatcgggagtcacggggtcggccctcaggggaacggggactatccgtatcaacttcggttgttttttcggtttcttca

SEQ ID NO: 4191 - DNA, 155 bp, Homo sapiens
gcgtggtctacgccgagtgacagagacgctcaggctgtgttctcaggatgaccgagtgggagacagcagcaccagcggtggcagagaccccagacatcaagctctttgggaagtggagcacccaatgatgttcagatcaatgacaatttccctgc

SEQ ID NO: 4192 - DNA, 110 bp, Homo sapiens
aagacgagctgtatgaatgtatggataataatgacgaggcattatcttccatggaggctaagtataaaataggtgcttggttacaaacttttaatcaaaggcttgacctt

SEQ ID NO: 4193 - DNA, 182 bp, Homo sapiens
ctaaaggagaagcaaccgttggggggttggggtttcctaaggaatggtttcaaaaatgtacccatcaatttgatcaatagcacttttaattccttttgaagtgttgcctctaggtgggttgtttgtctttttggcatgcttaaaggccaatgtcccttaaaaattcatatttgttccccttt

SEQ ID NO: 4194 - DNA, 170 bp, Homo sapiens
actgaagacaagaccccaaggagttgtgaccttgccaccaggtcggttgccgaagaaagagttttggtaccatagccgagggttcaattgattaattaccctacttattaaatgtgtgggatcctataaatttaaattgtgtctctattacctgttgaggaaggtccatt

SEQ ID NO: 4195 - DNA, 116 bp, Homo sapiens
gctatttgaactggtgcctcttggagattttgagtctgtgtgttggggagaggcagccatggggcccaccaggacccttgagcccgggtgacagttcccgtccatcttgcaggttc

SEQ ID NO: 4196 - DNA, 281 bp, Homo sapiens
cagccgcagagattgttgatgcctaagaggagccggattgccatttatgaactcctttttaaggagggagtaatggtggccaagaaggatgtcccatgcctaagcacccgcagctggcaagcaaggattttcccaaccttcatgtcatgaaggccatgcagtctttcaagtcccgaggctacgtaaagggacaatttgccttgagacaattctacttgtaccttaccaattagggttccagtatactcgttattaccttcatcttcccccggagtttgttc

SEQ ID NO: 4197 - DNA, 272 bp, Homo sapiens
ttgtgttgacactgtagctcatactggaaaagtcgatcaatgttttgcagtttattgaaagtagttctatatataacaatgttataagcatttctttagaaatggttgaaaatgcttctaaaatgtgattatcgaccatgggatgcatgatcgttgtaattgttgacattccctttagaaggttgtgaaatgttacaacttgtgcttatgttggaccaatcttctggcttaagtaccagggcactaccttcaataaggtctattataactta

SEQ ID NO: 4198 - DNA, 286 bp, Homo sapiens
ccacatggaaagctgctcaaaatcagtacttatcagggaaaagcaaatcaaaaccccttcaaatcttctaagcacctaggatcatcagagtcaataaaatacagaaattaccaagttttgaagggtttggaggaaatgggagacttagggccaccgccatttagactttaaaccagtccaaccattttggaaaccattctggcagtttttcaaaagataaggcatttatatgccccagatattcactccctaggtatacctagaagaattgaggctgggcagcagt

SEQ ID NO: 4199 - DNA, 220 bp, Homo sapiens
ggaatgctggcttccctggcctccctggacctgctgtgagtttgatagaaaaaagctcttagtattttgctttaaataaaatctatcttatagtatctgtctttaaagagaaaaaattagtgcaaaaatatattaaagcgtatgtatttattttttagggagaaccaggaaggcatggaaaggatggattaatgggtagtcccgtttcaagggtatttat

SEQ ID NO: 4200 - DNA, 271 bp, Homo sapiens
gaaaagtggaaagcagagagagaggctcggctggcaagaggagaaaaggaagaggaggaggaagaggaggaagagatcaacatctatgcagtcaccgaggaggagtcggacggaggaaggcagccagagaaaggaggggccgcaaccaacaagaagttcattcctcacggcccttttccctcgcagcaaagattttaggatgcacttgtccaaagaagaaatggcacttctcagagtatcaagcgagccctcagcccaaagttagagcaga

SEQ ID NO: 4201 - DNA, 305 bp, Homo sapiens
ctgcgctgacccaggggctggagcgaatcccagaccagctcggctacctggtactgagtgaagtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtctcaggacagaggtgtttgtggtgaagaggcagaccgcggtcgggagcccattgatgtctgagcctcccgaggcgagggtcggagaagcg

SEQ ID NO: 4202 - DNA, 225 bp, Homo sapiens
cgggtcctggcatcttgttcatggcaaatgctggacccaacacaaattgttcccagtttttcatcttcacttccaagacttagtggtttgatggcaagcatgttgtgttttgcaaagtaaaagaaggcattaatattgttgagggcatggagcgcgttttggtccacggaattgcaagagcagcaagaagagtcaccatttctgactgtagacaactcgaatatg

SEQ ID NO: 4203 - DNA, 145 bp, Homo sapiens
ggaactcttctgtatctaaaacaatacatctcaatcttgggccagggaaaatgggcttcttttctgggttggcacctagccaccttagggaatttcggttgagattttcaacaagagtaagacacacacattccaggtaaagggg

SEQ ID NO: 4204 - DNA, 181 bp, Homo sapiens
gtcaagagggtaaaacttggcctagaagctatcagcaaccacaaagagacaagaaggaaagacttttttcttaggctctttcttatgggaccctctctatagataggttataaacccaggcccagaaatatatatggggttttatatatatgatatggccctatatatatatggccctata

SEQ ID NO: 4205 - DNA, 101 bp, Homo sapiens
catgcacattttgattttgtttgtcattcaaaattgtgcttgtaaaaatgtatacaatttctgaggtttataatttctagggacttggttttttcctgcct

SEQ ID NO: 4206 - DNA, 120 bp, Homo sapiens
gccgagtcgcgcggaggcggaggcttgggtgcgtccaagattcaacttcaaccgtaacccaccggcatgggcgaggaaggcatttcttctggaggtttaattggacgttaatacttcttt

SEQ ID NO: 4207 - DNA, 176 bp, Homo sapiens
ggaatgaaaaaccagttcaatctccatgagctgaaaatgaagggccctgagccagtggtcagtcaaattattgacaaactgaagcacattaaccagcttctgagaaccatgtctattcccaaaggtagggttcttggataaaaaccgggatgagggagggtttgaaagtggagact

SEQ ID NO: 4208 - DNA, 128 bp, Homo sapiens
tgatgccaagattcgcatttttgacctggggcggaaaaaggcaaaagtggatgagtttcccctttttggccacatggtgtcaggtgaatataagcagctgttccctgaaggccttgaggcttcccgaa

SEQ ID NO: 4209 - DNA, 104 bp, Homo sapiens
tggaagcccaggcagaggaggcgctgagagttagccagggctgttaggacttccagcacgctgtcacctcttaatagttcacaaaaaagacttaaccttttaga

SEQ ID NO: 4210 - DNA, 133 bp, Homo sapiens
tccgcataagcctgcgtcagattaaacaactgacctgacaattaacaagcccaatatctacatccacccaccaggtcaattatttaaccctcactggtcaacccaaccacaggcatgctcatagggaaaggtt

SEQ ID NO: 4211 - DNA, 220 bp, Homo sapiens
tcgtgccgtgagaagccatgagcagcaaagtctctcgcgacaccctgtacgaggcggtgccgggaagtgcctcgcacgggaaccagcgcaaagcgccgcaaagtttcctcggggaacggtgggagttttcagattcaagcttttaggaactaatggatcccccagaagggaccaaacgctttttcggggcacccttaagagttttaagtgccactattcc

SEQ ID NO: 4212 - DNA, 270 bp, Homo sapiens
aaaaccagagaagcctttgactcagttcaaagaggctattaggaggaaattgactaaagctgtacagactctaagacctgggcacttacattcctttgcatttcttgagggatgctttgaattcttgttctactcctagggggctctcgcaacttcagatactaatctcaaggagagttattgggtcccgaggacacaaattcccctgtccacacagagaactctaatttcaatcccctgtagatctgtagagattataattctcagggg

SEQ ID NO: 4213 - DNA, 181 bp, Homo sapiens
tttttttaatctcctacttctgctatctttgagcaatctgggcacttttaaaaatagagaaatgagtgaatttgggtgatctgcttttatctaaatgcaaataaggatgtgttctctgagacccatgatcaggggatgtggcgcgggggtggctatagagagaaaaagggaaatgcctttg

SEQ ID NO: 4214 - DNA, 245 bp, Homo sapiens
tcgaagcgaggacgtggtgggtcctctggtgcgaaattccggatttccttgggtcttccggtaggagctgtaatcaattgtgctgacaacacaggagccaaaaacctgtatatcatctctcgtgtaagggggatcaaggggacggctgtgacagactctccccctgtctctgtgtggggttacatatgtgtataggccacactgcatagagagggcacaccagagctctaagaaaagggtacaca

SEQ ID NO: 4215 - DNA, 108 bp, Homo sapiens
gcaactgcctgggggcggggatgggggcagggtggaagcggctccccattttataccaaaggtgctacatctattgtgatggtggggttgggagggattcacttgtgc

SEQ ID NO: 4216 - DNA, 198 bp, Homo sapiens
ccagagttggagcagtggttactactggattgaccctaaccaaggatgcactatggatgctatcaaagtatactgtgatttctctacttgcggaaactgtattccggcccaacctgaaaacattccagagcaaggactctgtatatgggagttcaaggggaaggacacggtttgctaggagaatctttaaattttgga

SEQ ID NO: 4217 - DNA, 280 bp, Homo sapiens
gggaccaggccaatcccttctccacttactataatggttggaactaaacgtcaccaaggttgcttcttccttgcttgagagattggaggccttggtggattttcttcctgggttccctaggccctagtaaggcaagaggaaaacccatcctctccctctctcacaccgtagagcccaagatcctctcagaggcacaggagttctcccctctccaatggtcccccgtccctctgtctgtatatgtgacccacctatgtgaggatatacacctacgcactgg

SEQ ID NO: 4218 - DNA, 180 bp, Homo sapiens
gaagtgacatcgtctttaaaccctgcgtggcaatccctgacgcacccccgtgatgcccagggaagacaagggcgacctggaagtccaactacttccttaagatcatccaactatttggatgattatacccaaatgtttcaatgttgggagcagacacatgttgggctcccagcacagttc

SEQ ID NO: 4219 - DNA, 253 bp, Homo sapiens
ctttgggaggccgaggtggacagatcgcttgagcctaggaatttgagaccagcctgggcaacgtggtgaaaccccgtctctactaaaaatacaaaaattagctgggcatggtggcatgcccgaaattccaactacttgggtgacttaggtgagaggatcacctgaacccagaaggttgaggctgcagttagccaagatcatgtcccactgtactccagcccggataacagagtgtagatcctgtctctaaagc

SEQ ID NO: 4220 - DNA, 158 bp, Homo sapiens
ctcgtgccgaattcggcacgaggaccggggcatccccttgtccccaagagacccgacggttgcttcatggcctacacgttcgagagagagtcttcgggagaggaggaggagtagggccgccttggggcttggcattccgccccttgggccaacccttg

SEQ ID NO: 4221 - DNA, 118 bp, Homo sapiens
atgggaaagtgtgtaagatttagaaaaagcattaactattagtaaactttatcttaagctctaacctttgattaggtcccacaaaaattaggtgatatgcaatttctaatttagggcc

SEQ ID NO: 4222 - DNA, 310 bp, Homo sapiens
cgctcacgcaagcatggttaacgtgcctaaaacccgccggactttctgtaagaagtgtgggcaagcaccaaccccattaaaggtgacaaagttacaaaggaggggcaaggattctcttgtacggcccagggaaaggcgcgcgtatatgagacagggagggcaggtgcggctatgggttggcacaactctaaggcgcgatttttcccgggaaaaaaggtctaaaatctcacacagagggatgtgcgctaaggtctgagagtgcgtagagcccaatctacagatctgagagagtgctggctataaagagatg

SEQ ID NO: 4223 - DNA, 235 bp, Homo sapiens
gctgaagtcgttttttaaagagtatggacaaatagaatctgtacgatttcgttctcttattccagcagagggaacgctattccaaaaggttgcagcaattaaaccggtaaattcattcctattcagaaaatatttatgcccatttgtgtgttttaaggaagagagagtctctccacgcaagcaatttaaaaggattggggccccaattccagagatggattcgcgtatagagagt

SEQ ID NO: 4224 - DNA, 321 bp, Homo sapiens
cggcacgaggtcacaggggccgttgcgtttggctttgtggagggcctggacccttccacaagaacaaccgagggttcagggcacttaggacaatgttttccagggacgagtcgaccaaggaaggacagattagtgtctctcaaggggccatatcacgcgagagctctgtatagaggggctctatgtagaatatgagatactcgtgcctctgactctttctttctcacataaaccacacctcccgcacaacacccacgagacccctctgcgtcatcatctctactactctctcctctcttgggggatatgggccctccctac

SEQ ID NO: 4225 - DNA, 211 bp, Homo sapiens
ctgaactgacaatgaagggaaattgtttatgtgttatgaacatccaaggctttcttcttttttaaggtgtcaaagaaggtttcacaaaattaggaaggacaacagttcttagctgtaatttcggcttaaactctgtgacactctatatgtagtgtcacattttaaactcgaatatatatatatatcagagccagcttaacccatacactgt

SEQ ID NO: 4226 - DNA, 275 bp, Homo sapiens
ccctggtctctcaagcgtatacttcaatcatcgccgatgattttgcagcctttgttggacttcctgtaggaagaggctgttaaaggcatattagaacaaggatggcaagctgatttcaacacaaggattgtgtctctcccagagaagacacattgtcagagggccctctgagtgtgtttctcttatacacgtgttatattcccctattcagagagctctgttcacatttcccccaaatatacccatgtgatcagcaggcagtagagcagcagctt

SEQ ID NO: 4227 - DNA, 120 bp, Homo sapiens
ggaaagagctgaccaactggccatcagagtcaccaaccccaatgccaggctgcgcagtgaaggaaatgagtaggcagctcatgtgcacggtttctgtttaaataaatgtaaaaacttccc

SEQ ID NO: 4228 - DNA, 229 bp, Homo sapiens
ctcgtgccaattcggcacgagggttgattaggttattattgcaaagcactgtcaccggcctcagggagtttatgtgtaatagaattcaaaataatagctgtgtataacaattagctcaagccacggatgtgtgaggcatttgggatgtatctgaattaattctcactaaaattcagcaaagggctttatagccctcccggccctttcattaagggtggaatgagggttg

SEQ ID NO: 4229 - DNA, 247 bp, Homo sapiens
ccttactaccagacaaccttagccaaaccatttacccaaataaagtataggcgatagaaattgaaacctggcgcaatagatatagtaccgcaaggaaagatgaaaaattataaccaggcataatatagcaaggactaacccctataccttctgcataatgaatttaactagaaataactttgcaaggagagccaaagcttagaccccgaaacagacgagctacttagacagctaaagagcacaccct

SEQ ID NO: 4230 - DNA, 110 bp, Homo sapiens
cttaactaacattctgaactagttagtgcagctcttcattgtgttgtgtgggttggtctcataactagggtgagtttttctcctctgctgagggaacagtaccgaggttc

SEQ ID NO: 4231 - DNA, 205 bp, Homo sapiens
caaaaatatttagctgcagagaacaaaggggaaggattaggtcatccaggtggccaacaagtattacaaaccacacttgcactgaaagcaaaagcaaaaatcagatgggggaaggaaagtttgcccataatgtgggcttctactaacctcttcccttcaccattacctcatttctctaccacaaagggcgggaagagacagcagg

SEQ ID NO: 4232 - DNA, 210 bp, Homo sapiens
attaatatagccactccaactctcctatggtactgtttttatggcatttttccccatccctttactttcaacctatttttatctttaaatctaatgtgtctattgtaggtagcatatagttagatcttgcttttattagtcagtcaatctctgacttttgcatagcatttagagtgttcatatttaatgtagttattgatattggtcaat

SEQ ID NO: 4233 - DNA, 110 bp, Homo sapiens
gtgggcatcagcaatctgtgggctctgctcatcagggttttctgtcgagagctggaagctagcaaactactgttatttctagtcttccataaaggacaactttttttcct

SEQ ID NO: 4234 - DNA, 112 bp, Homo sapiens
ctcgtgccgaatttcggcacgagcccagattgaggtggttccttctgcctctgccctgatcatcaagccctcaagggaccaccaggggccaggagaggagaccaggaaacac

SEQ ID NO: 4235 - DNA, 149 bp, Homo sapiens
tttgaacatcaacagaagagctggagaaagtttgcaaccccatcatcaccaagctgtaccagagtgcaggaggcatgccagaggaatgcctgggggattttctcgtggtggagctcctccctctgtgtggtgcttcctccaaggcccac

SEQ ID NO: 4236 - DNA, 167 bp, Homo sapiens
ggctggagtttgagaaggtctacttcccatacctgcttatcagcaagaagcgctacgggggcctgctcttcttcttccggcccgacggccacgaccgcatggacttcaagggccttgaggccgtgcgcagggacaacttcccccttcgtggccaacctgtgtgcact

SEQ ID NO: 4237 - DNA, 158 bp, Homo sapiens
ccaagaaggagatcaaagacatcctcatccagtatgaccggaccctgctggtagctgaccctcgtcgctgcgagtccaaaaagtttggaggccctggtgcccgcgctcgctaccagaaatcctaccgataaggccatcggtgactcaaaactcacttg

SEQ ID NO: 4238 - DNA, 150 bp, Homo sapiens
caaagttgtcgctattgtgcttcatccgttcagctgaacaggaggatggatacagccgcgagtaaaaaaacggatttcctcttcctagcttaaaatctgatttacactgttttgttttttaagaaccaaaagtgccatagtttaggattt

SEQ ID NO: 4239 - DNA, 183 bp, Homo sapiens
ggcctcttcccttggggagggggccacctgtagtatttgccttgatttggtggggtacagtggatgtgaatactgtaaatagcttgtgctcagactcctctgcgtggagagggtgggtgcaggaggcagaccctcccccaaagcccccttgggagatcttcctctctctatttaactgtaact

SEQ ID NO: 4240 - DNA, 120 bp, Homo sapiens
cctggggtgtattaactttgtgtatatagtgtaaatatccccactgtactgttaggagggcaacaattcttaggtattggcttttttgcaaagagttctacaacctttcaatgaaacaat

SEQ ID NO: 4241 - DNA, 180 bp, Homo sapiens
gccgatcccaggtgcgtgtgtctctgtctctcctagcccctctctcacacatcacattcccatggtgggcctcaaggaaaggccccggaagcgccaagcttggagataacagccttttgcccgtcggcccttcgtcggcccttgggtaccatgttggccacaacttctgttggcccctgt

SEQ ID NO: 4242 - DNA, 148 bp, Homo sapiens
gcaaaatgacccaccaatgggaagcagctggcttcactgctcaggtgattattctgaaccatccaggccaaataagcgcggctatgccctgtatttggttgccacaaggcttacattgcatgcaaggtttctgagcttaagggaaagg

SEQ ID NO: 4243 - DNA, 140 bp, Homo sapiens
caaaggagaaaaacagtgaaaaagccaatttcacttgttcgttcaattccagcttgttgctaatattagttacccttgtttttaattgacagagagttggcttggaatctgtagcttaggggaggggccacaattttagg

SEQ ID NO: 4244 - DNA, 175 bp, Homo sapiens
ggcataaaatccactgtctgccagcctcccttccctcccacctttttgggtacattggtgtaaaaaatgtaaaacaaaaaaattttatgaactaactgtggtgtgtgaaagagaggaggaaaactggaaatcttattccgtgtgtgtttgggagttgcttggggttgggggtcgt

SEQ ID NO: 4245 - DNA, 255 bp, Homo sapiens
gtggaggagatgttaaagtaacccatcttgcaggacgacattgaagattggtcttctgttgatctaagatgattattttgtaaaagactttctagtgtacaagacaccattgtgtccaactgtatatagctgccaattaggtttctttgtttttactttgtgctctgctatctgtgttatgactcaatgtgggagtttgtttatacacaatttatttgtatcaattcaagtaaaacccaaataaatgctttcccc

SEQ ID NO: 4246 - DNA, 188 bp, Homo sapiens
ctcgtgccgaattcggcacgagcctaaacctgtattttagtgttgtgaactccagtggtttcaagtcactaaagtttcttaagtcttagtgttttcttaagcagttttcccttgtggctccctggcgtgttctctcctgacttttgttccctgcccttagtgttatttcccccctttctatccccaaa

SEQ ID NO: 4247 - DNA, 124 bp, Homo sapiens
cccccttcccccttttttgtcccccaacttgagatgtatgaaggcttttggtctccctgggggtgggtgggggcagccagggcttacctgtacatttactttagaccaattggaattaaagttc

SEQ ID NO: 4248 - DNA, 150 bp, Homo sapiens
gttttctttacagagaatgatccttttaaggcttgtaaggccctctggtttggacaaaaaccctcagttagagacaaagccgggagggattatttagctgaaagctatgatgatatatataaaaccagctctctatcccaatacgcacct

SEQ ID NO: 4249 - DNA, 150 bp, Homo sapiens
ggagtagttaccataagaacctgttagctagcagtgattatgaaggcactgttattttatgggatggattcacaggacagaggtcaaaggtctataaggggccatgagaaggggttttggagttttgactttaatttgatggttcccaaa

SEQ ID NO: 4250 - DNA, 180 bp, Homo sapiens
gttgcatagactagtcctatggaaaaaaccaagcttcgttagaatgtctgccttactggtttccccagggaaggaaaaatacacttccacccttttttctaagttttcgtctttagttttgatttttggaaagatgttaagcatttatttttaggtaaaaataaaaactaatttcatact

SEQ ID NO: 4251 - DNA, 210 bp, Homo sapiens
caaatgtcaacgttcattatcaactaaagaagtggtttcagaatggcatccacaatttacaaacctgttgttttaagcagggcatttaccctaagggaaatgtcttctttgagaaaaaatttgggaattgtcaaaccaaaaacaattgaaaatcttgcccaaaaatcttgtgtccctttccccggatgtcttctgggtatctcgggccct

SEQ ID NO: 4252 - DNA, 207 bp, Homo sapiens
cgaggccaggtctccagctggggtggacgtgcccaccagctgccgaaggccaaggacggcaaggtcccggtgggacggtaaacaaaggcagggaaaatgaaaattggttcgggtgtttacgggcgagggacaaagggagggcgcggttccgcccctttcttaaaaaaccttaagggcttggttggggcttccgcaaaaaagcgcggg

SEQ ID NO: 4253 - DNA, 175 bp, Homo sapiens
ggacagtcagttttagggttgcctgtatccagtaactcagggcctgtttccccgtgggtctctgggctgtcagctttcctttctccatgtgtttgatttctcctccaggctggtagcaagttcttgatcttatacccaacaaaaagcaacatccagaaataaaggtctctaggcc

SEQ ID NO: 4254 - DNA, 150 bp, Homo sapiens
gttatctatacacagtgtaagatttaacaaactgaaatgatccacctcatatgtgagtccgtccaaaagatgttactgctctgggtgggccagtgttctatatcggttatactaactttcatttaaagtatttattctaaaatgcccctg

SEQ ID NO: 4255 - DNA, 325 bp, Homo sapiens
cgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtgcctctgcaagggccgagaggtgtacccgcatttcggcaaggccccaggaaccccgcacagccacaacaaaccctatgtgcgctctaaggggcggagttcgagcgtgccaaaagccgacgggca

SEQ ID NO: 4256 - DNA, 368 bp, Homo sapiens
gaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagacagatgctaaaagttttgtgcactctttgtgtgtgtaatgcacattagttaaaacacatagttttggagagagttaaaactagctctagagtaaggatgagaaactcgagtgtttttaatataaagataaaagcct

SEQ ID NO: 4257 - DNA, 333 bp, Homo sapiens
aagagactggatgctgcttatcgttccatgaacgggaaaggccccgtttacttacttttcagtgtcaacggcagtggacacttctgttggcgtggcagaaatgaaatctgctgtggactacaacacatgtgcaggtgtgtggtcccacggacaaatggaagggtcgttttgatgtcaggtggagtttttgtgaaggacgttcccaatagccaactgcgacacattcgtctagagaacaacgagaatataaccagtgaccaactctagggacactcagggaggtgtctctcgagaaggctaagcaggtgttgaaaattatagccagctacacgc

SEQ ID NO: 4258 - DNA, 250 bp, Homo sapiens
ccgaccctgccgatgtggccatccagctgaccttcctgcgcctgatgtccaccgaggcctcccagaacatcacctaccactgcaagaacagcgtggcctacatggaccagcagacttgcaacctcaagaaggcccttctcctccagggctccaacgagatcgagatccgcgccgagggcaacagacgcttcacctacagcgtcactgtcgatggctgcacgagtcacaccggagccttgggcaagacagt

SEQ ID NO: 4259 - DNA, 210 bp, Homo sapiens
tggagatgaagagcaggagaatgaagtcttttctctcttaatgtttaatcagcattaacgcacctttaagtgccattggatttagagcagtgttgttattaaagcaaactaaattgtcttgaagtgtagaaagcacttttagaaaaagaagcaaggttaggcttagagaacaagacagattaaggtacttctcttagcttgaaaagatct

SEQ ID NO: 4260 - DNA, 137 bp, Homo sapiens
tcagtctgcattttcgatcatgggctacatgccgagtgctggggcacagagatgacacaagatcgggttccttcacttctttcatgccacaagggtttattgagcaacctgttgttgccaaggcctcacaagattcc

SEQ ID NO: 4261 - DNA, 140 bp, Homo sapiens
gcaaaatacagtgccttcaaaatgattctctgtgtgaattgcatgcactttcatgtaaccatagagtgtaacctgtatgtgcatgaccatgtgtctggagtgtgttaaggtataggatacagcaggagggggccttggcc

SEQ ID NO: 4262 - DNA, 170 bp, Homo sapiens
cggcacgagcccagatgcgcctgcttcctctgcgccagaagaaggcccacctgatggagatccaggtgaacggaggcactgtggccgagaagctggacttggccccgcgagaagcttgagcagcaagtaactgttaaccaagtgttttggcaagatgaggtgatccgagt

SEQ ID NO: 4263 - DNA, 188 bp, Homo sapiens
taaacattcatattgttttcaaacttggaattcatagacactctggctctaggttccttaagggggaaaacaaaagatgactttatttcacattcaagaaaatcagttcagttccaaagctgtgggtccttccagccacttctagggacactggggaaccttgttaaacgttgacatcagttctctcc

SEQ ID NO: 4264 - DNA, 370 bp, Homo sapiens
ccaacatccagtattttatcttgactgtcctaaccttaccttagatgctaacagaagggtcctgctgaaataacactgggtgctatattgatgggtaaatgtgtacatcctattccttcctctttatcttacaattttttgtcttccccttaggcaaggaggtaacttaccatttcggctacttttaaggaattacttttgtgaaaaccctttaggaaccccgtgttgtgtttcaatgtggggtaattgggcccaagggtggggggccattttttttgggtcttctaggagggaaaaccatcttgtgtcaccatttttgatattaagaggttatggggacatcaacggcatcgaaaagggctacttctta

SEQ ID NO: 4265 - DNA, 104 bp, Homo sapiens
cggcacgagagtacttctagagcggccgcgggcccatcgattttccacccgggtggggtaccaggtaagtttacccaatttcgccctatagttagtcctatttc

SEQ ID NO: 4266 - DNA, 282 bp, Homo sapiens
gtcagacaggaggcggcatgacttgaaacagagtgcagtgccctctgactgggctgatgtgtttatttgggtctactgaaaaataacacagatgattcaaatgtttgagctgtataagaccaaaagtgtttggcctcacctcagtcagaggcatctgtggggcttgagcatggtactcaagtgaaggagttctcaggatagggggcaacagtgtccagtgtaggctgagaatagacccaggatttccaggcccagctaggagaaagttggcaggaaagcggg

SEQ ID NO: 4267 - DNA, 355 bp, Homo sapiens
gcaagatggccgggtgaaaaaagttgagaagccagatactaaagagaaggaaacccgaaggccaaggaaggttgatgctggtggcagggtgaaaaagggtaacctcaaagctaaaaggcccaggagggggaggccccattgcagccgcaaccctgtccttgtcagaggaattggcaggtatccccgatctcccatgtattccagagaggccatgtacacgaggaagtactcagccgctaaatccaggttgaaaagaaaaagagggagaggttctcgcacctttaacaaaccagttggtggtgacagaacggcggtccccgggtggttaacctgcgcaaatgcctagatattatcc

SEQ ID NO: 4268 - DNA, 350 bp, Homo sapiens
ggccgcgttcgcaccaaacccgtgaagaaggcggcccgggtcatcatagaaaagtactacacgcgcctggccaacgacttccacacgacaagcgcgtttccgaggagatcgccattatccccagcaaaaagctccgcaacaagatagcaggttacgtcacgcatctaatgaggcgaattcagagagccccagtaagaggtatctccatcacgctgcaggaggaggagagagagaggagagacaattatgtccctgaggtctcagccttgggttcaggagattatggaggtagatcctcacactaaggatatgctgacgcttttggcctccgccagtctctcacccttcag

SEQ ID NO: 4269 - DNA, 301 bp, Homo sapiens
tcacagattatctttggggccttttcattagaaagctgtttgtttgtccccctgttggtacatttgggttacctcattttgccgtttcagattgtgaaagctcacagggggtgtttttggaatcatttgctggagtcattttctcaaatcatattccattgtatcagttaacatatagttttaaatgtatgtatttataaatatctgtaaccaaatcatttgaggccttgataatatttttaacacgtttgtacattttttatgagagttactagtaatgctttactaaggtgtgcaatga

SEQ ID NO: 4270 - DNA, 351 bp, Homo sapiens
gactgaggaagacccggaaacttagggggccacgtgagccacggccacggccgcataggcaagcaccggaagcaccccggcggccgcggtaatgctggtggtttgcatcaccaccggttcaacttcggacaattaccacccaggttactttgggaaagttggtatgaagcattaccacttaaagaggaccagagcttctcccaactgtcacctagacaaattgtggactttggtcagtgaacagacacgggtgaattctgctaaaaacaggactggggctgctcctatcattgatgtggtgcgatcgggtctactacaaagttctggaaagggaaagctcccaaagcagcc

SEQ ID NO: 4271 - DNA, 353 bp, Homo sapiens
gtcgagccaagactcgcggctacgagcacgtcgacatccagaacttctcctccagctggagttattggatggccttctttgccctggtgcaaacttttttcccttaggccttcggcttatggcaagtttagcccttaagacccgcgggcaagaccttggaggtgccttttaatttccgggagcccatgcggactcccgaagctcctggatacagaggacatggtgcgtcttcgagagcctcactggaggtgcgtatacacgtacatccaggaattctaccgctgtctggtccagaaggggcctggtaaaaaccaaaaagctcctacccccttctcggggccccgasgtatcct

SEQ ID NO: 4272 - DNA, 156 bp, Homo sapiens
taaggactgtatttatttattaatttaagacagaatcttgccctgttgcccaggctggagtccaatggcgtgatctcaagctcacttcaaacccccgctttcctggggtcaaagtgattttttcccccccaagctactccgaaggctgaggaaggg

SEQ ID NO: 4273 - DNA, 260 bp, Homo sapiens
gtgaaatgtattatcaccagcagacactgccgggcctccctcccgggggcactgcctgaaggcgagtgttggcatagcattagctgcttcctccccttctggcacccactgtggcctggcatcgcatcgtggtgtgtcaattccacaaaatcgtgtgttcgtggaaccagtcctagccgcgtgttacagtcttgcattctgtttgtctcgtgggggggaggtgacagttcttcggaaatgtgtcttgtctccaatttggr

SEQ ID NO: 4274 - DNA, 137 bp, Homo sapiens
ctggagcataatgaagtggaaccgtgagcgcaggcgcctacaaatcgaggacttcgaggctcgcatcgggctggttgccactgtttacaggcagaaaccgaccgaaggaccctgccagatgtttcggggggaaccgg

SEQ ID NO: 4275 - DNA, 335 bp, Homo sapiens
ggatgacgtcatgcttctggacaccttggaccaggtctttgtcttggttggaaaggattctcaagaaggaggaaaagacagaagccttgacttctgctaagcggtacatcgagacggaccagccaatcgggatcggcggacgccatcaccgtggtgaagcaaggctttgagcctccctcctttgtgggctggtttccttggctgggataatgattactggtctgtgaccccttggacaggccatgctaagctgctccctaggaggggcaggccacccatataccgatcagtgcttttgactgttctccataaagaggctagagcagaagagcagc

SEQ ID NO: 4276 - DNA, 114 bp, Homo sapiens
gcttgccacaattcccggggacaattgattccagacatcttggccgccccccaaaggtatgcttttcacctttcgaaaggagagctgttgttctgccggacccccgaggaaaac

SEQ ID NO: 4277 - DNA, 115 bp, Homo sapiens
ggcaaacatggaaaccctggtgaaacttgtccttctcgtcctttggggtctcctggtttctgtttgcccaagaggttctcagttgcccacaaggcattttgttgcgcataaggga

SEQ ID NO: 4278 - DNA, 200 bp, Homo sapiens
tgtgagtccaactcttctaaaggaacctctcttggcaacccagcagggaaaggaaggcaaggaggaaccaaacaatctacttgttccttcttcccagtttttagcaaagatgaaaggacttcccttcagttgccatatagaaactctttaatttttcaccaaggcagagaccctctcattttcataacaaattgtatacc

SEQ ID NO: 4279 - DNA, 108 bp, Homo sapiens
agagcagctacgaaacaagccttctgaccttggcacgaaactacaagattcccggatcatgaacactcttagcgttctccttggggtcgatcttggcagtattgatga

SEQ ID NO: 4280 - DNA, 135 bp, Homo sapiens
ttttgctgagatggctgccagtcttaagcgtccagactcaggtgcacttggctttcttcggagggcttgcccttctgtggtcccccggcccttctgtgagagagatgtgtgtttccacagccagatatgggagat

SEQ ID NO: 4281 - DNA, 150 bp, Homo sapiens
gctgttcatacggcagttattcttggattccgtcgtaacttaaagggtaattttcacaatgtgccgagtgcctttattgattcctcaaattaaggagggggggtgttcctttaggttcctgcaggaggggacccacttttaggtgcacac

SEQ ID NO: 4282 - DNA, 110 bp, Homo sapiens
gctacttcctttgtcaccactgctgaacgtgaaattgtccgtgacattaaagaggaggctgttctattgttcgcccttgaatttgaggattaggttgcccacacttgctc

SEQ ID NO: 4283 - DNA, 110 bp, Homo sapiens
attcagttctgtagagttagaataccgtttgttgttggagatgtgagttgagtattagaatggtacaatagagtgttgaatgcaattgtgggtgcaattgtgataaatag

SEQ ID NO: 4284 - DNA, 151 bp, Homo sapiens
ctcgtgcgaattcggcacgagagcagacagcatgagccacggagcccagcaagccttgaggagaaccattggaatctactctaaagccacttgcttcggcccttgcttgtaatgcttcggataaggtcatcgagcccattcagtgcccgct

SEQ ID NO: 4285 - DNA, 133 bp, Homo sapiens
gcaactagcaaaaatctgcataatgcaacaacacagttttcacacttcaaattttacatgaggggttcttcacggttcttcttggacccagtcttgcaaaattagaggggaaggccctatgggagatttattt

SEQ ID NO: 4286 - DNA, 145 bp, Homo sapiens
ctctccagatggatccctctgtgcttctggaggcaaggattgccaggccatgttatgggatcttaacgaaggcaaacacactttacaaggtatgatgtgtgtgggacatcatcaacggcctgtgtcttcagaccctataccccgt

SEQ ID NO: 4287 - DNA, 160 bp, Homo sapiens
ttttttgtattttctccataattattgtgatgttatcaacatcaagtaaaatgctcaatttcatcaattgcttctgttcaagttttcttgaacacaggcttcaattttccttccaaaatgctgcatgccacacttgaggggaacggggcagaagggattt

SEQ ID NO: 4288 - DNA, 157 bp, Homo sapiens
aaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctt

SEQ ID NO: 4289 - DNA, 220 bp, Homo sapiens
gtcacctcaaggtgcagcccttttgcacttaagtggatctcctggcatgagttggctgagtgagtccttggtccagcccagagccacagcctttgacctcttggagcagccagaacttttgtgaccccatgttcaggggccagctgcccagttttggtaaggagcatttcttggacctgacagatagaagcttttagcatggtcacttttaggagggcct

SEQ ID NO: 4290 - DNA, 270 bp, Homo sapiens
tggaagtgacatcgtctttaaccctgcgtggcaatccctgacgcaccgccgtgatgcccagggaagacagggcgacctggaagtccacctactttccttaaggatcatccaacttatttggatgattatccgaaatgtttcattgtgggagcagacattgtggggctccaagcagatgcagcagatccgcatgtcccttcgcgggaaggtctgtggtgctgatgggcaagcacaccatgatgcgcaggccatccgagggcacctggaaaa

SEQ ID NO: 4291 - DNA, 163 bp, Homo sapiens
ctcgtgccggcttaatgaacatttttaaaaataattaccaaggcctcccttctacttgtgagttttgaaattgttctttttattttcaggggtaccgtttaatttaattatatgatttgtctgcactcagtttattccctacttaaatcttaagccccatggt

SEQ ID NO: 4292 - DNA, 215 bp, Homo sapiens
ttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattccccttgcccctaccccctctttttggaagatattttgattccttataaacttttaccccaagct

SEQ ID NO: 4293 - DNA, 305 bp, Homo sapiens
gcgccggctatgccctgtattggattgccacacggctcacattgcatgcaagtttgctgagctgaaggaaaagattgatcgccgttctggtaaaaagctggaagatggccctaaattcttgaagtcttgtgatgctgccattgttgatatggttcctggcaagcccatgtgtgttgagagcttctcagactatccacctcttgggtcgctttgctgttcgtgatatgagacagacagattgcggtgggtgtcatcaaagcagtggacacagaaggctgcttgagctctgcaaggtcaccaagtct

SEQ ID NO: 4294 - DNA, 233 bp, Homo sapiens
ctttaccagaaaaaacatggtattaaactctataaacctctcattctccctgtgactcaggccccaatcttcatctccttcttcattgctttgagagagatggccaaccttcctgtgcccagcctgcagacaggtggcctcttgtgggtccaggatctcacggtatccgatcccatctacatattaccactggcagtcactctctacaatgtggggctgttcttgagctatgg

SEQ ID NO: 4295 - DNA, 180 bp, Homo sapiens
tcgcttcgaagcgaaaagtcctaatagtagaagaaccctccataaacctggagtgactatatggatggcccccaccctaccacacattcgaaggacccgtatacataaaatctatgacaaaaaagggagggatcggacccccaaagcttgtttcaagccaaccccattggcttcatgact

SEQ ID NO: 4296 - DNA, 190 bp, Homo sapiens
gagaggctgagggactcactggagggcaccaaggcagcccacagccagggaaggttgggagggggggcggaaacccatgcctcccaactgagcactgggaatgtcaacccaataagtattggccagatcaagcgcctcgtggtcagagcagagccaccaagtgccactgtcccgagacctgcacaaacct

SEQ ID NO: 4297 - DNA, 198 bp, Homo sapiens
cgggtgacgtccaggagagggagcgccctggctgcccctcggccgccgactggacgcgcgggccttgccagcgagcaccctcatcgggctgtcgctgacagcatacctcaaaaggccctagctaataaacctgtaagcccagcatttgagagaaggtagggtgtgtatatataaaaggttgtgtacaactccacgagg

SEQ ID NO: 4298 - DNA, 117 bp, Homo sapiens
cttaggtgcacagctgttcaatatacacagagaacagaaatattcctactgtctttggaaacccttggtgtacctcttagttggcaggaataaacatcaacacaggttcaaggactt

SEQ ID NO: 4299 - DNA, 89 bp, Homo sapiens
agtacttctagagcggccgcgggcccatcgattttccacccgggttgggtaccaaggtaaggtttacccaattttggcctatagttagg

SEQ ID NO: 4300 - DNA, 139 bp, Homo sapiens
ttgggagtcttccaaaccaccttccctcatctttcatcaatcattgtacagtttgtttacacaacgtgccattttggtttgtgcctcctaatatttattggccttattaaataaacccagccccaggctttgcaaccct

SEQ ID NO: 4301 - DNA, 160 bp, Homo sapiens
tctagggccaccaggctgaggactcgcccaggacaagagacttgtctctcagacccctggggccaacaatgtaaggccaacaacttcaaggccgttggaatttcccccaacatttggggagcaaagcttatttcccaaaatgtcttttatacccttttga

SEQ ID NO: 4302 - DNA, 95 bp, Homo sapiens
aggagctggggtggsccctgagctccaacggccataacagctctgacttccacggtgagggccaaccttttgggtgcaaccccaagttgggtgtg

SEQ ID NO: 4303 - DNA, 136 bp, Homo sapiens
ccacctgtaatcctagctactcaggaggctgaggcagaagtgcttgaatccaggaggcagaggttgcagttagccagcagattgttgccaatggacttcagcccttgggcaaccaagcagcaaaaacttcctctca

SEQ ID NO: 4304 - DNA, 206 bp, Homo sapiens
gagtaaaaccttttatgacaggggctgcagaacaaatcaagcacatccttgctaatttcaaaaactaccagttctttaattggtgaaaacatgaatccagatggcatgggtgtctctattggactaccgtgaggatgggtgtgaccccatatatgacttttctctaagggatgggttagagatagggaaaatgcttaacacactgt

SEQ ID NO: 4305 - DNA, 172 bp, Homo sapiens
gatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaat

SEQ ID NO: 4306 - DNA, 325 bp, Homo sapiens
caaacagaagctttattcgagaacaggtgaatcagttgaatttgtgtgtaaacggggatatcgtctttcatcacggttctcacacattgcgaacaacatgttgggatgggaactggagtatccaacttgtgcaaaaagatagaatcaatcataaagtgcacacctttattcagaactttagtattaaatcagttctcaatttcattttttatgtattgttttactcctctttattcatacgtaaaattttggagttaatttgtgagaatgtaattataagctgagaccgcgtggctctcttcttaaaagcaccatattaaatcct

SEQ ID NO: 4307 - DNA, 334 bp, Homo sapiens
tgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaacactgtatgatggttgtgcgtccagaaaaggctattaaaagactgtcattgagatcaatacaccaaaaattgatcaagtacctattgttgatgtcatgatcaatgacttttgtgatcagaatcagaagttcggatttgaggttgggctctttgttttctttgctaagattaagaca

SEQ ID NO: 4308 - DNA, 283 bp, Homo sapiens
ggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttcccctgcaggagcaggttcttgggagccgtgaggcaggaggacaattaggtcctgaatctcctgcaaaaatggtctgcctggaggccctaggccaacagaatctcagtaaacacgctgtcacccctgg

SEQ ID NO: 4309 - DNA, 312 bp, Homo sapiens
aacacttatgtgattgagccattgcataaaattactattaaagcctcatcttgattttatagggattggctattcatcatggctggagacttcctgaatataccctttcccaggagggaggacctctctcataagagagaatatactacaatttgcaggctagagtcatttatggagactggacaagggggcatcaaaaaagcaagccaaaaggaatgctgctgagaaatttcctgcccaatttagtgatatttctccgagaccccatatctctaacacatgtagtaggcatactctagggtgtactctgca

SEQ ID NO: 4310 - DNA, 246 bp, Homo sapiens
ttgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaagggttgtgccacatagacaatatgttactaaatcagcactttaaaatca

SEQ ID NO: 4311 - DNA, 265 bp, Homo sapiens
gacacccacccacccagtgttatattctgcctcgccggagtgggtgttcccgggggcacttgccgaccagccccttgcgtccccaggtttgcagctcttccctgggccactaaccatcctgggcccgggcttgcctgtctgacctccgtgcctagtcgtggctctccatcttgtctcctccccgtgttcccaatgtcttcagtgggggggccccctcttgggtgccctcctctgccatcacctgaagagccccacggccaaacac

SEQ ID NO: 4312 - DNA, 160 bp, Homo sapiens
agtgtaaaaataagtatttacatagaaagacagactgaatggatgcacggtgaatgcatgaatgattgaacgacagacaagatttgcattgaccgatgaggagggcattttagagagggatgagggtcattgatccttgggtgcagatcttcaaaagaat

SEQ ID NO: 4313 - DNA, 235 bp, Homo sapiens
gcaggatcaaggtgaaaaggagaaccccatgcgggaacttcgcatccgcaaactctgtctcaacatctgtgttggggagagtggagacagactgacgcgagcagccaaggtgtttggagcagctcacaagggcagacccctgtgtttttccaaagctagatacactgtcagatcctttggcattccgagaaatgaaaagattgcttttcacttgcacagattcgagggggccaag

SEQ ID NO: 4314 - DNA, 195 bp, Homo sapiens
ctcgtgccgaattcggcacgagtatgtgtgcttctgtttatgttgtcatcactcattccttcccctgtcctatttgggagggctctaaatggatcttctaacttataaatgtcaaatatatttttggtattagagtgtgcctatgatgagagaaatcttaaatgtatattttatgtatgctgacacattttatta

SEQ ID NO: 4315 - DNA, 102 bp, Homo sapiens
ccgtccctggatgctgtccggagcgatccggcagccagcttcttggaccatcaggggcggggaccctcctggcgcttccggagaagcattgcttagcacttg

SEQ ID NO: 4316 - DNA, 205 bp, Homo sapiens
gagccgcaggcccgtaggaggccattggcgcccagccggaatggcatggtcttgaagccccacttccacaaggacttgcagcggcccgttggccaagttgtttcaaccagccggcccggaagatccgcagacgtaaggcccggcaagccaaggccggccgcaattgtttcgggcccgggttgggtcccattccggcccattgctc

SEQ ID NO: 4317 - DNA, 250 bp, Homo sapiens
cacgctgcagtacgcactggcctgtgtcaagcaggtgcaggccaaccaggaatactaccagcagttgagcctggaggagggcgagccttgctccatggacatgtccacctattaccctggaggagcttggagcacaattacgtgtttagtacaacctttagaaccaggtcagcggcggcctggccttttaatcccgacggaaccctattccttttcccaaaatctttgaatttctctttgtctccccctc

SEQ ID NO: 4318 - DNA, 228 bp, Homo sapiens
gaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagcgttaggagcgggctgctgagagctaaacccagcaattttctatgattttttcagatatagagaataaacttatggtcagcc

SEQ ID NO: 4319 - DNA, 315 bp, Homo sapiens
ctcgtgccgaattcggcacgagcaaagcagcagctgtattgccgcagttctagcttcaccctcacgatgtttcccctggtcaaaagcccactaaaatcgtctcccagttcgaagcattcagccaacaatggcaaggcagagccacccgaaacgtacaactgattttcatgacaaatacggtaatgctgtattagctagtggagccactctctgtattgttacatagacatatgtagcacacaagtcgggatagaatggagcccgtcccctgttggcagagttaccccaaagggatggaggagtcagtaatcatcc

SEQ ID NO: 4320 - DNA, 262 bp, Homo sapiens
gaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactatttttatatattgatgcccacttgtt

SEQ ID NO: 4321 - DNA, 286 bp, Homo sapiens
tcttgacgaggctgcggtgtctgctgctattctccgagcttcgcaatgccgcctaaggaccgacaagaagaagaaggacgcttgaaagtcggccaagaaagacaaagacccagttaacaaatcccgggggcaaggccaaaaagaagaagttggtccaaaggcaaagttcgggacaagctcaataacttagtgcttgtttgacaaagctacccatgataaactctgttaggaggttcccactcattaaacttattaccccagctcttggctctcagagactttagag

SEQ ID NO: 4322 - DNA, 272 bp, Homo sapiens
ccactcttaatcagtggtggaagaacggtctcagaactgtttgtttcaattggccatttaagtttagtagtaaaagacttgttaatgataacaatgcatcgtaaaaccttcaggaggaaaggaggaatgttttgttgacccattttggtttccttttttgcgtgtcgcagttttaaggtattagtttttaaaatcagtacttttttaatggagacacactttgacccaaatttgtcacacagttttgagagccctttaaaagtgtatgtgag

SEQ ID NO: 4323 - DNA, 346 bp, Homo sapiens
ttttcaaagaggggaaatatgaaagagcaattgaatgctatactcgagggatagcagcagatggtgctaatgcccttcttccagctaacagagctatggcctatctgaagagttcagaaatatgaagaagctgaaaaagactgcacacaagccacttttattagatggctcatattctcaagctcttgacacaagaggactccaagaacacattttgggagagctaaatgaggcaaaacacgatttttgaaactgcttttacttctcgagcctcgagataagcaagcagtactcactctccacaattaaaaaggagttattttaggaaggccactagggatgagga

SEQ ID NO: 4324 - DNA, 203 bp, Homo sapiens
gaaggtgccctgtgtcttccttaattcctggcacaatatgagagctgcaccagcgccggccgcagtgacggaaagatgtggtgtgcgaccacagccaactacggttgacgacgcaagtagggcttcttgccttgaaccaagggtacaagcctgttcctggtggcagccacgagtgtttggccaagcattgggtctgagcgact

SEQ ID NO: 4325 - DNA, 108 bp, Homo sapiens
caacagtggaagccagtagagtgctatcttgaatgttgatgaaggacaataactgcctacctaggattctaaacccagtgaaatatatgtcagattgagggctaatta

SEQ ID NO: 4326 - DNA, 190 bp, Homo sapiens
gcgttctctagcacacctgccttgttggtactgctcggcgtggaatgcctctcgggctctgacagtgtcattgacactgttgctgatctccttggatttacctggtccatttggatcaagttctttcacctattcacatgagcagatatcaccttaaaaccttaaaggttggcttaacacttctcgccct

SEQ ID NO: 4327 - DNA, 212 bp, Homo sapiens
cggaagacctcttatgctcagcaccaacaggtccgccaaatccggaagaagatgatggaaatcatgacccgagaggtgcagacaaatgacttgaaagaggtggtcaataaattgattccagacagcattggaaaagacatagaaaaggcttgccaatctatttatcctctccatgatgtcttcgttagagaggtaaaaatgctgaagagccc

SEQ ID NO: 4328 - DNA, 195 bp, Homo sapiens
acgagggatggcccctccgggaaaactgtggcgtgatggccgcggggctctccagaacatcatccctgcctctactggcgctgccaaggctgtgggcaaggtcatcctgagctgaacgggaggttaactggcatggccttccgtgtccccactgccaccgtgtcagtggtggacctaacctcccgtctagaaaaa

SEQ ID NO: 4329 - DNA, 212 bp, Homo sapiens
aagaagcactaacatagctgcagctgccagtgagccacactcctgagacactctctatattgcctgcactcctgtaacaaccataatttttccatttcattgtatggtgtttggccattgttggcctgtggattcccttagagtgtaagtctgtttgttttcaattgtctgaccttcagcaggagatgtgatacaacttgggcactaaggga

SEQ ID NO: 4330 - DNA, 213 bp, Homo sapiens
caacagcttttgccactcgacttttccaacatttttgttattggcaagggcaacaaaccatgggatttctcttccccgaaggaaagggtatccgcctcaccattgctgaggagagagacaaaggactggcggccaaacagagcagtgggtgaaatgggtccctgggtgacatgtcagatctgtgtacgtaattaaatatattgtggcaggaga

SEQ ID NO: 4331 - DNA, 215 bp, Homo sapiens
gtctcacagaaagttctccgctcccagacatgggtccctcggcttcctgcctcgggaggcgcagagcagggcatcgtgggaaggtgaaagagcttccctaaggatgacccgtccaaggccgggtccacctaacagccttcctgggttacagggctggcatgactcacatcgtgcgggaagtcgacaggccgggatccagggtgcacacgaaggag

SEQ ID NO: 4332 - DNA, 135 bp, Homo sapiens
gaagtgccatccaatgccacctgtccatggaggagtggccctgcagcttccacagctgcatgacctgcttcccacccaasggtgtcgttttgttttaaaggtaactgtcctaataacaagcaagccttaaggtcc

SEQ ID NO: 4333 - DNA, 275 bp, Homo sapiens
ggattaagagggtttttcttaaatattagcttttaatgtgtacaattaggaaattttttttaagtgaaggactctctacccttgccgtatctaaggagctgaggtaatacagatccaaggagaatttgtatagcaagaaaaaaccagtcacctacagaaactcttaaaaggataaaaacccaaagttccttattttgaaattgtcaaagacaaagcgggtgttttccttttaacaggtgatcacgtgtcgcgttcatactcaccggtaattaaag

SEQ ID NO: 4334 - DNA, 270 bp, Homo sapiens
cggcacgacttacagacacccttaccccccccactgtacagagaccaagacagaaattgtttgtaattaatggaccttattttttattattgccaatccccttagggtattggattttacaaatctgcctcttcccttgggccctcccttggtttatattttatgagggtaggtcgggcttttctggtcctgggcccagggaaagggggctatcctacccttacttgggaccccctgtgttgtcccaagcgctgtgggcttttaattcca

SEQ ID NO: 4335 - DNA, 140 bp, Homo sapiens
gcgacatggcaaacgtaccaggaagtcgggatcgtcggtaatacgggaccgctattgggccttccttccggaaattggtgaggaaatttgaattcagccagcaggccaaggtccatttccctttcctttggccaaaccag

SEQ ID NO: 4336 - DNA, 197 bp, Homo sapiens
gttgcagtgagccgagatcataccactgcactccagcctaggcaacagagcgagactcggtcaaaagaaaaaaaaaaaggggagctgggcgtgggtactaatgccgtaatcccaggcctttgggaatcccaggcaaggtggcctttagggcaaggagttcggaacctccctgctaacaggtaaaccccctttccctt

SEQ ID NO: 4337 - DNA, 113 bp, Homo sapiens
ctcgtgccgaattcggcacgaggattactaccaaccgtcactatgatgaggactctgccaattgggtccccgggagccccttacggctttaggcattgggccaagcgtcaact

SEQ ID NO: 4338 - DNA, 160 bp, Homo sapiens
caaacggtagttttgtgtgttggctgctccactgtcctctgccagccttcaggagggaaaagcaaggcttacagaaggatgttccttcaggaggaagcagcactaaaagcactctgagtcaagatgagtggggaaccctctcaataaacacattttggat

SEQ ID NO: 4339 - DNA, 290 bp, Homo sapiens
gctgtttcagccaggaaggccaaaatcaagagtgagatgtagaaagttgtaaaatagaaaaagttgaggtttgtgaatcggttgttctttcctcacatttggatgattgtcataaggtttttagcatgttcctccttttcttcaccctccccttttttcttctattaatcaagagaaacttcaaagttaatgggatggtcggatgtcacaggctgagaactcgttcacctccaagcatttcatgaaaaagctgctgcttattattcatacaaactctcaccacgatggtg

SEQ ID NO: 4340 - DNA, 267 bp, Homo sapiens
cgcccagggaaagcggcgttatgacaggaagcagagttgctattgtgggcaaactcaagccgattttccggaaaaaggctaaaactacaaagaagattgtcctaaggcttgagtccgttgagcccaacttcagatctaagaggaatcctggctattaaaagatgcaagcattttgacctgggaggggataagaggagaaaggcccaagtgatccagtcctaggtgtcaacttttattatgaggcaataaaatcttaagtttatgttc

SEQ ID NO: 4341 - DNA, 195 bp, Homo sapiens
cgcggcacctgtacctccggggtggcgctggggttggctcatgaccaagatctatgggggcgtcagagaaacggcgtcatagcccagccaattcagccgagcgtccaagatgttgcccccccggtcctccaagcccttgaagggcttaaaattgtgtggaaaggccaagattgcggcccaaactctcaactctaa

SEQ ID NO: 4342 - DNA, 225 bp, Homo sapiens
tctcaatccagcacagcgaaggcgggacaggattcctctcttcattacagatgaggaaactggggtgtttggatggtggggggcatgcgcattgtccaagcccacacagagccaacattagagcccgggtctaagattctccccccctttacccccttccctgctccaaatattcccacactttcccacttttaggagattgcttcctctttttccaaatggcaa

SEQ ID NO: 4343 - DNA, 100 bp, Homo sapiens
ggaaaccagaggcattgacacagggttcgtagaagattcaagggccagatcttgattgcccaccattggtaatgggaggcaccaaaaaaccaaggcacat

SEQ ID NO: 4344 - DNA, 230 bp, Homo sapiens
gccgccgctaccaccgcgttcgggtgtagaatttggaatccctgcgccgcgttaacaatgaaggcagaggttcgaacgtgcccggctttcctccagcaagctgtcggacgcttgtggaggaaacccacactaacgagttcatcacctggagccagatggccaaagttttctggtctctggatgagcaacgtattgcaaaagacattcttcccaaatatttcaagcacaat

SEQ ID NO: 4345 - DNA, 310 bp, Homo sapiens
ctgagaccaacactacacttgacccttcacggaatccagactcttcctggactggcttgcctcctaccaacctcccaaccctggaacccctaagggccaaccagcagagtggagctgagctgtggacctctcgggcaactctgtgggtgtgggggccctgggtgaatgctgctgcccctgctggcagccaccttgagacctaaccgggcctgtgatatttgctctcctgacctctcactcaatcctcttcctttcctctgtggcttttcctgttattgtcccctaatgataggatattccctgctgccta

SEQ ID NO: 4346 - DNA, 245 bp, Homo sapiens
cttgccgaagacctctgaagtacgctggagctgtgttgtacaggtgctgtgagacctaccctattcagaattaaacctcactgcaaatttcctccatcacgagctaacaacactaatatacgtatttagcacctctcaggctttgccattggagacccatttctgtagggctaaggaacatttagacgtggtacttacttcaatttgacttgcgaaggtatcttagaacacccgctttggcttct

SEQ ID NO: 4347 - DNA, 208 bp, Homo sapiens
gcccttcgagcaccacgcaagaagatccatcgcagagtgctcaagaagaacccacttgacaaactttgagaatcatgttgaagctaaacccatatgcaaagtccatgccgccggaccaccattcttcgccaggccaggattccaaggctccgggtgggttagggcagcttcttcagagggcgcactcaaggccaaattgagttgagag

SEQ ID NO: 4348 - DNA, 200 bp, Homo sapiens
cgcccggctgagccgacattgccggcgtcttggcgattcggcccgacgagctccgctttcgctacagcatggtggcctactggagacaggctggactcagctacatcccatactcccagatctgtgcaaaagcagtgagaatgcacttgggccagaattcagagcaaatcctgaggagacttctggcagcaacgtaaaaa

SEQ ID NO: 4349 - DNA, 125 bp, Homo sapiens
tatctctacactgcaaattttgggtctcaatttttactgtgcctttgtttttactagtgtctgctgttgcaaaaagaggacaacattctctgcctgagttttaatttttgtccacaattaatttt

SEQ ID NO: 4350 - DNA, 208 bp, Homo sapiens
ggacacctctcctcctgattcccttggcaccttgtctttctgtctgtttacctgtctccctgcctgcccatcttgcatcttttgcagcccactctgacttccctcttgggggctgagagccaaccttgcctgcccccttctttcttgccttaagagtgttccctttagggttgggatagggggttcacgcgcttaaaccccgagcatt

SEQ ID NO: 4351 - DNA, 327 bp, Homo sapiens
gctcgtgccgaattcggcacgagggagttcagggaatcatcgtcgtgaacacagaaggcattcccatcaagagcaccatggacaaccttaccaccacccagtatgccagcctcatgcacagcttcatcctgaaggcacggagcaccgtgcgttacatcgacccccagaacgatctcacctttcttcgaattcgctccaagaaaaatgaaattattgggtgcaccacatatagactatttcctagtgtgagtcagagtccaaccgcatatgcgactctctttgcgccccgtgtcatatcccaaattaatgtccccacagagtgtgatt

SEQ ID NO: 4352 - DNA, 203 bp, Homo sapiens
ggtcactcagatgtgcaggtgttaatcttctctaaaagcctggtgatacagctcttgctttctgagcacactacggatcttggaaatactttgaaaatgtgtatacttagaatacttttgctgctaaggagaactttctctccatatgtcagagatagctgagaccaagtgatgtgtaggttttcagagaagcacagtgtgtg

SEQ ID NO: 4353 - DNA, 339 bp, Homo sapiens
catcaataagcttcatctctgggagggaaccttttttaatatatgagagctgtgataaaaaatgtttcagatgttttagtcaattgtgaaattttttcttaaggcaaattttctctttctatcagagttgtatatatactaagcgcccaagagacacattccctgctagagatgcactatattgagactctcgcgcacatgagactatactctgtcgtgcacatccacctctcatcatgtgagaactgctagtgtaaatataccccgatgctgctaacatcactacacagagtgtctctactactggcagcagactcatcatcttcataatatgatgca

SEQ ID NO: 4354 - DNA, 340 bp, Homo sapiens
tggagagctctgtagatgtctattagggccccttgtgtgcagagctgagttcaatttcctggatattcctgttaacttttctgtctcggtgatctctgtcaatgtgtgacagtgtgggttgtttaaagtgctctcccatatatatatgtgtgtgggggtctatagtgatctctgtagagcactctagagactctctctatgtgatctctggggctcccctatatgggggcgcatatatataggggagagagagcatcatcgttgtagagagcctccctaccaccatgatgatgatctcctccgttgtctctagatgattgttggtggaatgaaggctgta

SEQ ID NO: 4355 - DNA, 160 bp, Homo sapiens
ggttttccccatgctgttctcatgatagttaggtgagttctcacgagatcttattgttttacaagttacggttttccccgcttccttcttcccgcatgtgtaaggaggtcggttctttccctctcacactcttcacacaaccatattgtaaggttccctt

SEQ ID NO: 4356 - DNA, 135 bp, Homo sapiens
gtcatgacttggagccaacggggaagtgttcctcatcaacatcaagacactcaatgaggtggattccagcgcatgttaattgcggtgacttgcgctcaagagcgcgtggcactctagagcagggggctctgcata

SEQ ID NO: 4357 - DNA, 91 bp, Homo sapiens
gggatccctcatctgttcctccgggaccctggtgctgcctctaactgacaattcccttggggcttcctgtaacctctttgagagaggcctt

SEQ ID NO: 4358 - DNA, 190 bp, Homo sapiens
cagttctccatgcagaattgagacctagatgatcatctgcaatgaagsagttggatttgtgcttccttcaaatgtaaaatttaatttttggtattttgcatctctttttgtgaggtaaatttcacaatatttcagagatatgtagggcacacagagagtcacagagagagatctcacactacatgagaag

SEQ ID NO: 4359 - DNA, 230 bp, Homo sapiens
tttagacccgtgtattctagaaggggaagatacattttagatctgtctctgaaccttgatagaaaagtacaacttggccaagtgtggtggctcacgctgtaatcccagcacttttggaggctgaggcaggtggatcacttgaggccacagagttccagactagactcggccaacatagtgaaaccccatatctattaaaattacacacattagactcggcatgatagagg

SEQ ID NO: 4360 - DNA, 260 bp, Homo sapiens
aataccgttgatgtgaattattttaaaaggcaaaaccgtgctctttattttaaaaaacactgataatcacactgcggtaggtcattcttttgccacatcctatagaccactgggtttggcaaactcaggcagaagttgagacctttctagacatcattgtcagccttgctacttgaaggtacaccccatagggtcggaggtgctttcccattcccacggttgtccctaggtttaccctcactgctgggggtagcgttact

SEQ ID NO: 4361 - DNA, 310 bp, Homo sapiens
ctcgtgccgaattcggcacgagcttggttgggaggaccagagcctgtctcagggaatttgcctgcttgggtgatgcagggaggaaggtctagtgcagggaagagggggcctggctcagctgttcaccagcactttttgaccacagtctcgctactgcgggcccctgccctagaggtttagagcgatagacctccctctccctcgggggacatatctgggacacaggctctctcgaaatcgtctctcctgtcccagacacaggtttgagtctcagacgtctcgatctactgtagacgacgaagacgacata

SEQ ID NO: 4362 - DNA, 195 bp, Homo sapiens
ggagaaactggcaaggagaagctcccgcggtactacaagaacatcggtcttggcttcaagacaaccaaggaggctattgagggcacactcaatgacaagagaatgcccccttcactgtgtaatgtgtgtccatcgaggggcgcggtctctctctgcgcgtgtgtgcccagatataagagatcacagagagcccat

SEQ ID NO: 4363 - DNA, 235 bp, Homo sapiens
aagaaatccaggctcctcttccaagagattcaagtgctttccagactccaaagggtatcttagatgcaatctcttctctcttaggcccttgccaatttgttcctggttccgcccttctctctagaccatagttgaggacccacccttggagtctctcgagagactctccttcgtttcatatcttaaaacacatacacagatatcctctttcacatatacccttagacctatagag

SEQ ID NO: 4364 - DNA, 245 bp, Homo sapiens
catggctcaggctgcccaaggcttttctgtcacctcttttgttctctcacactgaccagtctttggcttaagctgacttaggagggtttttctgaattgtctaggatcctgcaattattttccttagctcccgccttgctcccattcacatttacacatgtgtaaaggttggggggtgagtgcccctctgagcgctttccgtttgtaatataagcacaggacacttacctctgctctaacgcata

SEQ ID NO: 4365 - DNA, 240 bp, Homo sapiens
ggcggaggtgcaggtcctggtgcttgatgtcgaggccatctcctgggccgccttgcgccaattcgttggctaaacaggtactgcttggcccggaaggttgttggtcgtacgctgttaaggcatcaacatttcttggcaatttctacagaaaccgttgaagtacccggcttttcctccttaagcgcgttgaacaccccacccttccccgaggcccctcctttccgggcccagaccaatctc

SEQ ID NO: 4366 - DNA, 280 bp, Homo sapiens
ctcgtgccgaattcggcacgagatgcctgatctgtacttctacagagattccgaagagattgaaaaagaagagcaggcttcttctgagaaggcagttaccaaggaggaatttcagggtgaatggacttctccccctccgtagttcacttctactcagagctctaggttgcagactcgtctctaaggtgtacagatgtccctctgtgtctcatatagcaattccctactgtaggagtcgtgcgctcagactctcacagagagtcgtcttcagatctcactg

SEQ ID NO: 4367 - DNA, 280 bp, Homo sapiens
gtgaaatcacttcatatatcatgtgctgtaaaataagaactagctgaagagacaaccaaagaagcattaaggcaggttgatgctgatgggacactaaaatatttttacactcaacctgagcgcgttattcttgacactcttaacagagattttttcaattgtgtttcagagactcttagtatatgcacatgtactctagagggggagttcacatctataaatgtcatatacccccctatatatatgtgatattttcatatgcacttctcttgccacatgc

SEQ ID NO: 4368 - DNA, 202 bp, Homo sapiens
gtttaagtgtctaacaaacttaaagctactgtagtacctaaaaagtcagtgttgtacatagcataaaaactctgcagagaagtatttccaataaggaaatagcattgaaatgttaaatacaatttctgaaagtgtatggttttttctctatcatctcgggatacacttgctctatattttataaatatatatttctcactgg

SEQ ID NO: 4369 - DNA, 127 bp, Homo sapiens
cctttgatttttataatgggtgggactgtatccctgcctcaccccaggtctccgtctgccccgccaggtaccccacagagaccaatgacattttgccacttgaacaataaataaagttttttgggaa

SEQ ID NO: 4370 - DNA, 315 bp, Homo sapiens
ggcgtcaaaggtgaagcaggacatgcctccgccggggggctatgggcccatcgactacaaacggaacttgccgcgtcgaggactttcgggctacagcatgctggccatagggattggaaccctgatctacgggcactggagcataatgaagtggaaccgtgagcccaggcgcctacaaatcgaggacttcgaggctcgcatcgcgctgttgccactgttacaggcagaaaccgaccggaggacctctcagatgcttcgggagaacctcgaggaggagggcatcatcatgaaggacgtgccccctcgtaaggtggg

SEQ ID NO: 4371 - DNA, 138 bp, Homo sapiens
gtctagcaaagggggaggcacttaaaaactttgttttggatgtgctgtgagaggagctgcattgccagcgcagaaccagaggatgggagtaaagggcaaggtactagcttggctgggtaaaccctttagggagccttg

SEQ ID NO: 4372 - DNA, 140 bp, Homo sapiens
ccttactactaataattattacaatttgactaccacaactcaacggctacatagaaaaattcaacccttacgggttcggctttgaccctatattccccggccgggttcctttcttcataaaaatctttcttagagaggta

SEQ ID NO: 4373 - DNA, 145 bp, Homo sapiens
cggcacgagtattggtactgttcctgttggccgagtggagactggtgttctaaaacccggtatggtggtcaactttgcttccgtaaacggtacaacggaagtaaaatctgtggaaatgcaccatgaagctttgagtttaagctct

SEQ ID NO: 4374 - DNA, 323 bp, Homo sapiens
gcctgcgagaatcgaggcactcgctggcgtacccatgtatcgaaatgagttcacggcctggtaccggcggatgtcggtggtctacgggatcggcaccttgtctttgttgggctcactcctttactatagccggacaattgcgaagtcgtcagtagagcacaaaggatgggctcaccaagtgaagtacccagtgaactctctctaacgcccaaaaggtttttattgtgggagacaaatgtcacaaatatagaggagtttgttccacatacagagaagatcctcacttctttgagatcatagactcgtggcccccgtacagcagc

SEQ ID NO: 4375 - DNA, 324 bp, Homo sapiens
gtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatcttggcagtcaggggcaaggactcttgtgaggagagttagcccaagtataggctctccccccatgccatcacatccctcatacttttgtatactttgaagcacctcccctccagaaggg

SEQ ID NO: 4376 - DNA, 135 bp, Homo sapiens
catgtgccgaaattggcacgagagcttttttcaccctgagggcgacctagcctgggcaagggcagcagcggaggcctaggagccaagcccctagacgaagcaatagaagcctcttttccagccatctatgtatct

SEQ ID NO: 4377 - DNA, 200 bp, Homo sapiens
tccagatcattcctacaaagtcaactgggagaataataagtctgccggagtgttgagtgctcccacaattaccaaggatgcttcctgggtggggtgttgagttgggacccttgtcaaggtgggccaagcctagtagagacccagtccactcaggtccattacacataggtggggctagggacagcgccctttggttacac

SEQ ID NO: 4378 - DNA, 314 bp, Homo sapiens
ctcgtgccgaattcggcagaggggccctcgggtgtgagctgcgcgaccgctctgagggttcgtggccaaccgttccttcgcggtccctgccgccaacgtccaaggttcaaggtttgtaggaaagattggtggttcggaacaagcgccatcgccgccggtttattgcggggcccttttcattggggtactaaatctacttcggcccgaaaaaggcggagtgaccccaacttcaggacaggcttcgagaaccgagaaagaaacagagctcccaaggagagcctgggctctcaagtactcacttaagatgctgagct

SEQ ID NO: 4379 - DNA, 330 bp, Homo sapiens
ctgccacatacaccacaaaaaccaaacatccccccaatgaccttagccccattgctccattcactcccaggtgaggattcaggcaaacgtccacaaaggtcacaggcagcgtacatacggttctgttataccccatatattaccccttcatgtctaaggaggacattttctttagagatttcattttagtgtatcttaaaaaaaatcttgtgtaaccttgcctccatcttttccttgggtgaggacaccaggattgaccttttgtgtctatgatgtgctgtcacagctctctgatagcctagtacatctggcacaggttactgtatctga

SEQ ID NO: 4380 - DNA, 175 bp, Homo sapiens
ctcgtgccgaattcggcacgaggaacgatgaggcagttacataataatagttaatggaaggtgtgctacagacattatcttgggtttctccctaactttgcccttcactggttgcttaattgtgaaccagccaaaggctttattgtcttggcttaattgtgtgaggtaacctacg

SEQ ID NO: 4381 - DNA, 343 bp, Homo sapiens
gaagacaatacccatctgatgatattttggagagtctgatcaaccaactcaagtaagcaagatgcaggaggatgaatttgatcagggtaaccaaggacaaggaggtaactccaattgcaggaattggagggggaaaatccatcggaccgtcaattaggcaattcaggaacctgattggcagagtcaagagggtaaacctggcctgagagtctatcagcacccacagagagacaagagaagagactgtttctgaggctctctcatggacctctcgatgatggtatcccacgccagaaatcatggagttgatgatgatgcgatgatgatgcgatgatgcgcacta

SEQ ID NO: 4382 - DNA, 160 bp, Homo sapiens
gttgtggagacggccttgagtctcggtccgagtgtccgtgagtgtgagccaccttgggcaaggtccctgcgccagggccccgcccgcccctccatcttgggcccggggtgactgggtccccggccttttgtccccggggccttaaccttccccttgcctg

SEQ ID NO: 4383 - DNA, 189 bp, Homo sapiens
tgggaagggagttgcttgtcacacggattcaggaactgctctccctcagctgggcttggggtctccaggggacctgagctacatgcaggttgttgagctggaaaggaaggtcctggactgtggcccagattagggctggggcagctcccgagagattgattgagtgctgttccctatgggaccttataa

SEQ ID NO: 4384 - DNA, 150 bp, Homo sapiens
gagaaatggaacacaaggagttacctatcactttcacttataatttcaaaagatgactacaaccatgtccatgctcaggattcaaacaggttttccatatcaccttttgggttggtaaggtgattttaccagtttttgtttttaaattgg

SEQ ID NO: 4385 - DNA, 244 bp, Homo sapiens
ctcgtgcgaattcggcacgagcaaggccctacatagaacatacagttgagtggggagtaaacaaaaagataaacatgcgtgttaattggctgttcgaggaggatatcggattaaaaagcctaaacagggaacaccttcatcacagtgtttgatgttggacacatagatggtgatggcacaggtttaggacacattattttcataggctaaatctataacccagagtaaacatcaatgctcagag

SEQ ID NO: 4386 - DNA, 260 bp, Homo sapiens
ggaaggcccaagttggagaatgatgtggagagtgtgccaagacactgcttttggcattttattccttctgtttgctggatgtcaattgacccttttcattttctcttacttgtgttttcagatattgttaatcctgccagtctttctcttcaagccagggtgcatctcagaaacctcctcacacagcactctaggcagccactatcaatcaattgaggtgacactctgcattaatctatttgccattaaaaaaaaaaaaa

SEQ ID NO: 4387 - DNA, 195 bp, Homo sapiens
cagccaccaacttaaaaaggactggacaatacttttaccactttcccttctcagaattcaggcctgtcctcgggaatgctacagggtacagcccatttgagctcctgtatggatactcctttttgttagggcccagtctcattccggacactagaccaacttaggactgtgcccccctcaaaaaaaaaaaaaaaa

SEQ ID NO: 4388 - DNA, 225 bp, Homo sapiens
ctgagacccaccttgctcataaacaaaatgcccatgttggtcctctgccctggacctgtgacattctggactatttctgtgtttatttgtggccgagtgtacaaccatataatagatcacctcttcagctaaaacagcgctcgtgccgaattcggcgacctgcggttcctcccccttcccatgctgccaacttcttaaccgcaatagtgactctgtgcttgactg

SEQ ID NO: 4389 - DNA, 265 bp, Homo sapiens
ggagacttcaggctgaactgaggcagagatatgtctctgagcctctgcacaaaaccagggaccagaaagcattgctcacccatgaaactataagctaaaacattactccaaattggtccaggactgacaaaacacacaagatcctagcagaggcaaatgtaaaacttcttcagaggtgatacctcttaaactaggaaaccagctcttggggaagctactaccccactgaagatgagcttacaataaatattatattccatccaac

SEQ ID NO: 4390 - DNA, 245 bp, Homo sapiens
aaaaataatatatacttgaccttagagtcgtaagcatacatattatactacataccatgggtcaggatgaaccacctgagtagtgaaagttgagaggaggacttagacctagggcactctaatacatggagatagagggatgagagagtctagcacaaaagagccaggctcagtcagcaaggaaagaagagaaccgggaagcatttccagaagacaagggaggaagatttttttaggaggaagga

SEQ ID NO: 4391 - DNA, 168 bp, Homo sapiens
gtcttagaggtgggatgcagatcttcgtgaagaccctgactggtaagaccatcactctcgaagtggagccgagtgacaccattgagaatgtcaaggcaaagatccaagacaaggaaggcatcccttcctgaccagcagaggttgattcttttcctggaaacaactggg

SEQ ID NO: 4392 - DNA, 260 bp, Homo sapiens
tttctttatgcctggctttgcccctctcaccagccgtggaagccagcagtatcgagctctcacagtgccggaactaacccagcaggtcttcgatgccaagaacatgatggctgcctgtgaccccgccacggccgatacctcaccgtggctgctgtcttccgcgggggggatgtccatgaaggaggtcgatgagcagatgcttaacgtgcagaacaagaacagcagctactttgtggagtggatccccacaatgtcaagac

SEQ ID NO: 4393 - DNA, 310 bp, Homo sapiens
gtcgagctggcggaaccggagaagtggaggttcttgagcccgaggaggatttcgagcagtttcttctcccggtcatcaacgagatgcgcgaggacatcgcgtcgctgaagcgggagcacggggcgggcgtacctgcggaacccgagcaagctgtgggagatggagcaatatgctcattcagatcaaaacgcagggtgagggctcggaggagagcgccctcaaccacctccagaacccgggcgacgcgccgaggccgcacgcaagatgtacgacgagccgacgagagacacgagatacgagatggcagatt

SEQ ID NO: 4394 - DNA, 322 bp, Homo sapiens
ctagctcaggccaagagggtgtgacatagtggcatggataattttgtttgggtttgtattatgtttggatccacatcacccagtggtcagcatggagggcttgatatggagagaccaaccagactgtgctgtgtgggtgacgagatagacacaaagaccttagatgcctcttcatgttactttgctgagaggaggagtagagatatgacacagcagttgaaggggcgggagtggagtcaacgaacattattattttattttttcgtgataagcagtactcgaataaaatggtgcagtttggagaagattattattctacaga

SEQ ID NO: 4395 - DNA, 204 bp, Homo sapiens
accagcaggactgcccatcttcaggaaacgggaaaactggtagatgtatgaaccttctcacaaatttatttgagttagtcatgaaaaggactaacatcctaaaacaatgaatacaggcaaattctccatggggggagaactataccagcagagcttatgtttgttataagagtgcaaaagatatattgaggggcaggagagggt

SEQ ID NO: 4396 - DNA, 120 bp, Homo sapiens
tgtgtgtgagcgctcatctggatgagtgaaagctgcgtttgccgcatatgagagaccatgattcaatcacacatgagatgatgacttcatcagctgtatggcaatagaagctcatagtct

SEQ ID NO: 4397 - DNA, 127 bp, Homo sapiens
caccgttgtcgtggcaggtacgactgtggccacgtgcagaggaggtaccgcctggggcacagtggctggcgccctccagaccatgacctccgttctggctgccacaggtcctccgatgctggccttt

SEQ ID NO: 4398 - DNA, 135 bp, Homo sapiens
cccatctggctctgaggcaccgccaaggcaaggaatcacaggatgcgcatcattgcctttgtgggaaggcccagtggaggccacttagagggatctggtgaaactggctaaacgcctcaggagggggaaggtaaa

SEQ ID NO: 4399 - DNA, 103 bp, Homo sapiens
ctcttatagcattgcattgtatgattcacatattgtttcattaggtacctagggagcacctgattttgctaggcagtgctccccttataccaccacaggccct

SEQ ID NO: 4400 - DNA, 109 bp, Homo sapiens
caggggctgcagaccaaatcaagcacatccttcttattttcaaaaactaccagttctttatgggtgaaacatgaatccagatggcatggttgctctatgggactaccgt

SEQ ID NO: 4401 - DNA, 115 bp, Homo sapiens
gaaatgctcttctggaatgaaggacctaacagtcaaattaagtttgaataggagagaacctcctgcacgtcacagacaccggtgtaggatgaccacagagagttggttaaaacct

SEQ ID NO: 4402 - DNA, 182 bp, Homo sapiens
gtaaaaccttttatgacaggggctgcagaacaaatcaagcacatccttgctaatttcaaaaactaccagttctttattggtgaaaacatgaatccagatggcatggttgctctattggactaccgtgagatgggtgtgaccccatatatgattttctttaaggatggtttagaaatggaaaa

SEQ ID NO: 4403 - DNA, 109 bp, Homo sapiens
tggacgcgggcagagagggtagcctgttggcatgggcagggaacagtgcaggccgtggggcttcctgaggtacagccaccggcaggatgtgttttctttccattgtttt

SEQ ID NO: 4404 - DNA, 190 bp, Homo sapiens
aatttacagagtacttactctgtgttaaaagtaagttaataatgtattgtaatctttcatccaaaatattttttgcaagttatattagtgaaggtgggttcaattcagattgtcttgcaacttcagttttatttttgccaaggcaaaaaactcttaatctgtgtgtatattgagaatcccttaaaatccc

SEQ ID NO: 4405 - DNA, 119 bp, Homo sapiens
atggtgagagacaggggcccagtttcattctttagcatgtggggatttatttcctgggttccctattctgttcccttggtttatgtgtctgtttttagcccatattatgttttggtaac

SEQ ID NO: 4406 - DNA, 305 bp, Homo sapiens
gtcctttcagtggtagactcggggagaactttgtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatggacttttttagacagatcttcatgacctgttccacccaagttcatcatcatctcttttacaccaaaaggtctgcag

SEQ ID NO: 4407 - DNA, 343 bp, Homo sapiens
gccgcccctactgggaagtgaggagcccctctgcctggccaccaccaagtctgggaggtgtacccaacagctcattgagaacgggccatgatgacaatggcggttttgtggaatagaaaggggggaaaggtggggaaaagattgagaaatcggatggttgccgtgtctgtgtagaaagaagtagatatgggagacttttcattttgttctgtactaagaaaaattcttctgccttgggatctgttgatctgtgaccttaccccaaacctgtgctctctgaacatgtctgtgtcactcagggtaaatggattagggcggtcagatgtctttgttaacagatgct

SEQ ID NO: 4408 - DNA, 346 bp, Homo sapiens
gaacttcttcccttgacagtttatcttagcactgaaacatcaaatatattgtatctgctttatctaatactcagaaacaaagaacctacgtgaccaatatcaaatattatattttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaattgtagtcagcctacacagccagacatgtggcttaagtaattttatcgtcttatttttactctaggca

SEQ ID NO: 4409 - DNA, 356 bp, Homo sapiens
ctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccacaagccaaaatgaaactgatggtacttgttttcaccattgggctaactttgctgctaggagttcaagccatgcctgcaaatcgcctctcttgctacagaagatactaaaagatcacaactgtcacaccttccggagagtagctgacctgacacagattgatgtcaatgtccaggatcatttctgggatggaaggg

SEQ ID NO: 4410 - DNA, 204 bp, Homo sapiens
cacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggataaaatttggaaatggagatgaaaaaaaaaaaaaaaaa

SEQ ID NO: 4411 - DNA, 315 bp, Homo sapiens
caaactccaacaaaaatcgctctctggtttgcagtcatttatttattgtccgctgcaagctgcccccgagacaccgcgcagggaaggcgtgcccctgggaattctccgcgcctcgacctccgacgacagacgcctcgtccaatcatggtgacctgcctttgctcgcagttctggaggatgctgctatcgaccttccgtgactcacgtgacctagtacaccaatgataagggaatattttaaaaccagctatattatatatattatatatatatagctatttatttcacctctctgtatattgcagtttcatgacc

SEQ ID NO: 4412 - DNA, 139 bp, Homo sapiens
cccagccctgcctaggaaccgtacatcccatctgctctctggccaacggcttcacaccttcccctgctgcatgtgggggccgatgggcaggggacctcggtggaaataaaatgtatctatcaaaaaaaaaaaaaaaaaa

SEQ ID NO: 4413 - DNA, 525 bp, Homo sapiens
atggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaccaaaactacaatgagtctctctattatctatacgctggttgagatttttcaaatattgtgatacaatcttgctgattcactgctggattgctcaccattgtcgctgtatggcagttaaggattaaatgatcggttaggcacaaaatccagtcccattccatagagtatgtgacggtaatgctactgcattcattgggccacccggaaaaatacaatgctgcattgtaatcatccaagggtgaggtggggtccttagg

SEQ ID NO: 4414 - DNA, 455 bp, Homo sapiens
gaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggtttttgtgatgtatgaaacttgtgttttttatatataaatgagtatagttagtgttgtggtaatgcctgttttcatctgtaaatagttaagtatgtacacgaggcactaccttctgatttattgcaatgttcagtcctagtttttacttttattcttaaagcaattcaggtttgctttcaatttatgtacctagtctagttagcctcagatgttccagaagtcaattatgatt

SEQ ID NO: 4415 - DNA, 355 bp, Homo sapiens
aggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaccattcctggaattgccacataattcattaaaacatttttttagcaaaaaaaaaaagggtcttctagagcgccggcccatcgatttccaccggtgggtccaggtaagtttccaattcccctatagtagtcgtattac

SEQ ID NO: 4416 - DNA, 415 bp, Homo sapiens
  misc_feature 11: n = A,T,C or G
gcctgacaggnccccacgcccagccagcccaggacccagcctcccagccaggtccccctccccaccccgccgcagagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctttcccggagagatacagaggcagctgcaggacatcgagaggcggctggacgccttggagctcccggccgtggagctggagaagcgacttcgggccggccaaggaaattacgttaggatagcctaatggtgg

SEQ ID NO: 4417 - DNA, 435 bp, Homo sapiens
taagctcctagtccagacgccatgggtcatttcacagaggaggacaaggctactatcacaagcctgtcgggcaaggtgaatgtggaagatgctggaggagaaaccctgggaaggctcctggttgtctacccatggacccagaggttctttgacagctttcgcaacctgtcctctgcctctgccatcatgggcaaccccaaagtcaaggcacatggcaagacggtgctgacttccttggagatgccataaagcacctgatgatctcaagggcactttgccagctgagtgaactgcactgtgacaagctgcatgtggatcctgagacttcaagctcctggaaatgtgctggtgacgttttggcaatccatttcggcaaagaattcaccctgaggtgaaggttcctggcagagatggtaactggggtggccagtccct

SEQ ID NO: 4418 - DNA, 385 bp, Homo sapiens
tttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaggagctggagttcaatgagtcctagacagttagaggggcctgagcttcagctcaatggaagcctgctgtgtgccacaagacggaaaagtggagaagctgcagtgggagacaaagcctcggtccccacccatccacacacacctacactaacacacgggcacatgggcgcaccgaactaccattcaggcagtcagtgggcagaggaagttag

SEQ ID NO: 4419 - DNA, 355 bp, Homo sapiens
taggggagtctggacttgtagctggaggtaagactgctttaaaaaaaaaaaattcttcaaaacctggtcacttgccgactggtataaaactttcaagctacatattagcccaccctcagtgtttcatacctcattccaccccaccccaactcccaaaaagcatcatcagatagtttttaatttaataactctgtagtcataactagaatctgagtccttaagaatagactcttttttctctttgtacctccagtacttaagagactgtacaagattaaaacagtgttcagagaaataagtttgaggcatagtgcttttaaagttgaactggcaaatgagtcaatctaaatgtgtg

SEQ ID NO: 4420 - DNA, 122 bp, Homo sapiens
gacttcagtacagattatatttatttacacttcaatttgtcatcagtgaatttttttataaaggttggagccaggccccagtgtttgtatttgaggccaggcttcactcttaaggtgcctac

SEQ ID NO: 4421 - DNA, 131 bp, Homo sapiens
gaacatgaatccagacgctggatctgtcagtgtggcctcatctctgtctagagctgtctcactggatctagagctcaatcgccctctgatcgccgatcacctctgagaccaacctcgctcataaacaaaat

SEQ ID NO: 4422 - DNA, 118 bp, Homo sapiens
gcaagatggcagaagtagagcagaggaggaagcggaccttccgcaagttaacctaccgcggcgtggacctcgaccagctgctggacatgtcctacgagcagctgatgcagctgtacag

SEQ ID NO: 4423 - DNA, 105 bp, Homo sapiens
  misc_feature 95: n = A,T,C or G
acctacttcggagactagttatatttaaacaagatgatacagccttccaaacaactcctcttgcctggagactagatacctctgtagcctaccanatagccacac

SEQ ID NO: 4424 - DNA, 214 bp, Homo sapiens
catccttgacttttgtggcttggggaggggtagtgttccacagcttttccttcccacccccagcctaagatgcctcgctctttcaattctctaattctaaatgcttttaaagagataaattgtttagatgtaggcattttaattttttaaaaattacctctaccagacctaagcactttgttaattttggggggaaagattagatatggggaaw

SEQ ID NO: 4425 - DNA, 174 bp, Homo sapiens
gctccaggcttttagcagagccaaatagagtagattgaagtgtaatagaaagtggagtggtatcgttgtctcctccattgatgattgtcataggttttagcatgtcctcctttcttcacctcccttttttctcctataatcagagaactccaagttaatggaatggtcggatct

SEQ ID NO: 4426 - DNA, 144 bp, Homo sapiens
gaaaacttctcttgccattctctctcttttaactaagctgaatccttccatttcttctgcacatctacttgctaaaattgtgggcaaaagagaaaaagaaggaattaatcagagcattgtacaaaacaggatacataaacacct

SEQ ID NO: 4427 - DNA, 246 bp, Homo sapiens
cggcacgagccaatgtctccaacttcactttgctcctagcacgattatattcacctgggacatgctgctatgctgggactcatgtatgtctactggactcagctcaccatgttccagacctcgaggtacctggccatctggggcagtgtgacgtttctggctggcaatcggatgctggccagcaggcagtaaggagaccagcacattaggttccagaggaaggatggaaattctaaaaactgaatk

SEQ ID NO: 4428 - DNA, 291 bp, Homo sapiens
ggtgtgcagggagaacagggtgccaccgcctgcctggtgtccagggccctccgggtagagcaccgacagatcagcacattaagcaggtttgcatgagagtcatacaggaccattttgctgagatggctgccagtcttaagcgtccagactcaggtgccactgggcttcctgggaggcctggccctcctggtcccccggccctcctggagagaatggtttccagccagatgggaattcgtggccttccggcattaaggggcccctggtgctcttggtttaggggactaaagt

SEQ ID NO: 4429 - DNA, 106 bp, Homo sapiens
gcagctatttttgcatcctctctctgtctgctcagttctggcatctctccctcctgtgtttccaggtttctctatatactttggcctgtttggtctctctgtggta

SEQ ID NO: 4430 - DNA, 106 bp, Homo sapiens
acagagtcagagagagagacagagttagagagttgagacagagtacagacagagagagacagattcaagagagacagagagagccagagagagagagagacagatt

SEQ ID NO: 4431 - DNA, 101 bp, Homo sapiens
atgttagtgagccacagcctgtttgtccttgcagttgtctcacggctctctagcgtcctctcctctctttggcctcagtggcttggatttcctatccaaag

SEQ ID NO: 4432 - DNA, 103 bp, Homo sapiens
gagacataccaacactgacaaactagaggggacatgagtacatctcaagggtcactgtgtcttaactcacttcgatcagaaattaaggccctttctctgagga

SEQ ID NO: 4433 - DNA, 158 bp, Homo sapiens
tcgtcaatttcggcataattgaactaactggggactctctgtgctagtaaccacggtctctgatcaatatcactctcctacttacagggctcaacatactagtcacagcctatactcctctacatatttacacaacacaatggggctcactcaccccc

SEQ ID NO: 4434 - DNA, 128 bp, Homo sapiens
gctccttggaaaacgagggtcctcctcgagctgcaggtgcagaggggaagacaagggtgaaaaaggtgctaaggggggaagcaaggtcgagaagggtcctcctggaaaaacccgccccagtcggtcct

SEQ ID NO: 4435 - DNA, 153 bp, Homo sapiens
cggcacgagcgttggcagggagaagcagcgtcctagagcaggcctgcagttgtctgcagggccaaggccagggagcagggtctcctttggagggacctggcaagcccctcacgtcgccaggtttttcttagcaggggagggtcacaccacacc

SEQ ID NO: 4436 - DNA, 320 bp, Homo sapiens
gagagaactagtctcgagtttttttgtattatttttagacataggggtttcgccacgttgcccaggcttggtcttggaatttcctgaggtcaagcctgtctgcccatcttcagcaacttttgggagggccacggccaggccggattcatgaggtcaaggagatcaagaaccatcctcgctaacacggtgaaaccccatcttctacttaaaaatacaaaaaatcagccaggcgtggtggttggtgcctgtaatccagctactcgggaggctaaggcaggagatggcgtgacccgcagcggagttgcagtaagcgagatcgt

SEQ ID NO: 4437 - DNA, 275 bp, Homo sapiens
cggaggctccagacatcacctaccactgcagaacagcattgcctatctggacgagcagctggcaacctcaagagggccctgctcatccagggctccaatgacgtggagatccgggcagaggcaatagcaggttcacgtacactgccctgaggatggcttcacgaacataccggtaggtgggcagactgtatcggtaccggtcacagagacctcacgcctcccatcattgacattcaccatgacatagaggcccagcaggattcgtgtgacatagg

SEQ ID NO: 4438 - DNA, 210 bp, Homo sapiens
cttagaccaagggaggacttcccagcatcagagatgacacggatcgccaggctgattggagaaggaacaagatgagttacgggaaggaggaggagcttcagaagagcttaaacatactgactgccttacagaagaagggggccgagaaagaggagctgtaaaaggcttatctctaattttcaggggcttgctgggggtagggagggagag

SEQ ID NO: 4439 - DNA, 240 bp, Homo sapiens
agcatgcgatcgatacagagcatctgcactgggattgtccgccccgcctggcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattaaaaaaaaaaaaaaaaa

SEQ ID NO: 4440 - DNA, 307 bp, Homo sapiens
gagcggggaagctggggccaggcttggtcacggggtgctgtgacttaccaactgtgggagggtcgccactcccctttttgagtctcagtgcctcactataaataggaatggtagcctcccccctttataagtttatcccaaagaaacatgagataataataaaggcagctgggtgtggtggctcacgcccgtaatcccagcactttgggagggtaaggcgggtggatcatgaggtcaagagatcgagaccattctggccaacatggtgaagccccatctctactaaaatacaaaattagccgggcgt

SEQ ID NO: 4441 - DNA, 283 bp, Homo sapiens
ctccgcatcccgtcagctggaaaaggcctgtgccagtcaggcttctccaagggagggtgacatgctggcttttgtgcccaagctcaccagccctgcgccacctcactgcagtagtgcaccatctcactgcagtagcacgccctcctgggccgtctggctgtcgctaatggaggtgacggcactcccatgtgctgactccccccatccctgccacgctgtgccctgcctggctagtcctgcctgaataaagtaatgcctccgcttcaaaaaaaaaaaaaaaaaa

SEQ ID NO: 4442 - DNA, 240 bp, Homo sapiens
cccaaacgagggcacttttaagaaatgttacaggctaaaggtagttaaccatttgaggtgaaaacacggatcctacgaagaacaaagaccaccaaaaaggcaaaaatatgtggaaaaatataaaaaatgttttctggttaacaaaatgttaatttctaacattttaaaacaaaaatgattgtttataacatgtatacattgcatatgtgatacagcacagaggacaggggggttgcatgg

SEQ ID NO: 4443 - DNA, 172 bp, Homo sapiens
  misc_feature 114, 115: n = A,T,C or G
cctgcctcggaagcgcagagcaggcatcgtgggaaggtgaggagcttccctaaggatgacccgtccaagccggtccacctcacagccttcctgggatacaaggctggcatgganncacatcgtgcgggaggtcgacaggccgggaatccaaggtgaacaaggaggaggtggt

SEQ ID NO: 4444 - DNA, 346 bp, Homo sapiens
gtggcgcgacggagagcacgcatgaggctcggcacgctacgggagtacaaggtagtgggtcgttgcctgcccaccccaatgccacacgccgccctttacctcttgcgattctttgcgcttatcatgtcgtcgccagtcccgcttctggttctttgtatctcattaaggagtggagagtcttcaggggaggattgtctactgtgggcagtgttgagagtccccttgccgtgaagaactcgggtctgctcgtatgactccgagcgcaccacacatgtaccggatacggactgacacgagcgtgtaccagtgtaccggaatggtgccggaccggccagccattcattag

SEQ ID NO: 4445 - DNA, 382 bp, Homo sapiens
gagtgtgagcttgtgcttgtgaaagctaaccatgctaaccaccagggcaaagcagcacagtgtgattagaacagagcgggatcaggattttcacagaggacaggtcagctgaggggcctgcacacacagggtgtggaggagccacagatgggcgcgagagcctgccttttgcctggccagctcaccccacctgggcctcactgctccaggaggcttccagttaccgagctaagtggctcttgcagtcccgtgacaccttgagctgtactcggtggatgttatgctatccgtgctagccgttgtgctggctggtgtagatgtagtccatggagaaacactttgttccgttttccagccggtctctaaattgttaatgaagaca

SEQ ID NO: 4446 - DNA, 243 bp, Homo sapiens
ctcgtcaattcgccaaagaattgtagttcttattcccacgcgaaaacagagtgttagctgcggtggcagacgtctgtccgggagtttctctggagcccagatcgacgagccgttaggcctatgtaaatggtataatggggaatatagagtcgtcgagttgtcttcgcgtctctagctagtcattaggggagaaggaaaactaggatagaaaagaccttccacctacctgggcaaccatatcat

SEQ ID NO: 4447 - DNA, 280 bp, Homo sapiens
ctcgtccattttcggccaggggggccaaggccagactccacgattgggaggaccaggtccgctgcgacatccgccagttcctgtccctgaggccagaggagaagtcctcctgccaggtggcccgctgactgcacttgcatttgggggttgtcgggtagagcttggggttgtcagaggctagggcagtacttaggaccttggcaaaacctgccacagggtgttgggacgaggaggctccaaattgcagattaaaaatgctcactttgaaaaaaaaaaaaaa

SEQ ID NO: 4448 - DNA, 454 bp, Homo sapiens
gaatgaaaatttatgaaaaagatgaagaaaagcaaagggctttgctgggctatgctgataaccagtgtaagctggagctacagggcgtcaagggtggggtggaccatgcagcagctttttggaggaattgccttctcttgccccccagcaaagagttgccagacttagaagactcgatgaaaagggagagcagacgatctgactccctcgtgagcctggacacccaggcaagcacagtacagatgtcatctgcgacctacgacataaattgcttgtcgggatgagcattcgagacttctagatgatcagaggaagcaattgttggatatgcatgcagatgataaagtacgagtggttgcaacacataaccaagctcagttacggagcatatcagcagcctttttatcctccacactttagcctaggttattccaataagtctttttattttccc

SEQ ID NO: 4449 - DNA, 430 bp, Homo sapiens
ggtcgcacgcgtgagacttctccgccgcagacgccgccgcgattgcgctacgtcgcctccctacctgctggctgcctagggggcaacttcctcccccagcggcaagggacatcaagaagatcttggacagcgtgggtatcgaggcggacgacgacccggctcaacaaggttatcagtgagctgaattggaaaaacatttgagacgtcattgccagggtattggcaagcttgcagtgtacctcctggtggggctgtagcgtctctgctgcccaggctctgcagcccctgctgctgggttctgcccctgctgcagcagaggagagaaagatgagagaggaggagtctgagagtagatgatgacatgggatttggcctttttgattaaattcctgctccctgcaataaggcttttacaaataaaaaaaaaaaa

SEQ ID NO: 4450 - DNA, 401 bp, Homo sapiens
cacaagtccctgtatctgaagtctagcatctcaaggctgatctgggaagtgtgctagtatgctccctagtggataacttaatcttttaatacagttccgtcattccatcttgttttcagaagagagggtggctacagccaggcataacatatccactgtgtgcatagagggtctctcacgttgatgctcgcattcatcagctttctctaaggctttgctcaggtcaacctaaaatgatgttaggcaacaggtcccagtcagttcctctatttcaccatttgctcaaagccatatggcccgataggggtactgctgactaaggttgtatccaataaggggcgggggtcctttgggggccgggccctggtttcccccggtgggtccaggaaggtcccttgccc

SEQ ID NO: 4451 - DNA, 360 bp, Homo sapiens
cttttgtataattctcattaaattattcaagactttaagaggaaagacatgccatgctaattctttttaaaaaaggaaactgccgaataacttctgtagttgtttaattagtttaggggaaaaaaaaaccttcaaaagcgtatattcaaactttgattctagttgcctttcgtctaagtcatgggaagccacgtgagtattctttgccatctccaggagtggatggttagaggagggaataggaatccccatcagctgagggagcttaacttggctgtaagatgtggtcttggtccagcaacacgtggaacatgttccttgtcctgaaaccttggaattgacaagaattgaggaagacct

SEQ ID NO: 4452 - DNA, 318 bp, Homo sapiens
tcggccgagagactccttttccagcttaggtatcacactaaatctccaggggcacattgaaatcctgagtgatgtgcagctgatcaagactggagacaaagtgggagccagcgagcacgctgctgaacatgctcaacatctccccttctcctttggctggtcatccagcaggtgttcgacaatggcagcatctacaaccctaaagtgctttatatcacaggggaaactctgcattctcgcttcctggagggtgtccgcaattttgccagtttctgtctgcgagttggcttcccaacttttgctacagtaccccttttt

SEQ ID NO: 4453 - DNA, 356 bp, Homo sapiens
catagttatgtaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttccatatattgttatagacagctaaacccttcaactatgcaatgaatgttcgggcttttcacaaaagccgcctaactcaaaggagcctttcaaatccatttacagcatacttaaggtcatatttacctgaacaggcgcttacgtgatatgactctgttttcctgcttgttttttt

SEQ ID NO: 4454 - DNA, 245 bp, Homo sapiens
ttctctttcctttccttggagggaagacagcagagtcatcagttaaaaaaaaaaaaggaaacccaaacacctcccttgaacaaatttatactcctgttcccagggtcttgagactttagggkkgctatacccatgagtcttataggggggcacttttccaataaacaaaaacaacttttttggttacctcagttgcagagatatattcatttggaaggtgttctcagattattttttcaggtata

SEQ ID NO: 4455 - DNA, 141 bp, Homo sapiens
ccagccacagtggtgacctcccgaggactccaactaggccaaaccagtacagctactatccagcccagtcaacaagcccagattgtcactcggtcagtattgcagcggcacagctctgctgctgctgctttactaatgcaa

SEQ ID NO: 4456 - DNA, 260 bp, Homo sapiens
ccactctgttcattgtaggtactttagcatcatccctgggtctctacccactagatgctattagtatgcctccatctccagttatggtagccaaaactgtctccacacatgggccaaacatacccttgggaaccaaaatcaaccccttggcttcggaactattggctctaaggggtaccaaatggggatgtgtctgaatcaggctatctgggattggccggggtctcaaaacccttggggacacagttaatgggccaggg

SEQ ID NO: 4457 - DNA, 270 bp, Homo sapiens
tgtaattcagaattcataccaatcagtgttgacactcacacattgcaaaagtggtcgcaatattcagtgcttaacacttttctagcgttggtacatcttagaaatgagttctcaagttgattttatcctcgcaagcatgttgttataaggattgtgtggtgtgtctatcattacacttgtgttctgtatctcgagaacagtgttctctacacattcatatgtgttatatgagagagatgctctaatgcacactcgtcacatatatatata

SEQ ID NO: 4458 - DNA, 350 bp, Homo sapiens
gtactttccaatctcagtcactctaggactctgcactgaatggctgacctgacctgatgtccattcattccaccctctcacagttcggacttttcttccctctctttctaagagacctgaacttggcagacttcaaaataaaatctctgtgtgtctatatatatatatgtctctccgtaagagccctcgggtcacaggcagagacacggaactctctcgtgtgtgtcacatgtcccctgagtgactctccccagagcacgacagaggatgtctcttcacgtgcgcgcagcagcagctctgtgtgtctacacactagtgctactactgctgtatacaactctgtagttatt

SEQ ID NO: 4459 - DNA, 195 bp, Homo sapiens
ggaccctgcagccgcagagatgttgatgcctaagaaggacccgattgccatttatgaaccttccttttaaggagggagttattggtgccaaggaggatgttcaccatgcctaggaacccgagcttgcagagcaaggattttcccaaccctcaagtgtctgtaaggccattgcgtgtctctaagtgcccagagctc

SEQ ID NO: 4460 - DNA, 280 bp, Homo sapiens
cttgctttcagttttctgtggtctcttttacatcctgcttcaagattcggagtgttggaggaagctaaggaaggtcttggtgcagtaggttagcaagacctcttgcttcccagcccaaggttggttggggcggacaacctttttttgtgcaatccaatcttatacacactctgcgcatatctctctgagagacacacacgcatatgagaagagtctctggaggctctcttgtagagcctatccctctcgcagagatactctcccagatgtaacgtgatcc

SEQ ID NO: 4461 - DNA, 341 bp, Homo sapiens
tggcggtgcagctttgaccgtgccatcgagatggagcgtggcatcttcggaggaggcttcgcaggttcctttggtggagctggaggccattctcttggggtggccaggaaggcctcccagatatttgtgagaaatctgccattcgatttcacatggaggatgctaaaggacacattcacgagtccgccacgtgctgtacgccgacatcaagatggagattgggaagtcacgggtgtgtgtggttagttcgagtcgccacagtgccgagagagcctccggatgatgattgcatgagcttagtgcgagagattacgttcgattgatagaacgctaagcagtgc

SEQ ID NO: 4462 - DNA, 285 bp, Homo sapiens
gccgcccaagatgccgaaaggaaagaaggccaagggaaagaaggttggcttccgccccagctgtcgtgaagaagcaagaagctaaggaaagttgttgaattccctggtttgaggaaaaggccttaggatttttgcatttggacaagacatatccgacccaaaagagaacctctcaccgctttgtgtaaataggccccgctatatatacagtttcagagcgcaaagagaccaacttctatatacgcgctctgagagcctcctcccgcgttatacacattacaccga

SEQ ID NO: 4463 - DNA, 285 bp, Homo sapiens
cagccaaagctgttgcggtgaccctgcagtcacactgaccccacctgaaattcttgggcagtcctcttttccgcagctgcaggagaggaggaagactattaaaagacaatactgatgacatgtttcgtagataggggtttgcagctgccactcgagctcgtagctcgcgttaatgaccctactcgatgtgctctcggggacatgttagagggacacaggcgcgagctcctcggcacgagttyacaggtctgagacacatagagatagggcacatctcttagaaga

SEQ ID NO: 4464 - DNA, 105 bp, Homo sapiens
gagggatttagtctccattaattgtcaatgtctcttgaccccaatcattatacttggttcttctttttgtccttaggtcattattattattacctttactttaat

SEQ ID NO: 4465 - DNA, 185 bp, Homo sapiens
ccactatgaaggttacggttcttcccctttttttcaattttgttggctttagaaggaaggcactattcaaaagcttcacaacctctaaggttccggagcttgcctttttccaagggagggtaatatattatatcctccaaccctttttagggttgggccattactttaaaattggtttgggatta

SEQ ID NO: 4466 - DNA, 280 bp, Homo sapiens
atggcggcaggatggatgtggataccccgagcggcacaacagccgcgcgggcaagaagcgctttgaagtgaaaaagttggattcagatagcccctcttggcccttgggatattgttggtttatatacttttccatacttcagagacccaatatatagggtattttgcatataattcaaagtataccagacgctcccgtatattacgagagagctacactcgcgcatggagagtctatacccatgcttcacactcaccactacatctcgtcgctgtcatca

SEQ ID NO: 4467 - DNA, 291 bp, Homo sapiens
atcgacctccccaccccatccaacatcttccgcatgatgaaacttcggctcactccttggcggcctgcctgatccttccaaatcaaccacaaggacctatttcctaggccaatgcactatcttaaccagacggccttaaggccggcctttttaatcaaattggccacaatcactttgagacggtaaaattattggctgtaatcaatcccggtatccttacaggcaaattgggccctctaatatatctcttatatcgtcctctttcctacacatcggcgcgagctctattat

SEQ ID NO: 4468 - DNA, 150 bp, Homo sapiens
ctcgtgccgcaaaatacgattttgataaatagacaggtgtatctattcttgattaacgattcactctaataaaaattttgactcttttgtatccatccttaaaattcagtctgattccacttactcaggagacaatattacatgggatat

SEQ ID NO: 4469 - DNA, 176 bp, Homo sapiens
gtcaaatgccccctgagtgacttcccccagcccaggccagaagaccttccttcaggtgccgggcgcaggaacttttgttgttgttctacacaattggggctatttttgtgtcaaacaactcttgtatttttttaaaacatcaattgatatttaaaaatgagaaagagtatttggag

SEQ ID NO: 4470 - DNA, 278 bp, Homo sapiens
ggattcagagggaccagtgcatccaattatacaattatacccagaaggtcctgtgtaggggactgcgattgacatcaccctagtctgcagcaccaaggactgaatgagctcaatcctcttataatttaggctggactgtaacagccactggcagcaacagcttacgtggtgcagccaaagtgcaaccatgccagcagcggccatgttccccagggtgggggtccagttagtaagccacggcaccaaagaggcgagcattccttttgccaaaaaggatt

SEQ ID NO: 4471 - DNA, 348 bp, Homo sapiens
ctcggacaacttgcacaagcgccgcaaaccggggcagagaagcctaccacaagaagcggaagtattgagttgggcgccagcttccaacaccaagattggccccgccgcattcacacagtccgtgtgcggggaggtaacaagaaataccgtgccctgaggttggacgttgggaattctcctgggcatagagtgttgtcttgtaaacaaggatcatcgatgttgtctacaatgcatctaataacgagctggttcgtaccaagaccctggtgagaattgcatcgtgctcatcgccagcacaccgtaccgccagtggtacgagtccactattcgctgcccctggccgcaaga

SEQ ID NO: 4472 - DNA, 356 bp, Homo sapiens
ggaaatggaaccgtctgaactatcctgcccgccatcatcctagtcctcatcgccctcccatccctacgcatcctttacataacagacgaggtcaacgatcccttccttaccatcaaatcaattggccaccaatggtactgaacctacgaatacaccgactacggcggactaatcttcaactcctacatacttcccccattattcctagaaccaggcgacctcgactcttgacgtgtacaatcgagtagtactccgattgagccccattcgtatataattacatcacagacgtcttgcactcatgagctgtcccacattaggcttaaaacagatgcattccggacgtctaacaacca

SEQ ID NO: 4473 - DNA, 348 bp, Homo sapiens
tttagtcaggaaggacgttggtgttgaggttagcatacgtatcaaggacagtaactaccatggctcccgaagttttgccaaaacctcggatgcttggctttctggcaaggccgtttgcgaattcatatggctgtagattcgtgcttatccttcgggtttgcagctttgtattaagttcgtgtggctgatcaaagaagaggcatacgagatttcacagaactacgattgtcaagaaagattttgaggagtgaggaaggcttggtacttccagagttaaagaatctcggatataagatttctcaggttgatcactagagtttgcactacttgtgtctgactatgcacatg

SEQ ID NO: 4474 - DNA, 304 bp, Homo sapiens
taggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccagatttagatggtttttaattaaacttttctctccctttttttttcactaaagcatgtttatcccctaatccattaaggggcatgaaaaaaggataatgtatttgaaattataaaaaaaaaaaaaa

SEQ ID NO: 4475 - DNA, 245 bp, Homo sapiens
aaaagaccaaacttccaggcctgcttttttcttaaagtactttaaaaggaaatttgtttgtattttttatttacattttatatttttgtacatattgttagggtcagccatttttaatgatctcggatgcaccaaaccagccttcggagcgttctctgtcccacctctgactttacttgtggtgtgaccatgttcatatatctcaaagagaaaaaaaacctgtaaaaaagcaaaatgacacagga

SEQ ID NO: 4476 - DNA, 250 bp, Homo sapiens
gagaccaaggccgccccgctctggtctcagaccagttgtgctgctcttgctctggctcagctggtgtggggcgcaggcgggaaacgagacctctagcatctggctgaaggctctgccaagctcctcttcagggctgcagtctgcctgcctgcatataccgacttggccagacactgctgctaaattccagggactctttctcccctcctctgctctccagccaatccttgaggatttaataactggaagg

SEQ ID NO: 4477 - DNA, 191 bp, Homo sapiens
ctgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattagaggtttaaataaagagttttaatttttaaaaggg

SEQ ID NO: 4478 - DNA, 106 bp, Homo sapiens
aaaatgctgtttgtattttgtggtctaataaggagttcgggatagcctgttgtatttgcctcatgcgagcccctgaagctgccttggggagaagatgctgaattgt

SEQ ID NO: 4479 - DNA, 238 bp, Homo sapiens
ctcgtgccgaattcggcacgagccgcggcgggagaggaacgcgcascagccttgggaagcccaggcccggcagccatggcggtggtaggaggaatgaaatgtgtgaagttcttgctctacgtgcctcctgctggccttttgcggcctgtgcagtgggactgattgccgtgggtgtcggggcacagcttgtcctgagtcagaccataatccaggggggctacccttgctctctgttgcc

SEQ ID NO: 4480 - DNA, 237 bp, Homo sapiens
ttgaatcccggcgcttccaggttgtggactcccgagccactggcaggttccgcggcaccgagcccgagccccgagacggcatttaacctggccacataccaggtaccgtgaacatacccttcacagactttctgagccaggaggggcttgagaagagcccttaggagatccgccatctgttccaggagaagaaagttgactgtctaagacacttgttgccacgtgttgctctcgcgt

SEQ ID NO: 4481 - DNA, 101 bp, Homo sapiens
ccgaaacaggctactctcctcggccccctccatcgggctgaggaagcacagcagcatcttcaaacatgtacaaaatcgattggctttaaacacccttcaca

SEQ ID NO: 4482 - DNA, 239 bp, Homo sapiens
gcgatttgctggtgtagacatccgtgtccgtgtaaagggtggtggtcacgtggcccagatttatgctatccgtcagtccatctccaaagccctggtggcctattaccagaaatatgttgatgaggcttccaagaaggagatcaaagacatcctcatccagtatgacccgaccctgcttgtagctgaccctcgtcgctgcgagtccaaaaagtttgaggccctggtgtccccggctcgct

SEQ ID NO: 4483 - DNA, 237 bp, Homo sapiens
catcgtgctcatcgacagcacaccgtaccgacagtggtacgagttccactatgcgctgcccctgggccgcaagaagggagccaagctgactcctgaggaagaagagattttaaacaaaaaacgatctaaaaaaattcagaaggaatatgatgaaagggaaaaggatgccaaaatcagcagtctcctggaggagcagttccagcagggcaagcttcttgcgtgcatcggttcaaggcc

SEQ ID NO: 4484 - DNA, 270 bp, Homo sapiens
ctagtggatccaaagaattcggcacgagccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgttttatcagggccaacagccagggacctgtatgggttccaaaaggtcccaggtgtcctcttccgtgcagtcgggaaaaagcccc

SEQ ID NO: 4485 - DNA, 236 bp, Homo sapiens
ttatgcaaagaaaaatgaacccaaacatagacttgcaagacatggcctgtatgagaagaaaaagacctcaagaaagcaacgaaaggaacgcaagaacagaatgaagaaagtcaaggggactgcaaaggccaatgttgggtgctggcaaaaagtgagctggagattggatcacagccgaggagtaaaggtgctgcaatatgttagctgtggccactgtggattttttgcaagacact

SEQ ID NO: 4486 - DNA, 343 bp, Homo sapiens
agagtactggctccttttataatttgttaccagctttacttttgtgataaaatattgatgttgtattttacactcttaagtcttaaccacagtcagaattatcttaatgtagattataattctggtctttcaggaaaaaaaaacaaaaatctgatatttatttcaaaacgtattgaggcacacaatattaatattgtgccatatgacaacaaagtctttcctaaatactccatctgtttagtactgtattgtggaatatttgagtctattccatacttgaaacatggaggatttagagatgcctgacaatattatttaagtagtatgtgaccgagctataatt

SEQ ID NO: 4487 - DNA, 360 bp, Homo sapiens
tagttctgaacgttagatatttttcttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaatccacctgttaaatttttctggacaatgccagcattttggattttcttaaacaagtaaatttcttattgatggcactaaatggtgtttgtagcattttcatcatacagtagattccatccattcactatacttttctact

SEQ ID NO: 4488 - DNA, 285 bp, Homo sapiens
tgtcccaactgatgatatccacatgaaggcaagttgatctggagaatgtatggcttcattttatccgggagttcattgcaccagttacactgaaggtctttgcaggctattatacgagggatttgcactactgaattttgtagtaaaatactcccctgaacgacagcgttctcttcgtcctcatcatgatgcttctacatttaccataaacattgcacttaataacgtgggagaggctttcagggaggtggtgcaattctaaggacaattgctctattgagtcac

SEQ ID NO: 4489 - DNA, 114 bp, Homo sapiens
gatgggtggggtggggagggaatcacttggtgctatagaaattgagatgcccccccaggccagcaaatgttcctttttgttcaaagtctatttttatttccttgatatttttct

SEQ ID NO: 4490 - DNA, 365 bp, Homo sapiens
caacacactaaccatataccaatgatggcgcgatgtaacacgagaaagcacataccaaggccaccacacaccacctgtccaaaaaggccttcgatacgggataatcctatttattacctcagaaatttttttcttcgcaggatttttctgagcctttaccactccagcctagcccctagccccccaattaggagggcactggccccaacaggcatcaccccgctaaatccctagaagtccactcctaaacacatccgtattactcgcatcaggagtatcaatcacctgagctcaccatagtctaatagaaaacaaccgaaaccaaataattcaggcactgcttattacaattttactgggtccta

SEQ ID NO: 4491 - DNA, 255 bp, Homo sapiens
ctcgtctattccggccagggtttgccttcctcttttttcttgtcattgctggtcaagattactaatatttgggaaggctttaaagacgcatgttatggtgctaatgtactttcacttttaaactctagatcagaattgttgacttgcattcaggacataaatgcacaacatctgtacatgtctccatcagaagattcattggcatgcacagggggattctctccttcatccgtaagggcaacaataaaaccaaat

SEQ ID NO: 4492 - DNA, 215 bp, Homo sapiens
gacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcca

SEQ ID NO: 4493 - DNA, 262 bp, Homo sapiens
gtcagaagacaacatttgaaattaatcccagacacccgctgatcagagacatgcttcgacgaattaaggcagatgaagatgataaaacagttttggatcttgctgtggttttgtttgccacagcaacgttcggtcagggtatcttttaccagacaatcaagcatatggagatagaatagaaagaatgcttcgcctcagtttgaacattgaccctcatgccaaggtggaagaagagcttaagaagacctgagagacagcagag

SEQ ID NO: 4494 - DNA, 259 bp, Homo sapiens
tttagatgtagattctctggtcattgagcatatccaagtgaacaaagcacctaagatgcgccgccggacctacagagctcatggtcggattaacccatacatgagctctccctggccacattgagatgatccttacggaaaaggaacagattgttcctaaaccagaaggaggaggttgcccagaggaaaagatatcccagaggaactgaggaacaaaaacttatggcacgggagtaaattcagcattaaattaaatgta

SEQ ID NO: 4495 - DNA, 250 bp, Homo sapiens
aaaattttatgagagaatggcttactacacctccaggatgcagttccccatggagatggcggcacttccgggacgaccagggcctgcagggaaggatggtgcttccggcaggccaggtgcttcagggtcactgggctgcctggtcagattggcatgacaaggacggcaggcttgcaggattaaaaggttggctggtgacaaatggaaaaagggacatggtgttggcatgcaagaaaatggtgtggccgcc

SEQ ID NO: 4496 - DNA, 360 bp, Homo sapiens
acatctagtgggcaacacagggaggaatatgattagttctgtttttcccccagcagcatcattctgttcttctgcctgagggcatttgcccctctttcttatctggagacattgtttcttagctactttcattctatcttctctcttatacttagtgcctaggtagttggctccgattaattttgctgtatgacctttatgcttccaaaagtgacagattattgactgttaaaatattagtgaatatatacacttggtatacatccagcaggtaatattaattcttgaggaaattacacattttagagccagtaccatcatcttctatgtagtatctagaaccgtgtctcattaaaaaaa

SEQ ID NO: 4497 - DNA, 360 bp, Homo sapiens
cgggttgtgcctggaggtggaggggaagatggtcagtaggacagaaggtaacattgatgactcgctcattggtggaaatgcctcccctgaaggccccgaggcgaaaggtaccgcaagcacagtaatcactggtgtcgatattgtcatgaaccatcacctgccaggaaacaagtttcacaaaagaagcctacaagaggtacatcaaagattacatgaaatcaatcaaagggaaacttgaggacagagccagaaagcgtaaaccttttatgacaggcctcgcagacaaataagcacatcttctaatttcaaaactccagttctttatgggtgaaacatgactcagatcgcatggtgctcttt

SEQ ID NO: 4498 - DNA, 290 bp, Homo sapiens
gaaaccctatgtgtgtaagcagtgtgggaaaaccttcagatatggttcagcccttaaagcccatcagagaattcataggagcataaaagtgtaagaccgtaaagagtatgagcgcgccattcatcatcagacagcccacactggtgagacatgatggaatgttagtcttataggtatggctttagaattgagagagttcaaaatgcagatcttgccacattagaaagcattcaatgtcagtcctgttttaatggatatctcactattcaatggtaaattaaaaaaaaaaa

SEQ ID NO: 4499 - DNA, 120 bp, Homo sapiens
gacaacccgtggcacatgtggaaattggccatgccctggccttggccagttgccccatgatgcctgccgcttgaatatgacttggtgcttatggtggaccccatcccccctaaatcgacc

SEQ ID NO: 4500 - DNA, 206 bp, Homo sapiens
gctcttggcacgttgtatagatccgatgtacgtccttaccttacgcatggttactgggataataggtgccatcttcttcttcttaggcctaggataagcttcgggcagcttttagcgaccgattcggagctcaattgcgatgcgcaaccccattacctaacttgcaacacgcgcaagcgctctgggtttctctgagagatgctgga

SEQ ID NO: 4501 - DNA, 170 bp, Homo sapiens
ttgcgtcttatcaccaataccagtaagttgcgatgcagttctttcagatgctcagatcgccatgcaccgttaccagtctaagccctgccgctgcttaaaagaaccgctttcctcccctaaagctatactttcgagagagagagagagagagagggtctcatagaacgagg

SEQ ID NO: 4502 - DNA, 180 bp, Homo sapiens
tccctctctgcacgtactgtggaaagaacacgcacttagtctctaaagagtttattttaagacgtgtttgtgtttgtgtgtgtttgttctttttattgaatctatttaagtaaaaaaaaaattggttctttaaaaaaaaaaaaaaaaaactcggggggtacttttaggggcccgccatcg

SEQ ID NO: 4503 - DNA, 250 bp, Homo sapiens
cggctggaagcatatctacattgtgcatacaaggaagctttgagattggcattccaggggatgtggatccaggagacagattattccacattacaagaatttgtaggagctctcactccttcagacaaccagtctagaagagagacatakaggvcaagttcacaacctcttcagccaagaccacctagtgatatatatggggtatgttgatgatcccgcaccacttatatgcattgatgagacagagctg

SEQ ID NO: 4504 - DNA, 200 bp, Homo sapiens
ggctgcgcatgacctgatggcccctgtagcgccttgactgctgggcaggctgccctgggactctcagccaccagttgcttatccagatgtgacagagctcgacccagccaggctgcacactcctcgactcggctagcctccactgcctcggaaagtcggccgacggcccaaagctgctgaggggtctgaggctggtgccc

SEQ ID NO: 4505 - DNA, 198 bp, Homo sapiens
tgataacaatgcatcgtaaaaccttcagaaggaaaggagaatgttttgtggaccactttggttttcttttttgcgtgtggcaggtttaagttattagtttttaaatcagtacttttaatggaacaactgaccaaaaatttgtcacagaattttgagacccattaaaaaggttaaattggaaaaaaaaaaaaaaaaaaa

SEQ ID NO: 4506 - DNA, 230 bp, Homo sapiens
cacttacagctcatcaacataaaatgaatactgccagaatactttacaagcccaaagaagaattcttctatcagcattccttttatcccagcacacacctgtcaggaccagcaatagtttcaagacttaagccagcattgggttttgcagcagcagcataacatggcaggcacatcacacatcccctgccagctattcacatggtgatggatacgcttggcattccttat

SEQ ID NO: 4507 - DNA, 260 bp, Homo sapiens
gacagagcaggattctgtctcttaaaaaaaaaaacaaaaaaggaaaacaggaaaatcttcagaagcaaaaaccaaacaatctcaccgtgctcggctgagatcatgtttttgcaggaacatggatggagctggaggctattatccttagcaaagtaatgcaggaccagaaaaccgaggcccaatgttctcacttataagtgggagctaaatgataaggtcttgtgaaccaaagaaggaaacccaaaatactgggtttcctt

SEQ ID NO: 4508 - DNA, 108 bp, Homo sapiens
  misc_feature 84: n = A,T,C or G
ggtgagctttgctgattccgatatagtgcccccagccagtacctaggtgttccccaccttgggcatcatgcaccacaacaaacngcccactgagaatgcaaaggagga

SEQ ID NO: 4509 - DNA, 300 bp, Homo sapiens
cacctgcaggctgaagttttctttgtgtgttctgcttgcagaaaagcttcagacagagcttggtaagtaacccctcttagaactatttctcctcagggccgggtccagtggctcacacctgtaatcccagtactttgggaggccgaggcgggtggatcacgaggtcaggagatcgagaccagcctggctaacacagtgaaaccccgtctcttctaaaaatacaaaaaatgagcccgcgtgcgcatgtcctgtagtccagctacatggaggctgaggcagagaagggcgtcacccgggagc

SEQ ID NO: 4510 - DNA, 90 bp, Homo sapiens
aacccagggctgctttttaaactggtttatttattttattatattcagttttcataaggagccaattccactctgtaaaaaaaaaaaaaa

SEQ ID NO: 4511 - DNA, 384 bp, Homo sapiens
gaacaggtcgtgaaaaaaggtcttggtgaggtgccgccatttcatctgtcctcattctctgcgcctttcgcagagcttccagcagcggtatgttggccagagcatccggagttcacaccctctgtggtccgtagagccactatgaggagggcctggaagaatttgcattttcagtggaaacaagtggtcgttactagctaagatgtgtttgtactttggatctgcatttgctacacccttccttgtagtaggcaccacctcttaaacataggatgttcagttctcatttacagtattagagcatttagaggtacagctttggagtgatcaactagactatatgcatctagtatgttttcataactatacgtaaaaaaaaaaaaa

SEQ ID NO: 4512 - DNA, 241 bp, Homo sapiens
ggccatcaagggttccgcaatgccctgttggattcggcacggttgagaggtagtgccaatgctgtgaggatccgagccccccagattggaggtagcttcgcagtgttggggggcctgttcttcaccattgacttttgccttgtgcggcttcggggcaaggaggatcccttggaactctatcaccaggttggagcatttacccgggcctgtccttgccttccccagttgcccacctgccatt

SEQ ID NO: 4513 - DNA, 190 bp, Homo sapiens
aaaacctttacactatttctagaaagtcagcatgtatttttggctcgaagtttctctagtgttttctgtggaagggaataaaaatttgagtttcagttgtgtacttccatgcttgaaaaattaagtccttccccctcagttataactcaaccttaatggaattcttttgcccttgtctctgttttgggtc

SEQ ID NO: 4514 - DNA, 335 bp, Homo sapiens
gcacgatgctggagttgctcaaccagcttgacggctttgaggccaccaagaacatcaaggttatcatggctactaataggattgatatcctggactcggcactgcttcgcccagggcgcattgacagagaaattgaattcccaccccccaatgaggaggcccggctggacatattgaagattcattctcggaagatgaacctgacccgggggatcaccctgagagaaattcgctgagctcatgaccaggcagcatcaggggctgaagtgaagggcgtgtgcacagacgctcgcatgtatgccctgcgagaacggcgagtccatgtcactcaggag

SEQ ID NO: 4515 - DNA, 112 bp, Homo sapiens
cacaataatagtagggtgactttcaataactgcactgacagcactagacagttcatcaagacagaaatgtcaacaaagaaacaatcggactagaactaatacctccggagca

SEQ ID NO: 4516 - DNA, 292 bp, Homo sapiens
gatggcccagcagtcctggtggagcagcagactgattcagcaatggagccaactggcccaacccaagagcgctacaaggatggggtggtgaccatcggctgtgtgggtttcctaatgtgggaaagtcctcgctgatcaatggcctggtggggcggaaagtcgtagagtgtctccagaccccgggccatacccgatactttcagacctactctctcaccccctctgtgaagctctgtcactcccaggcctcatcatcccatctcttctgcctaggcagttgcaggatctggca

SEQ ID NO: 4517 - DNA, 205 bp, Homo sapiens
atgagacaaggtgcacctttttatcataaccctctttgccctacatgactttttttactgtgtgcatcccgtagtcctcctaattctctgtctcctccttttctcccaccatcactatcatcgtcattctctcagcaggccagtgcattttctgaggactctctagggcacacggttttatttagagccacatcgctcatagtga

SEQ ID NO: 4518 - DNA, 220 bp, Homo sapiens
gctcacttccccatcaacgttgttatccaggagaatgggtctcttgttgaaatccgaaatttcttgggtgaaaaatacatccgcagggttcggatgagaccaggtgttgcttgttcagaatctcaggcccagaaaggatggatttaattccttgagggaaatagacattagagctgtttcaaattacagcggctttgattacagcaggccacaccagtta

SEQ ID NO: 4519 - DNA, 150 bp, Homo sapiens
ctcgtgccgaattcggcacgggatctggtcactaatactgtgagattatttcagcattgagtattggccggcctacacgtgcttttggaagactctctagctgttcattttttggcaaaatctaactttttggaaaggacctaattttgg

SEQ ID NO: 4520 - DNA, 180 bp, Homo sapiens
tgggttggcaggagatggaaacggaggtgccgcccagcatgggggcaggtccccagtccaccctgcccctcccctgtggagaggacggttagttgggggtttgggctagggctccattctggattcgccggttccgggggaggggtggctctgtgccgataactctgtctagtacgtgtg

SEQ ID NO: 4521 - DNA, 230 bp, Homo sapiens
tttctttaccagtttccggcgtacctttgtctcacgggcacctgtgacggcgacttgcgatatcgcggatgaagcaacgcggttaattgccattgcggcggcaccaggcaccgccgtttttgcttgatacggcttagggttttcaacggcctgctcaagaccttttatggccatacatccccctttaagcggcgacggttaacggaaggcggtacgcccgtccaagccag

SEQ ID NO: 4522 - DNA, 140 bp, Homo sapiens
gaacttagagaagcatcagggggtgtgtactcagtattcaaatcagaacacaagattggaccttttggaaaaattggttcaagctttcctattaggccattggaattcaaaggttagcaggagcaagcaattaggcagag

SEQ ID NO: 4523 - DNA, 170 bp, Homo sapiens
ccaggaagaggtcccaacggtttgcctggagctataggtctccaggtgaccaaggccctgaccagctatggaggaaattggccgagacggttaaggcaaggccccccaagggttggaagaattccttgagattccttgacccccgggacctccttgggtttccgggtttt

SEQ ID NO: 4524 - DNA, 172 bp, Homo sapiens
gcaaggccccttagggcagttctgcctcttggggacaccttaggctgagtgatcgccttcccgtggctgagagctgagaaggtcttcccagactgcacaagttgttccggtctgttcttttgattggcccgtttaaggacttaatcttcctttaaggccccttggcacccat

SEQ ID NO: 4525 - DNA, 185 bp, Homo sapiens
tgagcctcactgtaaagccacttccaggtgaaatggctgaatccaacctttggcgtggttgcagcttgacaacccaggcgctgagcccttggcttgggccaagaggggtagaggttacctccattcttcttaacaattacaatttggttacaaggaattgcttaaggcttccaaattcacacatc

SEQ ID NO: 4526 - DNA, 190 bp, Homo sapiens
  misc_feature 6: n = A,T,C or G
ggagtngtgagggacaaggacacggagctttgggatttgctgacgctgtcattgccgtgagatggggattaaccatgacgtgaccacggcgtggggcggggattatttgcgtcttcttaccccaggggactacaatgtgacttccaattccgagggctaccattcagtgtacaagggactgtctgggtca

SEQ ID NO: 4527 - DNA, 160 bp, Homo sapiens
agaagatgcaggccaacaatgccaaggccatgagtgcacgtgccgaggctatcaagggcctcgtaaaggccaaggaggttaaggccaagattccaaagggtgttagccgcaaggtcgatcgacttgtctacaattgcccacacccaaggtttgggaagcg

SEQ ID NO: 4528 - DNA, 130 bp, Homo sapiens
  misc_feature 49: n = A,T,C or G
atcaaggctgccgttcggcctgcagagtcatcatgccatgtagctcgtnggtcgcccgtatcttgggcatgtgtgttgaaatcacttcatatatacaacgttctcgtgaaaatagagagacttagctcga

SEQ ID NO: 4529 - DNA, 216 bp, Homo sapiens
gaagcgagatgacgaaggggaacgtcatcgtttggaaaagcgtcgcaataagacgcacacgttgtgccgccgctgtggctctaaggcctaccaccttaagaagtcgacctgtggcaaatgtggctaccctgccaagcgaagagaaggtataacctggagttccaaggctaaaggtcgaaatcccccccggatctgtcgaattggggaacctaaaaa

SEQ ID NO: 4530 - DNA, 175 bp, Homo sapiens
cttatgtagataggcacaaaattttgcttataattcttaaagcattccacggacctctgaaggtcttctgttggacctctgaggcccttattaaggattccttgagggaataaaaaatgtatttgtctcgtattcagaaagctgtcgtgttgaaatccctattcttctgtctaac

SEQ ID NO: 4531 - DNA, 135 bp, Homo sapiens
cgcagtactgatcattctattttccccctctattgattcccacctccaaatatctcatcaacaacccgacttaatcaacaaccaacaattgacttattcaaactgaaccccaaaaacaaatggataaaccataca

SEQ ID NO: 4532 - DNA, 103 bp, Homo sapiens
cttgctccaacagtcactcttgaagatttttgccaactccatggatggaggacacttcagtagtcatctagatccttttataaggcaagtttgggggtattct

SEQ ID NO: 4533 - DNA, 140 bp, Homo sapiens
cccaaccatactgtgtgacatttgctagggaattgttggtaaaatcactcgagtgagcgcttgtcctgaggcactgcctctccgcgtgaatgtcacttatctgttccggttgaaccgttgcaatgttatacaagacttga

SEQ ID NO: 4534 - DNA, 162 bp, Homo sapiens
tgcctttgtggggggcagaattcacatgggcaaaagcttttgaaaatcataaaagatataaggtcggtgtgggctaaggatgggaaacaagggctgattcttggattcccaaatttctcaactctyccttttttctattttgaaatttcctctcgcgcttta

SEQ ID NO: 4535 - DNA, 207 bp, Homo sapiens
agaacaatgcctccactgacctatgacctatctgacaggagcatcaaccctctgggtgggctttgtccactatggtgaagtgaccaatgactttgtcatgctggaaaggctgttttggtgggaaaccaagaagcgggtgcttatcctcccccaagtttctttgcttggtgcagacggaagcgtgggggctcttgggggaggtttgtm

SEQ ID NO: 4536 - DNA, 202 bp, Homo sapiens
ccagaatggagcactgattggtaatccaccttctttctttagaaactggcgatggaatatgagaggagccctctggaaagaaaaggacaaaacctgttcttttaatgaaagtaaaggatctggctgaaccaggttccacaagggttactttatatcataggcctgaggtttaaaaggctgtgcccacttaagaatgtcatat

SEQ ID NO: 4537 - DNA, 141 bp, Homo sapiens
ggaccatcggcatttctgtggatccgaggaggcggaccaagtccacggagtccctgcaggccaacgtgcagcggctgaaggagtaccgctccaaactcaacgctcttccccaggaagccctcggcccccaagaagggaggc

SEQ ID NO: 4538 - DNA, 130 bp, Homo sapiens
tccactcattcctcggtgctcagcaccctgaggtgaggctccattgtctcatcagagctgcatgtgtatgccggccttccctggtccggtgatttgtgttccccacccctacacagactgcctgagctct

SEQ ID NO: 4539 - DNA, 210 bp, Homo sapiens
tgtttctgagctttcctgtctttccttttttctgagagattcaaagcctccacgactctgtttcccccgtcccttctgaattttatttgcactaagtcatttgcactggttggagttgtggagacggccttgtagtctcagtacgagtgttcgtgagttttagccaccttggcaagtgcctcgtgtcaggggcccggccgccctccatct

SEQ ID NO: 4540 - DNA, 306 bp, Homo sapiens
ccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactatcccaggcaatttgctgtagataatgtgattgcttccactgacataattatcccacactctctgtcccgggtatactttgtccacacgagatttgtagttctctgtagtaaat

SEQ ID NO: 4541 - DNA, 260 bp, Homo sapiens
ctaggtcgcggcgacatggccaaacgtaccaagaaagtcgggatcgtcggtaaatacgggacccgctatggggccttccttccggaaaatggtgaagaaaattgaaatcagccagcacggcaagtacacttgctctttctgttggcaaaaccaagatgaagagacgagctgttgggatcttgcactgttgttcctgcatgaagacagtggcttgcggtgcctctgacgtacaatatcactttcgctgtcacgggtaaagt

SEQ ID NO: 4542 - DNA, 235 bp, Homo sapiens
ctttgtagagagagtaaaaaattttaacacccatagtaggcctaaaagcagccaccaattaagagagcgttcaagctcaaccacccacctacctaaaaaattcccaaaccattataacctgaacctcctcaacacccatttggacccaattctatcaaccctatgagaggacctattgtgagtataagtaacatgaaaacattctcctccgcataagcctgcgtacagattaaac

SEQ ID NO: 4543 - DNA, 158 bp, Homo sapiens
ccgacccccctgcagtacatgcgggccgaccaggcagccggtggcctgagacagcatgacggcgaggttgatgccacactcaagttcctcaacaacccaggttgaaggagcattccgcagccccgagggttccgcaaggaacccttcttggaacctca

SEQ ID NO: 4544 - DNA, 203 bp, Homo sapiens
ggcggacattcagactgagcgtgcctaccaaaagcagccgaccatctttcaaaacaagaagagggtcctgctgggagaaacttgcaaggagaagctcccccggtactacaagaacaatcggtcttggcttcaagacacccaaggaggctatttagggcacctacattgtacaagagaatgtcccctctcactggtgaatgtgt

SEQ ID NO: 4545 - DNA, 280 bp, Homo sapiens
aagaaggacgctggaaagtcggccaagaaagacaaagacccagtgaacaaatccgggggcaaggccaaaaagaagaagtggtccaaaggcaaagttcgggacaagctcaataacttagtcttgttttacaaagctacctattgataaactctgtaaggaagttcccaactataaacttataaccccagctgtggtctctgagagactgtaagagttcgaggctccctggccacgggcagacctctcaggagctccttagtaaaggacttatcaaactcgt

SEQ ID NO: 4546 - DNA, 210 bp, Homo sapiens
tttggatttaacaaatttgtatttgaaacacattctatgtctgataattcttaatggcacttttactaatttatttggggatcttgggtacattcttaatttgtgtttattcttcacgcttgacttgcaagtggggtattcccctgccacaagtgtcaaacagtgatattcttcctgtgttgtgactgtgagcagatttttccagatact

SEQ ID NO: 4547 - DNA, 140 bp, Homo sapiens
gcggcggttgcggccttttcagcaattgccaagactaaggcgctgagaactctcgcgggaagaagaaggaggagccctctctaaacaacctgacgacccctaaggggtgagccctttccagccctcgcggtctgccaaaa

SEQ ID NO: 4548 - DNA, 141 bp, Homo sapiens
ccagtgcctcctcctgtgggcctggcctcagggctatggacagactcctgtcccatcccagagacccctcgtgatcgttccctggcacgtgggccgtggcccggcttggtcggcttaaggacttcggatggaagctctccg

SEQ ID NO: 4549 - DNA, 161 bp, Homo sapiens
tggtagcagcaaaagtaaagggtgagaaactggataagaagctgaaaaaaatggagcaaaacaagacagcagccactaggtaccgccagaagaagagggcggagcagggaggctcttactggtgagattcaaagagctggaaaagaaggaacgagggctct

SEQ ID NO: 4550 - DNA, 111 bp, Homo sapiens
ctcgtgccgaattcggcacgagaaacatcaattttctgttcattacttactgttttgtctttagggtgtacaacctattgaggcctttggcaaaagcttcgagggattgtt

SEQ ID NO: 4551 - DNA, 120 bp, Homo sapiens
ccacagaagaaaccatttagtgtaatataattccatttacttacatttcaaaccaaaaaaattaaatagcatattgtttttggatacacaaattagtaggtttttaaaaggattattaaa

SEQ ID NO: 4552 - DNA, 135 bp, Homo sapiens
tggaatcggggtgaatggcgtcctccagcctcaggagtatacaagggcttacacctcagtagtactacaccaacagcacttgtacataacaagtgtcctacaacggcagggtccagactttgtttaccaaccctt

SEQ ID NO: 4553 - DNA, 172 bp, Homo sapiens
gttacatactagttgctagttagaatgatcagaatacattttttaggagcggtcatttttattaagttagttttagtagagataaggaaggaagtattttctttattaaccctgacccctttatttgaagagggagttatgggtaattgaaaggagtgtagaaagatttgga

SEQ ID NO: 4554 - DNA, 255 bp, Homo sapiens
caaaggcatatcttctatatctgaagagtatccttccttcaggctttaatagactgagtcagatgggtctgatattaatcaaaattgtctcttctgaggacccctgataagcattgacttgccgtcccctaagggaatccgagcggctacaaagcggtttctttacttctcacttcaattaattctcgtcgctctcgctttgggagagcgtactcttttttatcccctacacacaacccccacatatatgtattt

SEQ ID NO: 4555 - DNA, 175 bp, Homo sapiens
cgaggcgcctggcacagcttccctcttggcctttcatgatgaggtgcctcacaaaccttcctgacagatggggcccccccggggggggggcgttaactgaggatttccaaggcctacgggcagaggtggagaccatctccacggatctggagcttttggacagagagctgtccca

SEQ ID NO: 4556 - DNA, 300 bp, Homo sapiens
gcggctcggactgagcaggactttccttatcccagttgattgtgcagagtacactgcctgtcgcttggtcttctattcaccatggcttcttcctgatatccaggtgaaagagctggagaggcgtgcctcaggccaggcttttgagctgattctcagccctcggtacacaggactctgttcccagatttcccccttcccctccaaagaagaggatctctcccgggaggaaaatacagaggaaataagacgctacagaggagagacgcaggccccatgacgctgaggtctaaggcagctcgc

SEQ ID NO: 4557 - DNA, 400 bp, Homo sapiens
gttaggtagctttagggcaatattgccatggttttactcatgtgcaggttttgaaaatgtacactatgtattatttttaaaattgttttattattttggaaattattgtgttattccatgccaggcctctgcacagaggcctgagagcacaggttgttactctctgtgtacacctagggacacacatgtgtgctcttttggagcccctttttctccccgggctcctaatagaataacgcgcttatggggtatgtgaaatatctctagtggcgtttagagagcccagtaggtaatgtactgcagcatgatgagagttcctgataaatcatgtataacacctgattttggagcaccacacatatggcaggtcgcagtaatgcagccccacagaaactcccct

SEQ ID NO: 4558 - DNA, 135 bp, Homo sapiens
ctgtgtgtgcgtgtgagaatgatcacatgtggcgtcatgctttgtacagagcctcagaacactgggggcttgttcagtgaggggtccctcttggggacacacacacaggggggccgcccagggcgcacacctagg

SEQ ID NO: 4559 - DNA, 131 bp, Homo sapiens
tggcactggcattgtccctgtgcctaacaaccagcgtttgaggggctcggctttctgccctacagaggtctctgccggctcttttcttgctcaaccattggtggaggaaaacagttcaacacacacattgc

SEQ ID NO: 4560 - DNA, 121 bp, Homo sapiens
gaaaatggttcgctattcacttgacccggagaaccccacggaatcatgcaaatcaagaggttccaatcttcgtgttcactttaaggacattcgtgaaacttctcaagccatcaagggtatg

SEQ ID NO: 4561 - DNA, 210 bp, Homo sapiens
caacagcgacacccactcctccacctttgacggtggggctggcattgcctcaacgaccactttgtcaaggttattttcttggattacaacggattttgctacaacaaacaaggtggggggagctcattggccacatatgctctccaggagttaagagccctctgggacacacacaccccagacacagaggcacacacaggggagagagag

SEQ ID NO: 4562 - DNA, 150 bp, Homo sapiens
ataggcgcaagctgataagacaatgctcactgactatgactatctgacaagagcatcaaccctctgggtggctttgtccaatatggtgaagtgaccaatgactttgtcatgctgaaaggctgttttggggggaacccagaagggggggct

SEQ ID NO: 4563 - DNA, 175 bp, Homo sapiens
aaatttttggatggtatctatgtctctgaaaaaggaactgttcagcaggctgatgaataagatctaagagttacctggctacagaaagaagatgccagatgacacttaagacctacttgtgatatttaaatgatgcaataaaagagcctatttgatttggagccttcttcttaaa

SEQ ID NO: 4564 - DNA, 231 bp, Homo sapiens
ctcgtgccgcagaatctctggacggagctgctggcagcttctgcgagaagagagagatgtggaaggcaccttctagaagagagcgtgcctcaggttacttgaacttgaacggagactgtagacttccggactttcccctaggacttggggccctgtaggctgctgttggaggacttggtagagacattggaggggagggaagggcttttctccacacaaagggcagagagt

SEQ ID NO: 4565 - DNA, 190 bp, Homo sapiens
gagacgtcgggagcacagtcgggagagggacagggagagagagagagagagggagccgggaccagggggggaccgagatccggtatagggaaagggcccgagaaccgaggccagggaaagggatcgcagggaccaccaagcgccacaccagaagccggagtcggagcacacctgtccgggaccggggtgg

SEQ ID NO: 4566 - DNA, 110 bp, Homo sapiens
gcccaactggccatcagagtcaccaaccccaatgccaggctgcgcagtgaagaaaatgagtaggcagctcatgtgcacgttttctgtttaaataaatgtaaaaacttcca

SEQ ID NO: 4567 - DNA, 205 bp, Homo sapiens
ctgactttgacacacatggccaccttggcacaaaagccttgtggtatagagaaacaaatttgttttttatgtcctcttctccctttgccatctttcagcataggacttaactcccttaaggccagacatctgttgagacctgaccctagtcattggttaccgtgtgtcaaggcaatctggactttcagtgatgccactgagatgg

SEQ ID NO: 4568 - DNA, 207 bp, Homo sapiens
ctcgtgccgaattcggcacgagcccagatgcagtctacacagaactccagcccacctctccaaccccaacctggcctgctgatgaaacaccacaaccccagacccagacccagcaactggagggaccggatgggcctctagtgacagatccagagacacacaaggagcaccaaagcagctcatcccactgatgcaaccacggccgct

SEQ ID NO: 4569 - DNA, 248 bp, Homo sapiens
ggaactatcttaaggcacatgtgcaatggaatgaataaagaagtggcatatgtccatgggaatactgtaaaacagtgagcatgaatgaactagaagtccgtgtaataacgcagctgaatttaacaaaccttgctgattgaaagactccagacacaaaagccaacatgctgtatgattcctcctatataaattataaagacgggcaaaccttgtatacgtggtttaaaattgagggtggcagttagcct

SEQ ID NO: 4570 - DNA, 233 bp, Homo sapiens
cagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaggactggtggtccatggccctgctgattagatcatgccattcagtggagtcccaaatgaaggtttcatcttccg

SEQ ID NO: 4571 - DNA, 211 bp, Homo sapiens
ctgatgtcggtgcaggagctgaaggtgagtggagtgctgccaagaatatgcccgacttcccatgacaagacagaactttgtaacaaacagtaccaatttattttggccgtggggtttttgcttttttttcagttgatgactttgtgaacaattccaggtatttgaggcctctgttggccttaaatgtctgctcagtggagggagagcccag

SEQ ID NO: 4572 - DNA, 150 bp, Homo sapiens
gaaacattcagtagaacattttattgcctagttgacaacattgcttgaatgctggtgggtcctattcctttgacactacacaattttctaatatgtgttaatgctatgtgacaaaacggcctgatttctagtgccaaaggttcaacttaa

SEQ ID NO: 4573 - DNA, 145 bp, Homo sapiens
cgcatggcttccctgttccccagccccttgctccctctgttgattccggcccctgtcttcagggctcactgtgcaacttcttctgttcactgcttcttcttggggcctgttcattcccagggggtgtccccggatgcaggagggg

SEQ ID NO: 4574 - DNA, 120 bp, Homo sapiens
cctacgcacacgagaacatgcctcttggcaaagggtcttcctcattcctcttcaggagagagaggaagaagagcacacaaaggagggaacggcttgtatcacgagagcccaatttccatc

SEQ ID NO: 4575 - DNA, 110 bp, Homo sapiens
caagattacatgaatcaatcaagggaacttgaaggacagagacagaagagtaaacctttatgacaagggcttcaagaccaattaaggacacatccttcttattttacaaa

SEQ ID NO: 4576 - DNA, 153 bp, Homo sapiens
gtcaagccggatgcctaagtagaccaaatcttgttattgaagtgttctgagctgtatcttgatgtttaggaaagtattcggtacaacttgtaggatctacttttttgaacttttcaatccctgtgaggtgacaaattctctcatatgactagg

SEQ ID NO: 4577 - DNA, 120 bp, Homo sapiens
cttgatttcatttcaattgtcattagttggtattaaccagcaggagaggttgatgagccattttttcaaattgaaataccttttaatttccattataattttttttattttaggagttca

SEQ ID NO: 4578 - DNA, 135 bp, Homo sapiens
ctcgtgccgaattcggcacgagggcggtgtggtcgcagcaggcgcaccaagccctcgaaatgcaggaccggcggccgccgagttcgttgtacctgtacggtgccgggggaaatgttcccgttaggcaattggaat

SEQ ID NO: 4579 - DNA, 230 bp, Homo sapiens
attttatttacaaaatatatactgaatactatacatctggccccatcaccatgggaacaactccaaagcctgcctggggatttgtgcccaagcccagcccaggagggctagagaaagcaaaggtgtctaccagccgccgccattccagaagggaagcctctttccatgagtgtctgtcggtgggcggtgagctcaacacccacaaagggcagaaggctctgggcagtgag

SEQ ID NO: 4580 - DNA, 175 bp, Homo sapiens
cccggtggaggaggtccgcagggagcttctgaagccagacacgtgtttatgaggcgagagagtcactggggaagtcctgcgctccgagggcttcaggagcgtgtccttgtgctccaggtggcttcggaagatctccttggccagcttggccaccaggtgctttctgtagagatcg

SEQ ID NO: 4581 - DNA, 220 bp, Homo sapiens
  misc_feature 53: n = A,T,C or G
cacctccaggtgccccaccgccagctccgcatgtgaacccagctttctttccnccaccaactaacagtggcatgcctacatcagatagccgaggtccaccaccaacagatccatatgggcgaccttcaccatattgataggggtgactatggcccccctggaagggaaatagatactgtaagaacgcgcatatgagtgtaagctctaatttgaagagatc

SEQ ID NO: 4582 - DNA, 120 bp, Homo sapiens
  misc_feature 87: n = A,T,C or G
ctcgtgcgaattcggcacgagttacgaacgcacttacagtcgcatcataatcctctctcaaggacttcaaactctacttccacttanaagctttttgatgacttctatgcgaaggcttgc

SEQ ID NO: 4583 - DNA, 150 bp, Homo sapiens
gtttcctgactttatccaagagcagtgcaatcgtttggtatttcaacttcaaggagagctagggaggagaggaagaaggcttcaaaagagcttgaaggagacagagagccttagagacacagagagagactctcgaaccccacactttaa

SEQ ID NO: 4584 - DNA, 120 bp, Homo sapiens
gtcccctgctatgcctcaggtgaaccacataattcttggggttccgttcctacttgctagggatttctgaacaagttcaatggggccgcacacagtcttggcccacttccgcgatttaaa

SEQ ID NO: 4585 - DNA, 120 bp, Homo sapiens
ggaccccagcttttcttgccaagctcagcagttcactttctagagcatctgtcccactgggacacaaccacctaatttgtcaattgaaccctccctgggcctttcttaaattgggattaa

SEQ ID NO: 4586 - DNA, 205 bp, Homo sapiens
gagaattttaatgtttttcatttatcattgtaaaaccaagggcaattttataactttttttgtacgtgagctgttacatgtaggggcaatcttgtctttaagtaggggataaattactcctaaaacaaaaaaggattctctggtagtgtttcccttcaagtcaagcgtctctgtgtgtttaaataaactctctctgtgttaaaat

SEQ ID NO: 4587 - DNA, 120 bp, Homo sapiens
ggtaatgcatgacaaataaaggattagggttttccctctaatgaaattgtaaggcataagggattttagggtttcttcagagcaaaaattagggtatgcctttaggcgtgatttttgggt

SEQ ID NO: 4588 - DNA, 288 bp, Homo sapiens
ccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccaaatttgacgtgcaactcaaagagcctcggaaaaatggcagaataatct

SEQ ID NO: 4589 - DNA, 220 bp, Homo sapiens
aattataaccaagcataatatagcaaggactaacccctataccttctgcataatgaattaactagaaataactttgcaaggagagccaaagctaagacccccgaaaccagacgagctacctaagaacagctaaaagagcacacccctctatgtagcaaaatagtgggagagatttataggtagagggcgacaaacctaccgagcctggtgatagctctgt

SEQ ID NO: 4590 - DNA, 200 bp, Homo sapiens
gtttcaacagcatctctgctgttgacaatggctctctggccaacacgcctcatctgagggagcttcacttggacaacaacaagcttaccagagtacctggtgggctggcagagcattaagtacatccaggttgtctaccttcataacaacaatatctctgtagttggatcaagtgacttctgcccacctggacacaacac

SEQ ID NO: 4591 - DNA, 183 bp, Homo sapiens
gcagaacccaccaaccagaacgtgggtttgcctgaggctgtaactgagagaaagattctggggctgtgttatgaaaatatagacattctcacataaggccaggtcatcaccatttcctcctttacccttcaggtgcagtttcttttcacattaggctttttggtcaaaccttttggggcacgg

SEQ ID NO: 4592 - DNA, 110 bp, Homo sapiens
acagtgtgtttaataaattgtaattattttgtgtacagatctatactgttatctgtgtccatttccaaaacttgcacgtgtccttgaattccatctgactctaatttaat

SEQ ID NO: 4593 - DNA, 123 bp, Homo sapiens
cacagcgccatctctccctgagaataaagccgatagccaccctcctccggctccgagcctgcttctgccacacctcgctctcagttctctccacatttccatagagaccctgtggtttttgtt

SEQ ID NO: 4594 - DNA, 110 bp, Homo sapiens
ctttaatccttccactatcattcccattttgttacatttctgttatggggactttatgttgaaatattgtataaagcatttgtagcaatttaaaaataaaatatttaaaa

SEQ ID NO: 4595 - DNA, 213 bp, Homo sapiens
gcattgtgcaatacagtttcattaactccttcccccgctcccccaaaaatttgaattttttttttcaacactcttacaccttttatggaaaatgtcaacctttgttaaggaaaccaaaataaaaattgaaaaataaaaccataaacatttggcaccacttgtgggttttgaatatacttccacagagggggaggttaaaacccacaacttcca

SEQ ID NO: 4596 - DNA, 190 bp, Homo sapiens
ggaaacgccacctggtggtccctttaactgaagctttgccccctgcccgaaaggaaggtgattttgcccccacttgttggtgtatattgttgaccagaccccgggagcggcccatgtagaaagagagagacctctatctttcatgcttgcaagtgtaaatatgttacagaacatgcacttgccctaataa

SEQ ID NO: 4597 - DNA, 110 bp, Homo sapiens
ctcaggggctctagggactgccaggctgtctcagccacggagggcaaaatcaagagtgagatggtagagaggtgttaaaattaggaaaaggtggaagttggtgaattcgg

SEQ ID NO: 4598 - DNA, 165 bp, Homo sapiens
cagtcaaactgactcttggggaaagcaaccctcaagcacgatacccagagcatggtagtccaagggctttggcataccctaccatagggaattgggtctctgccaatcgcagagaggcacactcattctagaggaaaattccagtatgtataggtagtttcccag

SEQ ID NO: 4599 - DNA, 110 bp, Homo sapiens
atttcaactgtcagcatgatttccaggctccatatcttctacataggaaaatatgtcaaagagcaggagcagttgactttaaccttgagaccatcccagcgggagggcca

SEQ ID NO: 4600 - DNA, 120 bp, Homo sapiens
ggaaacaaagcttagcaggagaggagagccagagaagtgcacaaggaagcttacaaggttacaacaagattttgtgaacttcagcccaggcaccagttggttggccaggcccttagcttc

SEQ ID NO: 4601 - DNA, 115 bp, Homo sapiens
cttttttttcccactaagggtattttacttttaaggtagcttcgaatatagcaatacaattttaaaaatttaaaaacttgaattttttggtatcctattttaagggaatattatg

SEQ ID NO: 4602 - DNA, 110 bp, Homo sapiens
cgcgggccttgccagcgagcaccctcatcgggctgtcgctgacagcatacctcaaaagggcctagctaataaacctgtaaggccagcatttgagagaaggtagggtgtgt

SEQ ID NO: 4603 - DNA, 152 bp, Homo sapiens
ggggaattctccgcgcctcgaccttcccgacgacagacgtctcgtccaatcatggtgaccctgccttgctcgcagttcttgaggatgctgctatcgaaccttcgtgacttacggtgacctagttacaacaattataaggggatatttttaaa

SEQ ID NO: 4604 - DNA, 168 bp, Homo sapiens
ccggatcacctgttttgaaaccatcttccaagccatgctgaatgctgtggacccggatgcaagtgtcaggcatgggaagtcattgtccacatcatcgaggaggacaaaatcaacacacacggacaatgaagggccgaattggcttaccctgtttccagaggcccactt

SEQ ID NO: 4605 - DNA, 380 bp, Homo sapiens
tccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaattggttaactattaaatgttgacctagccagcgcagtggctcatgcctgtaatcccagcactttgggaggctgaggcgggcggatcacctaggtcggagttcgaggccagcctgaccacatgagaacccgtctcttttaaaaaaaaaa

SEQ ID NO: 4606 - DNA, 225 bp, Homo sapiens
ctgacagactcgctcaggaccctgaagcccgaggcaacatccttcgagaccggttcaagagcttccagaggaggaatatgatcgagcctcgagagagagccaagttcaaacgcaagtacaaggtgaagcttgtggagaagcgggcgttccgtgagatccagttgtagctgccatcagatgccggagactcgcccttcaataaaaaatctcttctagctgaaaaaa

SEQ ID NO: 4607 - DNA, 330 bp, Homo sapiens
ggcggtagttggtgtgtcctcggtttctcggctgctgggtcggtcccgcccacagctggggcgccctatgtcgagtggcgcccatggcaaaggagggctcagctcgcatgtggaggactctcaccttcttcgtcgcgctccccgggtacgccagtcagcatgctgaatgtgtacccgaagtcgcaccacggagagcacgagagacccgagttcatcgcctaccccatctccgcatcagaccagccgtttccctggggagatggtaccatactctattccataaccctcatgtgaatccacttccactgctacgaggatcgataagggatt

SEQ ID NO: 4608 - DNA, 360 bp, Homo sapiens
gcgctacgtcgtcctacctgctggctgccctagggcaaactcctcccccagcgccaaggacatcaagaagatcttggacagcgtggtatcgaggcggacgacgaccggctcaacaaggttatcagtgagctgaatggaaaaaacattgaagacgtcattgcccagggtattggcaagcttgccagtgtacctcctggtggggctgtagcgctctcttctgccccaggctcttcagcccctcctctgggttctgcccctcctgcagcagaggagaagaaagatagaggaggagagtctaagagtcaaatatgacatggatttggccttttgataaattcctcctccctccaaataagcctt

SEQ ID NO: 4609 - DNA, 205 bp, Homo sapiens
agatgacacacttggttctcagattgctgaccaccacttgtctagtctgcttggtggctagggacagcagaagtagaagaggaaatagatctggctgagtggaagagaggacagaattgggaggggagggaaagtgaagacaaggcagacaaagtggaaagcccctaatgctcttagaagaagtctaaaacccttcgtctttttc

SEQ ID NO: 4610 - DNA, 238 bp, Homo sapiens
ataaaatgttccttttgacaatatacacggattattatttgtactttgttttttccatgtgtttttgctttttatccactggcattttttagcttcttgaagacatatcatgttgtgagataactttcctttcacatctcccatggtcctagcaaaattgctaggcctgtagtagtcaaggtgctcaataaatatttgtttggctggttgtgagccttgctgccaagtcctgactttg

SEQ ID NO: 4611 - DNA, 142 bp, Homo sapiens
gttatgaaaagaccttagagatgagagagaactttcagaagcagttacaaggagataatgtctgcaacatcaatagtgaaaccccaagggcagagggcttccctttcaagaagtggttgataacagcgaatcgtcaacccct

SEQ ID NO: 4612 - DNA, 151 bp, Homo sapiens
gcagaatggctcccgcaaagagggtggcgagaggaaaaagggccgttgtgccatcaacgaagtgtaaccccgagagtacaccatcaacattcacaagcgcatccattggagttgggcttcaagaggcgttcacctcggcactcaaagagat

SEQ ID NO: 4613 - DNA, 101 bp, Homo sapiens
tgtggctcagagcttttacttgaggtgctaaccttggctgctttctccagtatggacaagatttgaagtacagaattttcaggccagcaggcccatacaag

SEQ ID NO: 4614 - DNA, 103 bp, Homo sapiens
ccttttctttcatggttttccttcctatttcttgaaagatcttagtaagccaatgctacagataatctgggattggagatgcattccacccttaacctttttc

SEQ ID NO: 4615 - DNA, 161 bp, Homo sapiens
ctcgccattttgggggaattccaacagttctaccttttgaagattaatgagaagggaagaaagaaagcaacttatgtgtcatctactgtgtactgggaacattaagcaaattttatttaatccttacagcgacattacaatgaagcattattattacattt

SEQ ID NO: 4616 - DNA, 127 bp, Homo sapiens
cccaatctaagcagactttgccttttttcaaaggtagagcgtgaataccagaaggatccagtattcagtcacttaaattaaggtctttgtggcaagaattacctttttgcaacaggcttccttgaat

SEQ ID NO: 4617 - DNA, 130 bp, Homo sapiens
gtgaaaccaattgtgttcatctagatagtaagtaactcctatttttactgttaattttttaaaagagaatttttccctgtggaaactccctgttagtacgtcctcaggggagaaagcctgtagaatatag

SEQ ID NO: 4618 - DNA, 270 bp, Homo sapiens
ctgtcagttctagttctctgttatgctgaactttctctataaccttggagaagtcatctcaatctctatataccacacctttcttatctgtgtaatctcttagttcttttagcttcaaaaggatatgaattggcaactgaagttggtttgtctcaactctcctgagagcctaactgtcaaggatggcatcatgttggaaaacacatcagagctccagcgtgcagtttcagggatgcttttaaaatctacatgggcgtggagactctaaga

SEQ ID NO: 4619 - DNA, 305 bp, Homo sapiens
tggctgtggagctgggcgtgctgctcgtccggcccggccggaaccggctgggtagagtgatgcggaccctctgcttgtgctgtgcttgcgacgcgcggaagccttcttactttcacaatcggagagacggagaaggaaggtctttttttaagagattcccgaccgaaccattgtaaataggaaactatccgacgcaactctatataaagcaacgcgaggggtatccacccgcacaccccgggctctgagcattgttttgagatgatgaggccccagagcacagtatcttctgccccaagcagtat

SEQ ID NO: 4620 - DNA, 235 bp, Homo sapiens
ccgagatgtctcgctccgtggccttagctgtgctcgcgctactctctctttctggcctggaggctatccagcgtactccaaagattcaggtttactcacgtcatccagcagagattggaaagtcaaatttcctgaattgcctatgtgtctgggttcaatccatccgcaattgaggtggcttaactgaggattggaagagagattagaaaagtgtggacgcttacagacttgtctt

SEQ ID NO: 4621 - DNA, 265 bp, Homo sapiens
tccaaacacaattttccacattagcagctccaatcttcttaaataaagctctgtttttcctatatctttatgactgctgagacccacagggaccaatatttgtattcaaattacattcaatggttcccattggtttaaaatgaggtctattaattgggattactatatattatcccaggattgacaatgcccggattgctttcagtatgtgtttaatgtagagatttcctctcatgacactatgtgtatatatctctgttccctg

SEQ ID NO: 4622 - DNA, 107 bp, Homo sapiens
ctctcaacctgtgcgggctgctgcgtcccaggactgagacgcaggccagccccggcccctagccctcagggcttctttcttatccaaataaatgtttcttaatgagg

SEQ ID NO: 4623 - DNA, 265 bp, Homo sapiens
ccacgagtcatgtcaacacagcgtgttgctaacacatcaacacagacactgggtccacgtcctgcagctgcagccgctgcagctacttctgctgttcgcaccgttccacagtatcaatatgctgcaggaggtcggaattcttagcaacctctttatgcacgagcacaaggttcacatgcaacagaccttctgtttcatgtatacagggcaggggcccctgtgctgtgtttccatgtgtggtgtgtccctcctcatgaggcgaaag

SEQ ID NO: 4624 - DNA, 245 bp, Homo sapiens
gggagaggcaggtactcacttggagtgctctaggctggtgcatacttggagcagggctggaagggctaaaggaccgttgccctgcagagggtacttctaccatcttcagcaagggtgaagggttggccaactcactgatgagccaagataggacttaagagtcaagagttgtgtctcacaaagggacactactgtcactctcaccagggcacatagagtcagatctttgtgtgcacattctcgca

SEQ ID NO: 4625 - DNA, 300 bp, Homo sapiens
ttctgacaccctgttcccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagattaaaggttcctctgagatgaggctgaataattatgaacctcacctcctctgattgttggagttgcacgaactcgggagacgtcctccataagtagagcacaga

SEQ ID NO: 4626 - DNA, 270 bp, Homo sapiens
aaaagaccattgtagtaaataagttcaaggggaacttgggaccagaaaccactgttatgtacaaaaaaaatggcaaattcaataaactcaaatttaaaataatttttaaattaacagttatgataaattttatattttatacaaatagattgcttaggatggttctcaagaattataagagaaatgtactcacagtgcaaaaattttataattactatactctgtgttttgtttggggggctggggaatgtgttttttacatgtagcgca

SEQ ID NO: 4627 - DNA, 240 bp, Homo sapiens
ggaagacaaaggcgctttggctaagctggtggaagctatcaggaccaattacaatgacagatacgatgagatccgccgtcactggggtggcaatgtcctgggtcctaagtctgtgtgctcgtatcgccaagctcgaaaaggcaaaggctaaagagacttgccactaaactctggttaaatgtacactgttgagtgtttctgtacactaaaataaattgagatatatatcacatatttcct

SEQ ID NO: 4628 - DNA, 265 bp, Homo sapiens
cagaggaggatttcctaggtaaagggagagaagcataagatgacaatcttaggcaaggaggcacaacttaagttaaagcttagaggtagaaaatgacctagtacctttataggcagctaccagcattttagtgttactatgagggacagtacaaagcagggagttggcccggcgcggttgctcacgcctcttattccagcacttttggagggcgcgatatggcgggtcacgcggtcagagatctagaccattctctcttcacact

SEQ ID NO: 4629 - DNA, 225 bp, Homo sapiens
cagttgaagaggcaagatagttcccagctttaataaataactgcggccaggcgcagtggctcacgcttgtaatcacagcactttggggaggccgaggcaggtggatcacttgaggtcaggagtttaagactagcctggccaacatggtgaaaacccgtctctactaaaaatccaaaaattagctgggtgtggtggtgactggctctactctggagtctgagacag

SEQ ID NO: 4630 - DNA, 255 bp, Homo sapiens
tgaggccctcacttcatccggcgactagcaccgcgtccgcagcgacagccctacactcgcccgcgccatggcctctgtctccgagctcggcctgcatctactcggcctcattctgcacggacgatgaaggtgacagtcacggggggataaggatcaatgccctcattaaaggcagccggtgtaaatgtttacccttttttggccttggctttatttacaaagaccctgtccaacgaaacattgggagcctacaat

SEQ ID NO: 4631 - DNA, 150 bp, Homo sapiens
gggctatttaaaattttattgactaatgtgcaaacttttttttttggttattgatgtttgttttaattccgctgtggccagataactactgtgtaagatattaattctttgaaattgatgagagtagctcaacctcacttttaggaaagg

SEQ ID NO: 4632 - DNA, 252 bp, Homo sapiens
cccacatgttgtgggagggacccagggggaggtaactgaatcatgggggctggtctttcccgtgctattctcgtgatggtgaagtctcacgagatcttatgggtttatcaagggtttccacttttgtttcttcaatttctcttgccaccagcatgtaagaagggccctttgggcttcctccacagatatctgagggctccctagagcayatgggagactctaatggcacattaaaaccctctttctttccca

SEQ ID NO: 4633 - DNA, 240 bp, Homo sapiens
cggcacgagtaaaaggcagcgcagtcaggatattggtaggtcgggggcggctttggaaacccttaagtttacaagcatgcgcggacttgagtgctcattaggtcgccgggcgtcacgtgcagccctggagccctgaaccccggcgtgcgttgggccgtgggccttcggggaaaggttccctgcactctgggggctctccgtgaaggcgctttacacccgctcttttaaattgggcacatc

SEQ ID NO: 4634 - DNA, 232 bp, Homo sapiens
gaatcagtcacaatgaattttacttgaatattgtatgttgcattccacttcatttgaaaataatgaaaccatgtaccactgtttacatcatctgtagtgatttcatagataatatatttaatatgacagagttatgtttcaactctgtagatgtttaacgtcatagacagattgggcctctgtattcgtgagctctatatctgtgtaattcaaccacgcgttgggggggaaa

SEQ ID NO: 4635 - DNA, 285 bp, Homo sapiens
gtctctctgacctcatattctactctgtcttacttaatctgctgtaatcacaccagctccttcactactgtggaacatggcagtcatattcctgcatcaaggcctttgcacttgcagttccctctgcctgaaccctctgcccctcttcatccttgacctcatttctttatcttcttcatgtcttctcactcagttgtcaatttctcagtgaccttatatgaccacctatttaaaattatattgtgctcgccctagcattctcatgtgtcttcccgtctcttctcc

SEQ ID NO: 4636 - DNA, 286 bp, Homo sapiens
gttcaattccaaacagctgctttatttggagaaataccgacctaagatgcgattacgcttcagagataccaatgggcatttctgtgttcagtaggagggaaatgtaaacgaggcctgacttgattgtgccatttagggggaacctctggtaccctgggaatgtgaatctggataataccctgtctaatcaaggaggtattgggttaggcactcctaacccactttctaatgttggcacagcgcacacaaagagagtctctctatatgtgatatgtgttgagagaga

SEQ ID NO: 4637 - DNA, 396 bp, Homo sapiens
ggcactcagaatggtccagcgtttgacataccgacgtaggctttcctacaatacagcctctaacaaaactaggctgtccgaacccctggtaatagaattgtttacctttataccaggagggttgggaaagcaccaaaatctgcatgtggtgtgtgcccaggcagacttccgaggggttcgtgctgtaagacctaaagtgctaatgagatggtccacacacagagacatgtcagcagggcctatggtggttccatgtgtgctaaatgtgtcgtgacaggatcaggcgtgctttcctcatcgaggcgcagcaaatcgttgtgaaagtgttgaggcacagcacagtgtcagaagctaataaaaaatgaaactttttgagtataaaatgaaaagccgtgt

SEQ ID NO: 4638 - DNA, 230 bp, Homo sapiens
cataaaagaagccgccctagccacgtcccctcgcagttcggcggtcccgcgggtctgtctcttgcttcaacagtgtttggacggaacagatccggggactctcttccagcctccgaccgccctccgatttcctcttccgcttgcaacctccgggaccacttcttggccactctgcttctggaccttccacaccgttttgtgggtagtcctcttccaaccaccagtggccc

SEQ ID NO: 4639 - DNA, 210 bp, Homo sapiens
ctcgcctgccaccggtgcacccagtccgctcacccagcccagtccgtccggtcctcaaccgcctgccggccggcccaccccccaaccggaggccatggacggccatcaaggaggagatgcaggtgctggaggttgacaaggaggacggcattgaccggccgaggaggccggaggccacaaggagcaagcttagggacccttcaaaacttg

SEQ ID NO: 4640 - DNA, 121 bp, Homo sapiens
ctcgtgccgctgagctgaaggaaaagattgatcgccgttctcgtaaaagctggaagatggccctaaattcttgaagtcttgtgatgccgcccattgttgatattggttcctgcaaggccca

SEQ ID NO: 4641 - DNA, 239 bp, Homo sapiens
gaaccatggagggtgtagaagagaagaagaaggaggttctgctgtgccagaaacccttaagaaaaagccgaggaatttcgcagagcttgaggtcaagcgccttagaaaggaggtttgcccaaaagatgcttcgaaggcaagggaggaggcttttctttaaaaggcaagctctctcacaggatatatggacagtatgacacagatctcaaattgcgatgcgcgagtatgcgcaagaaaag

SEQ ID NO: 4642 - DNA, 195 bp, Homo sapiens
ctactttcagggagtagaatcctgggattttttgaaggatactgtaagatggtgattatatctcaggaggggttccgtgggtctgtaccctttctgccacaagcaattatgaagcacatagggttgaggaagccaattaactggttgggtttggttattatttcaattatacacatggttgagtaaatatctcca

SEQ ID NO: 4643 - DNA, 290 bp, Homo sapiens
gggctgaggatttttggtccgcacgctcctgctcctgactcaccgctgttcgctctcgccgaggaaacaagtcggtcaggaagcccgcgcgcaacaaccatggctttttaaggataccggaaaacaaccgtggagccgaggtggcaattcaaccgattcggattacccttacaaggccgaacgtaaaatccttggaaaagtgtgtgtcctgtctagatagaggcgcaaaggaagagtctctcatgtgagagcccagctcgtagtcctacgagactagagagtactacaga

SEQ ID NO: 4644 - DNA, 165 bp, Homo sapiens
gttttgttactgatattgtatgtattcatatgcattgtggatcatgcaccatgaaacttgaaaattgttccaacatctcaatgggccacacagtttgtagctttttgcctgtaaaccgtgtatgtaaccatttgaaccgcgtatactaattacctaactcctttt

SEQ ID NO: 4645 - DNA, 136 bp, Homo sapiens
gcgggtccgctgctggcagcgctggaaactgggtggacggcatgggttggtctcaggatttgttccccggccttgtggagatcgctgtcaagggaagttaaagagcacgttggcacggaccaattcggggacaaat

SEQ ID NO: 4646 - DNA, 180 bp, Homo sapiens
aaagtttgaagtcaaaaaggtgatcgaattgcacagctcatttgcgaacggattttttatccagaaatagaaggaggttcaaggcctttggattgacacccaaagggggttcaaggggggttttggttccacttggaagagattaaaatttattgccaaggccagagaaacaaggaggca

SEQ ID NO: 4647 - DNA, 180 bp, Homo sapiens
gcattcttataagttctaaatttatgtttattataattcatatctggtagagtctcagtgttttcacatttgaaatccacttaaattgcaaatggttccttataattgaatggtgtttcctgggattcctaataaaaaatatggattgcttttttaccaaaccagatttattcacagaga

SEQ ID NO: 4648 - DNA, 145 bp, Homo sapiens
ccaagataacgagtgatgagccactcaccaaggatgacatcctgtgtttttgcggcatgctgagttgattgcaagcaacctttgttggatccaagtgcaaggctgttcctcaagcttggcctcttaaggagcctccttgatgatg

SEQ ID NO: 4649 - DNA, 116 bp, Homo sapiens
aacaagttacaaattgcaatatttgagaaggatgtaattatttatattacagatgtctatcaaggtttttcccattttacaattttaacctcatatattctcgatagggtggggaa

SEQ ID NO: 4650 - DNA, 120 bp, Homo sapiens
ctttgctgagatgaacaggggctcgaacgagttggaagacggttgtgggcggtgcatgttcttcatcggtttcaccgcgctcgttatcatgtggcaggagcactatgtgtacgggcccct

SEQ ID NO: 4651 - DNA, 190 bp, Homo sapiens
cagcaggcgcaccaggcctcgaaatgcagaacgacgccggcgagttcgtagacctgtacgtgccgcggaaatgctccgctagcaatcgcatcatcggtgccaaggaacacggattccttccagtgaaccgtggccagaggttacaaaggcacacagcagggtttattggccatttaaacttttttcgcta

SEQ ID NO: 4652 - DNA, 115 bp, Homo sapiens
ctttaaggtgataagacttagaagaggaaggccagactttctaccaatagcaatctcaaatggccaaacacaacctaaaattgcctaagttaggaagcagccccaggtggttcaa

SEQ ID NO: 4653 - DNA, 320 bp, Homo sapiens
cgagaatgagactattctcagcaatcagactgtcgacattccagaaaatgtcgacattactctgtaagggacgcacagttatcgtgaaggggccccagaggaaccctgcggagggacttcaatcacatcaatgtagagctcagccttcttggaaagaaaaaaaagaggctccggcttgacaaatggtggggtaacagaaaggacctcgctaccgctcggactatttgtagtcatgtacagaacatgatcaagggtgttacactgggcttccgttacaagttgaggtctgtgtatgctcacttcccactcaacgtgttatc

SEQ ID NO: 4654 - DNA, 320 bp, Homo sapiens
ggcgaaacgggagggagtgacccctgcgcccctcagtcccccctacgacgtcgcctccatagtctgcggagaagcggagactgcgcgcctcgcctcaaaagccgaaacgccgcgcactcggagccggcacgctcggccgggtatgtggttttttgcactgaatgtaacctagactcatctcacgggcttttgttgccccaggtactgtcaaaggcagtatttttgtgtttctgcagagttttgaccaaaatctgttccatgcaaaccaatgagggagagtatcggagaaagcagttccagatggacagaggatttgtatg

SEQ ID NO: 4655 - DNA, 191 bp, Homo sapiens
ccgagcaggaattcggtgtggacatagggccggtctgttcttgtaaaacctgaacccagaaacaacacaatccgttgacaacccaaaggacccaagtactttccaattcagtactctaggactctgaactgaatggctgacctgacctgactgtcaattaatccaaccttttaaagttggactcttttctc

SEQ ID NO: 4656 - DNA, 246 bp, Homo sapiens
caacatttcaagtgctttagagccatgcatgattagtggttaccctattgaatagggtagaagtaggatctttttcatcatcacagaaagttctatttgggcagtgctcttcttggtcatcatagggcttcagagcacttttcaaagctcatgcatgttcatcatgttggtgtcgtattttgggctggggtttttggttccccttggggtatagagaccagacccagatttgtgctcaatttcaat

SEQ ID NO: 4657 - DNA, 130 bp, Homo sapiens
gtgcctgcaatcccggctgctcaggaggtcgaggtgggagaatcacttggactcaggaagcagaggttgcagttagctgagatcgtgccactgcactccagcctgggtgacaagagcaagactctgtttc

SEQ ID NO: 4658 - DNA, 271 bp, Homo sapiens
ccggctaattttgtatttttagtagagacggggttttgccatgttgccaagcttgtctcgaactcttgacttcagatgatccatctgccttggcctcccacagtgctgggattacaggcgtgagcaaccaatgtcccggctctttctcacctttacaactttcttcttatcctcacatctgtttttcacaccttcatacctgtctctctcatgttcacacttgtctttcccatgtgcatagctgtctctctaaccattttggtgtgaaggg

SEQ ID NO: 4659 - DNA, 285 bp, Homo sapiens
agaaagagggaggtaaagacagagctttgaaaggagtttttcgagtgggagtattggcaaaaggattacttctcccaggagatagaaatgtcaaccttgtttttcttgttctcagagaaaccttcaaagacattatttaagccgtatttcagaaaacctaccccaaacagctttcttttattagcccctagagggattacataaaattgtcttttttttaagcggcaatatatttttaatttagtgtgtggcccacaaattcaagcactatctcactctcaatct

SEQ ID NO: 4660 - DNA, 305 bp, Homo sapiens
tagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagggaaatacatataaaacatatgcttacattacatgcacgcggggtttcatgctccctaatctc

SEQ ID NO: 4661 - DNA, 235 bp, Homo sapiens
ctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagagggggttttatgttttgagtcattagagtgatataataatttctctgagcttgacatctgtgatgttgatattaggatggtg

SEQ ID NO: 4662 - DNA, 304 bp, Homo sapiens
tcaggctggcacccccccactgccccagcctgcgctataccacgttcccctgatgcttgccttgtgccgggccccagaacccagggtcatggggttcacagcgcgggagtagcgtctcaatgttgtgagttctggggatgaggttcggggtatgattacagcttggaaatggctgattgccattatggctcctccttgccagaggtaaacgggtctggtcccagaacaggaggaggacatgatgatgactggagtaacgatgaagagctctcgagaaggacaggacttagagcaagatacttgg

SEQ ID NO: 4663 - DNA, 182 bp, Homo sapiens
cacctaatgcccacaaggtactctgtggatatccccttggacaaaactgtcgtcaataaggatgtcttcagagatcctgctcttaaacgcaggcccgacgggaggccaaggtcaagtttgaagagagatacaagacaggcaagagacacagtggttctttcagagaacttgcggttttagat

SEQ ID NO: 4664 - DNA, 133 bp, Homo sapiens
gcgagttcgaggaggaggctgaggaggaggtggcctagagccttcagtcactggggaaagcagggaagcagtgtgaactctttattcaattccaacctgttccgtggcctgttccaatgtgtgcaattgctgt

SEQ ID NO: 4665 - DNA, 240 bp, Homo sapiens
cggaaaatagcctttgccatcactgccattaagggtgtgggccgaagatatgctcatgtggtgttgaggaaagcagacaatgacctcaccaagagggcgggagaactcacttaggatgaggtggaacgtgtgatcaccattatgcagaattcacgccagtacaagatcccagacttgttcttttaacaaacagaaggatgtaaaggatgggaaatacagacacagtgcctcgccaataag

SEQ ID NO: 4666 - DNA, 155 bp, Homo sapiens
aggttagccttgcctatcctacatcttgcagaaatccgtcttccccccaaatggcatgcagatagaatccttctttacttttactttcattttagatctcccctttgttattatttagctagtcccttttgtcaatttaatggagatttggaaat

SEQ ID NO: 4667 - DNA, 153 bp, Homo sapiens
gcccaaccccctgctgccagtcagggcgcacaaaccccaggagagaaggcggaagcagcagcgactctaaaggcagccccaagctggctaaagcggttcctggtatggaaacctaggcccgcgcagtacccgggcccaaccgccctagattca

SEQ ID NO: 4668 - DNA, 285 bp, Homo sapiens
caaatggtgactgggcgtggtggctcatgcttgaaatcccagcactttgggaggccaaggcgggcggatcaccttaggttcggagtttgagaccagcctggacaacatggtgaaaccctttctctattaaatacaaaattagcttggcgttgtggtgcatcctgtaatcccagctactcaagaggctgaggcaggagaattgcttgaccgtgggaggcagaggttgcagtgtgccaagatcacaccactgcactccagcctgggagacagagtaagactctttct

SEQ ID NO: 4669 - DNA, 155 bp, Homo sapiens
atttagagcattcccaggccccgagggcttccgcaagaacccttcttggaacttcagagaacctaaacttttccaaccttaggtggaggatttgagattttctctgatttacacccaaacacaggctctcacacctttgacgcgcatttaaaggg

SEQ ID NO: 4670 - DNA, 322 bp, Homo sapiens
cataaacttaactctgcaatccagctaggcatgggagggcacaagggaaacatgggacccaaaggggacttcagccagagcacaaaggttctagggtacttcgagcaaatggggttgaggggtgctctctctgagctacagaaggaatgatctttgtgtgttaagataaaacacacagtccaaactctattcgagttgtccacagtcagcaatggtgatcttctttctggtcttgccatttctggagccccaagcgctccatggcctccacaatattcatgccttctttcactttgccaaacaccacatgttttccatccaa

SEQ ID NO: 4671 - DNA, 346 bp, Homo sapiens
caggaggcccagcggcccaattcttggtagaaaaagcaaagcaggaacagcggcagaaaattgtgcaggccgagggttaggcccaagcttccaagatgctttgagaagcacttagcaagagacccttgctacatcaaactctcgcaagattcgagcagacccagaaatatctccaagacgatcgccacatcacagaatcgtatctatctcacagctgacaaccttgtgctgaacccacagggtgaaagtttcaccacgggggagtgacaacctcatcaggggtaagaaattgagccttgtcaccacgagctcccccccccgaggaaggtggttcttcttctccagc

SEQ ID NO: 4672 - DNA, 114 bp, Homo sapiens
catgcttgggtttcctacttcagctacttcgtctccttccctgtctctcagcagttcccccaccaaacctttgctgcagacttcacacaactttcacacaactctctctctctc

SEQ ID NO: 4673 - DNA, 212 bp, Homo sapiens
aaagaaattcggcacgagcacaaatttgcgcgcctctcctttctgcctgctccccaagctctcggaatacaggccgaacaccaatgggtttcggagaccccgaaaagcccctgccggccctccaggtgctcaacgattacctgtgcggacaagagctacatcgaggggtatgtgtccatcacaagcagatgtgtgcagtatttgaagccgtg

SEQ ID NO: 4674 - DNA, 125 bp, Homo sapiens
ctgcacgaggaaagaggataaagggccaaaagccaaattgaactgagtggtacttagtgtttcaccattggggctaactttggcttgctaaggaggttgcaagccattgcctgcaaattcggcct

SEQ ID NO: 4675 - DNA, 210 bp, Homo sapiens
ctcgtgccgttcaaggtggaagacctgaccttcacctccccgttctgcctgcaagtgaagcggaatgactacgtgcacgccctggtggcctacttcaacatcgagttcaaacgctcccacaagaggaccggcttctccaccagccccgaagtccccgtacacgacactggaaggcagacggtgttctacatggaggacttacctaaccgt

SEQ ID NO: 4676 - DNA, 225 bp, Homo sapiens
atccctcccttaccatcaaattcaatttggccaccaattggtactgaacctacgagtacaccgactacggcggactaatcttcaactcctacatacttccccccattattcctaggacccaggcgacctgcgactcctttgacggttgacaattcgaagtaggtacttccggatttgaaggcccccaattcggtattaataattaccaatcaccaggacggcttg

SEQ ID NO: 4677 - DNA, 185 bp, Homo sapiens
cacggtctgatccggaaatatggcctcaatatgtgccgccagtgtttccgtcagtacgcgaaggatatcggtttcattaaggttggactaaattctcttcccttcagaggggttattccggggcatcttcttaattgaaaaaccattataattctttgtatattaaataaacatttgaaaaaacc

SEQ ID NO: 4678 - DNA, 180 bp, Homo sapiens
ctcgtgcgaattcggcacgaggggaaaggttttattgctatgcgggtaggtaagaacagattttacttacattcatatagttacttcaagtccagttttctgttaaacaattttccttatataatgagcccaaactagtccaagttagcttgaaccttggttttcttggagagtgaatgt

SEQ ID NO: 4679 - DNA, 366 bp, Homo sapiens
ccactatgctctaaccctgctcaggattcctgttgaggagatgctccctagcccagatggcacctcgacaccaggatgggactgcaacctcaggtctccccctacatattaattaccagtcaccaggagcccaccacctcctctaggatgcccctcaggtggggccaggccctgctcaacatctggagacacagtccaccctcagtctgcccacagagaggcttggtcggtctcactccaggagacgggagtgacccagcccggagcctctgacccagatcgtccctctccagctgaaagctagggagtttcccagagtcttctacccagcccctgtctcctgtagggataagaaagttccgtcct

SEQ ID NO: 4680 - DNA, 298 bp, Homo sapiens
gcacgagaagatgttctctccaggttgactctagagattgctgtaataatatctctcattaggcatgtactacctagactagtctcctgcacctgtgacactgccacaaaagaagataaaatgtctgtatgagcaggaagcaggagctagcaggctgctggactactcactagtcactcttgattccagaggctggtgaaaggtaggggttctcctttccattttgatattttttcaatacaaggtaatttctagatggggaatgcatcagtattagcatcttatgaaaaaaaaaaaa

SEQ ID NO: 4681 - DNA, 313 bp, Homo sapiens
gctgtcctctggaggcactacgcaagatgggactgcgccctggggtgaggcacccatttcctcgggcgatctgaggaagctcatcacagatgactttgtgagcaggagtacctggaatacaggaaggatcccaacagcaacccacctcagtattaattctctggggcctcggagccgccattagacagcaagatagggtcctagattatgccagatcagaccgagaccccggaagtgaggcctattcttggaggctttgatatcttcagcactgattgatatgccagacatccagcccaaataggccaaatat

SEQ ID NO: 4682 - DNA, 256 bp, Homo sapiens
gcagtggtcacagcagctgtactggagcaccgcgaaatcggcagggtctcgctcttgtcgtgtctgttcaaaccggcacgcctgatccggaaatatggcctcaatatgtgccgccagtgtttccgtcagtacgcgaggatatcggtttcattaagttggactaaatgctctccctcagaggatatccggggcatctactcatgaaaaccatgataattctttgtatataaataacatttgaaaaaccaaaaaaaaa

SEQ ID NO: 4683 - DNA, 240 bp, Homo sapiens
gccggcttcagctctccgcgcagaagtctcccggagccgacttctgagagtcgagtactcctatgtgaagactaccaagctcgtgttcaaggggaaccaaggcggagaggcgagatggaaagaaagtatcaaggagtgagctgaagccactgcccttgagaaccctctcgaggagtctgggctcatgaggatgccagaataagtcgcagtaaggagaaaaggacaaagataaaaaaaaaa

SEQ ID NO: 4684 - DNA, 139 bp, Homo sapiens
gtctcagttacttgggaggctgaggcaagagaattgtctgaacttgggagataaaggctccagtaagccaagattttgccactgtacaccaacctgagcaatacagtaagactcggtctcaaaaaagacaaaaaaaaaa

SEQ ID NO: 4685 - DNA, 323 bp, Homo sapiens
gagagtggtagaaaattgttccactaccacaaaagacacacagtgaccacggagcaacccaggcgctggaagactgaataatgaaaccagacccagtgttcaagaggactcacaagccttcaatcctgataatccttatcatcagcaggaaggggaaagcatgacattcgaccctagactggatcacgaggaatctgttgtatagattgtaggcggctaccacccactcccagaggatctgtcacccctggggcttatcacccatggccttatattatcaaggctccgcttcgcctacagagtcatcatgcatttggctgggg

SEQ ID NO: 4686 - DNA, 257 bp, Homo sapiens
actgtcgccttcacacaggtgaacctcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttcccactaaactgggttaaatgtacactgttgagttttctgtacacaaaaataattgaaataatacaaattttc

SEQ ID NO: 4687 - DNA, 278 bp, Homo sapiens
gaatggctgacctgacctgatgtccattcatcccacctctcacagtttggacttttctcccctctctttctaggagacctgacctgggcagactgcaaaataaaatctcggtgttctatttatttatgagtctccctgtaggacctccggtcaaggcagagcaggaaactaactggtgtgagtcaaatgcccctgagtgcttccccagcccaggccagagactccttcaggtcccggtccaggactgtgttttctcaaatggtctatctgttcaacac

SEQ ID NO: 4688 - DNA, 189 bp, Homo sapiens
gcagtcacagttgccagaagtagaggctaatgatatatcctatactgcacccactcttaatcagtggggagaccggtctagaccttttttttcatttgccattagttagtaggaaagcctggtaatatacaatcacgtaaacctagaggaaggagatttttttgccactttggttctttttccgctcca

SEQ ID NO: 4689 - DNA, 239 bp, Homo sapiens
cagatttgaactgttagcacgactgtgtccaaatagcactggtctgagattagagcgtctgcacagaggctggtatgtttgccataagagcaccgcgaaaaacttctaccgagaaggatttcttggaagctgtaaatagggtcataagtctattgccaaattacggtctactcctcggtacatgaaaatcacctgacccctgaaggctttcaagtaaaactttaaatggatccctacct

SEQ ID NO: 4690 - DNA, 235 bp, Homo sapiens
caaggtcggtggccaaaagagtgctgaatttctgctgcacatgctaaaacgcagagagtaatgctgaccttaagggtttagatgtagattctctggtcattgagcatatccagtaaccaagcacctaagatgcgccgccggacctacagagctaatggtcgggttaacccatacatgagctctccctcccacattgaggtggtccatcggaaagggaaccgtttgttcctaaccc

SEQ ID NO: 4691 - DNA, 376 bp, Homo sapiens
atacaatatgtaagctttcttaatattgaagtttctttgttttgagacagcatggtgatttttaaaattctttaattttgttcctgggatattgaaaattcaaattgaggccaaggttatttattggcttatccttaaacaaatagcaaggccagtcttttaagactaaaacagattgtgtctatttgaggcaacaagagttactattgtagggcatttaatgtagcagataaacactagaaatggtttatctaaagtttatcagctaggaggcataattttactgttcttgttgttctaggtagctctaggattagtgtacaaattctcagtagctagtctacagtattgtaatggtgttagctactctcatggt

SEQ ID NO: 4692 - DNA, 205 bp, Homo sapiens
cttaagtccatgatgagatacagcggccagtggtggctcaagcctgtagccacgacttttggagccaaggtgagatcaaggtagagtcaagcagctgcacatcgtaacctaccttctaaatcaaaattctggcatgtcgcatctttatccactcttgggctagcagagattctcacccggcgggagttcagtacaacgagtcatc

SEQ ID NO: 4693 - DNA, 218 bp, Homo sapiens
tcattggttaccagtgtgtcaggcaatctggactttccagtgatgcactgagatggcacctgtcaaaagagcagtggttccatttctagattgtggatcttcagataaattctgccattttcatttcacttcctgaaagtcagggtcggcttgtgaaaagttgttaaacaacatgctaatgtgaatgtcaaccctactctaaacttccctgtcagggc

SEQ ID NO: 4694 - DNA, 235 bp, Homo sapiens
tcgtctccgtcctccgacatcttgtctggacttcgctggcagtctcagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaaggggcggacagttatcgtgaagggccccagaggaccctgcggag

SEQ ID NO: 4695 - DNA, 185 bp, Homo sapiens
tgtttgacggacagatccggggactttcttccagcctccgaccgccctccgatttcctctccgcttgcaaccttccgggaccatcttctcggccatctcctgcttctgggacctgccagcaccgcttttgtgggtagctccttcttgccaaccaaccatgagctcccagattcgtcagaattatt

SEQ ID NO: 4696 - DNA, 203 bp, Homo sapiens
ccagactgaaggacatactcccctaacagctgggagtgctgctggctggcatttacttccagcccttatgaggagtttcccctgctgaagagccctgcctgccccagatcataccccttcctgcctgtacccttaccgctccatatggggtcaaagggctggctcctcacccacttggaaacctctgggccatccagctccag

SEQ ID NO: 4697 - DNA, 303 bp, Homo sapiens
gggaatcaaagcaaatgcattcaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacaggtttatttgcttaaaagattaccgtagggtcatacttttaaccctttttggtaca

SEQ ID NO: 4698 - DNA, 207 bp, Homo sapiens
agaagctctggcccctatggcggtggaggccaatactttgcaaaccacgaaccaggtggctatggcggtttccagcagcagcaggtagctatggcaggtggcagaagattttaattagggaacaaagcttagcaggagaggagagccagaaaagtgacaaggaagctacaggttacaacaagatttgtgaactcagccaagcacagt

SEQ ID NO: 4699 - DNA, 147 bp, Homo sapiens
caaggtactatggtcttcagatgcttaggctcgttgggtaggcctacttatccgcgactgaccgcgtccgcagcgcaccctacacttgtccgcgcatgcctttttttcgagctgctcatctctcgccctattctcacgacgataggt

SEQ ID NO: 4700 - DNA, 133 bp, Homo sapiens
cttccatgctaccattaactctggtgtgtttggcattttttacctgcacagggtttattcaattccatttttctggttgaggcctcaaagcaacaccctaaaaattaccttggggtttgagggtaagtaagag

SEQ ID NO: 4701 - DNA, 157 bp, Homo sapiens
agatatgattcatctcttctctcatatgtatacccagagtgggttgctgcatcaaatggtggttctattttaattttttaggaccgccatacttttttcataaggcctgtactaatttcattctcaccacagtcactagggtcccttttctcacaat

SEQ ID NO: 4702 - DNA, 157 bp, Homo sapiens
atgttatcgacagatgcattcattcatccgagcaatgcaataagccaaggcatttctctgtctgacaccaatatatgatagcacacacacatatcacacacacacacacacacccacaggggggggtccttcaggacatgattatgttttaaggaac

SEQ ID NO: 4703 - DNA, 130 bp, Homo sapiens
gtcaccagtgacatactcgttgtctaactggagaggtggacagaggttcggtactccgagactctgcctgagcaaaggaagcgctcctgagttactcattttagcgctggatgctcagcttctttaagat

SEQ ID NO: 4704 - DNA, 244 bp, Homo sapiens
ggcatgtaataccagaattgttactttacaatgttccttagcaaattgaatttgctttgaacttttagttatgcacagactgataataaacctctaaacctgcccagcggaggtgtgtttttttttaaatttaaatacagaaacaactggcaaaaattgaactaagatttactttttttcccatagctgggatataggctgcagctatagttgaacaggcagtctttaaaaacctgctgttaaa

SEQ ID NO: 4705 - DNA, 285 bp, Homo sapiens
gctggagatgatttgacctatagatcattctgacttacacatttgacttagcctagtctgagactctgtgcaactggccgtgattcagtataacctagaccagtcctgtttgcctcatgatatcaggtgggagctgaatgccatgaccaccaacagcaatatcagtcgccccatcgtctcctccatgggtaggaggaagtttctgccacctcccctcctgagcctgctgtcatcttcactgccctgcccatctgtcaccacctgctcctttgacccctggacttg

SEQ ID NO: 4706 - DNA, 257 bp, Homo sapiens
ctgacacctacctgcatcgggtggccagagcaggccggttttgcaccaagggcttggctatcacatttgtgtccgatgagaatgatgccaagatcctcaatgatgtgcaggatcgctttgaggtcaatattagtgagctgcctgatgagatagacatctcctcctacattgaacagcacggtagaagactcgcccattttggattgtgaccgtctgtccttcaggagaggacacagggtggggggtaaggagacact

SEQ ID NO: 4707 - DNA, 306 bp, Homo sapiens
gcagcctgaggtgatctgtgaaaatggttcgctattcacttgacccggagaaccccacgaaatcatgcaaatcaagaggttccaatcttcgtgttcactttaaggacactcgtgaaactgctcaggccatcaagggtatgcatatacgaaaagccacgaagtatctgaaagatgtcactttacagaacagtgtgtaccattccgcggttacaatggtggagttgcaggtgtcgcaggccaagcaatggggctggcacaaggtcggtggccaaaagagtctgaatttttgctgccatgcttaaaacg

SEQ ID NO: 4708 - DNA, 305 bp, Homo sapiens
gtccatctgagtgtccatcgccatcatctgccaggctgctgcatgcacctatgagcttctgggcttatacttgggggttttctctctgcctatagtatttttgttcttatcatacacttgataaagtccttaaattacagtttgaacattcagttaccatctctatgaggccatgctttgatgcatgcttagttattgcacataccgtaccatcatgctgtgccatttggtgttcatgtgtcttacagcacttggcaggtgttatagaatcaagttcatgtctcctttctcagaacttatttgag

SEQ ID NO: 4709 - DNA, 260 bp, Homo sapiens
ctaaacctgatttttgccatggattccttctggccaagaaattaaagcacatgtgatcaatataacaatataatcctaaaccttgacagttggagaaggccaatgcagaacttatgggaaaggaccaattatttataggttcccaacacaggtctaagattttttacctctgcatcagtgcatttctatttatatcaaaaggtgctaaaatgattcaatttgcattttctgatcctgtagtgctctatagagtaccacag

SEQ ID NO: 4710 - DNA, 318 bp, Homo sapiens
ctcaaatggcaacctacagaatgattacatttcatataaaattcttagaaatggcagaattatagtgatggagaactaatctgtgagtgccaagagttggggactggggagagagtgtgactataaaggagcaagaaggagcttttttgagtgatcagacagttgtgtgtcctgattaccatagtggtttcacaaatcaatatgtatgacaaaattccacaggcctgtacactccccacaatgcaaaaacatgagtcatgtaaaactgcaaactccataggtctaggttagttatgtattgtgcagtttgatatgtat

SEQ ID NO: 4711 - DNA, 330 bp, Homo sapiens
gttctacctcctgaagatcgtgaatcttatcagtttctccgtgtccaacacagaccactattgtctctcaactcaaagccttcttaatagttttttgctctcaagccttcttcacattactctcatagagttctttctaaacaggaactctctaaaacccttcaatagctttttaatgccataagttcagtttagacgcattaaaatgattcataccttactgcctcctgttcagacttgtctgttgctctctaggtctgacatgtgatttatcttccattaaacagttcttttattatttctggctcttactcataggattactaggct

SEQ ID NO: 4712 - DNA, 266 bp, Homo sapiens
gttgaagggctatattatccagggataaaattagacatttaaaatggatagctgcatatcctctgacagtcacttttgagattttttttcttaaacttttgttgagagctggctacaatttgagattctattttctgggagttcagagtggcagttattcaagtttactattctaagggcagattgtatatgcattctctgcagtacccccagtttctattattaactaccatctgactttgacttttttttttttaaaaaaaaaa

SEQ ID NO: 4713 - DNA, 282 bp, Homo sapiens
ctcgtccatttgggcgattgggaattctggccttctcatgacctctgctgatcctcctctcctctcctgctgagccttccacctctgacctctcactgttcatgccggaccctgttggatcttcctgggactccgagcaaggcctgcacgagagaaggctgaaaggctgctggggctgccacctcgctattccgcataagcatctgcccccaacccctttgaccttcatctgatggcattttatcaggaacaataaaggtttcctctcaaaaaaaaaaaaaa

SEQ ID NO: 4714 - DNA, 308 bp, Homo sapiens
gagccgccgccatgtctgcgcatctgcaatggatggtcgtgcggaactgctccagtttcctgatcaattccttccgctacaacggactgattcaccgcaaggactgttgggcgtggagcggcagccgacgcaaaaggtgtcgttgtggtaattaagcggagatccgccagccgaagcctgcaactcctatgttcggaccaccatcaacaagaattcttgggccacgttcagcagcatcagcaaatgatccgcagacaagtaccgcccgacctccgcatgcagccatccgaggcccagcgcatcctcga

SEQ ID NO: 4715 - DNA, 361 bp, Homo sapiens
ctgtgcccggcagttaggcagcagcagccgcggacagttagccgccgtgggagggagccatgaagcattacgaggtggagattcttggacgcaaagacaagggagaagctgttttttctttgacaaggtggagccccacgccaccattgcggagatcaagaacctcttcacttagacccatccgcagttgtaccccgcccgccagtcctccgcctggaccccaaggcaagtccttaaggatgaggatgttcttcagaagcttcccttggcaccacgccacactttacttccggcaccttgggcccagatcagctggtgacggtttcctacaaagtacgggggccctttcatcatcctcttt

SEQ ID NO: 4716 - DNA, 210 bp, Homo sapiens
cccaattggaccaatctatcaccctatagaagaactaatgttagtataagtaacatgaaaacattctcctccgcataagcctgcgtcagattaaaacactgaactgacaattaacagccaatatctacaatcaacccaccaggtcattattaccctcactgtcaacccaacacaggcatgctcataagggaaggttaaaaaaaaaaaaaa

SEQ ID NO: 4717 - DNA, 417 bp, Homo sapiens
ctcgtcattttcggcgagggggaattaaacccatgtggaggatgatgcaaataaaaatggtggcaagtggattattcggctgcggaagggcttggcctcccgttgctgggagaatctcattttggccatgctgggggaacagttcatggttggggaggagatcttttgggctttggtgtctttccgctttcaggaagacattatttcaatatggaataagactcccagtcaccaagcaaccacagcccgaatccgggacacattcggcgagttcttaacctacctccaacacattatggatacaaaactacacgcagcatcaaatgcaggaggctggccccaaggctcttttcaaactttgagcgcgttatttcatacctttcttttgatgcacacatgagctgctcatcgagtttt

SEQ ID NO: 4718 - DNA, 275 bp, Homo sapiens
cctgccggccccacaacctgcctgtggttcaggcggctcagcagcgagaactagaggccgtggaacaccggatccgtgaggggcaggcgggcgatggaccagaaggatcatcctgggggctggaccggaaggtgggctgaccagcaagagcacactgggagaggccgggggtggctgctttctacgtcaccaccaacccacaggagctaatgctacagatgaacccttctggaacctaatccgaaagtctgcagcaggagggccttccgggcagg

SEQ ID NO: 4719 - DNA, 251 bp, Homo sapiens
cagggattggcaaactgtggcctgaaggctaaatacagtctgttttttgcatggctgcaaactaagaatargtgtttgcaattttaaatggttgaaaaaaaatcaaaagaagaataacatctcataacacaagaaaattctatgaaattcaaatttgtgtctgtaaatacagtgttgttgagccaaagccgtcctcaatgatgtatcgtctgtggctgcctttgtgctgtaaccccaagatgcatagctgt

SEQ ID NO: 4720 - DNA, 105 bp, Homo sapiens
cttttcttctggtggtctttaggaaattatttcctctttttttgtcctggccgcatttttatgggtatctctcactgtctccactttgaccggcttaagctctag

SEQ ID NO: 4721 - DNA, 108 bp, Homo sapiens
ggcaggatggcagtcaatatcagagagagttgtcgctgaggcatctcaagctgactgatgagtctctcctcggagctggctgaaggatggctactctggagtggaggt

SEQ ID NO: 4722 - DNA, 143 bp, Homo sapiens
ctcgcctttggcggtgacagcgaagaacagatgctgggtcctcctgcacctctctctgggtagctcctctgagttatcctcacccctccacctaccattggtgtttccagctccagcctaagtgctctctcccctctaagctc

SEQ ID NO: 4723 - DNA, 130 bp, Homo sapiens
ccaaactggattagatacccactatgcttagcctaaacctcaccagttaaatcaacaaaacctcctcgccaagaaccactacggagccaacagcttaaaacctaaaaggaacctggccgggtgcttcaat

SEQ ID NO: 4724 - DNA, 133 bp, Homo sapiens
ctggccagccgagccagcccccggcacagcaccacgcactcgagggtgacggcctctccgcgcccaccgaggttggcgacacaccttcaaggcccaggcttttggagaggcaggagtagccacaggaagtaag

SEQ ID NO: 4725 - DNA, 98 bp, Homo sapiens
aaattctctgagtattctgattgtgatgatccagaccaccctgagattttgtcacctgattagtcaatatgaatgattaaaaggatgtgagaccactg

SEQ ID NO: 4726 - DNA, 132 bp, Homo sapiens
cagatgcgcacagagagcgtagacacccatcagctcagagctctgcgctgagacaccctgggtgccagtgtgtggaccgccagaggtggctcagatcacaaagcagctcccccatatgtccctctagcagcc

SEQ ID NO: 4727 - DNA, 122 bp, Homo sapiens
gctcggttgcagcacagagaagtgcaggagcctgagccagcagaggtcgcgcttaaccggcctgtgttttcagctcaagatttccagattccttgccaagcatatttttgccttaatgagag

SEQ ID NO: 4728 - DNA, 150 bp, Homo sapiens
caagttgagacctctgcagctcatgaagaatttagataggaggttggagggtgacactctcactgagactagtgtctacactcgctgcatagtgaccagcacctacggctggacagcaactatggagcagcatcatgaaagcccaggcac

SEQ ID NO: 4729 - DNA, 125 bp, Homo sapiens
agctcgagacgtgcagctggccggcatcaggactatgcaccgtatctccaaaccctgagaccaggaggaccgcgtgaggctggcctccgctccaggaggtatctctaagccacagactgtggtgg

SEQ ID NO: 4730 - DNA, 118 bp, Homo sapiens
aaaaaggcatacatcacatcacaaaaaaggatgccacacaaaaccacatccacggtcataacataaagatgaaaggtggataatccacacggatgaggcccccccccgcaccccgccg

SEQ ID NO: 4731 - DNA, 111 bp, Homo sapiens
caacatttgatattcagtgtaatccaattgcatgcattagcagcgtcaagatgaaataagagtcatatcaataggacaagaaaaagcaatttgacaaaatccaatatccat

SEQ ID NO: 4732 - DNA, 140 bp, Homo sapiens
gctggaggaggcctgcgacatggcgctggagctgaacgcctccaagcaccacatctacgagtatgtgaggtccagaatgtcattcatcgcacccaacctgtccatcattatcggggcatccacggccgccaaggtcatgg

SEQ ID NO: 4733 - DNA, 160 bp, Homo sapiens
tcagtagctgaatggaaaacattgaagacgtattccaggtatggcaagctcagttcctctgtggcttggctcttctgctcagctctcagcctcttggtctccctctcagagaggagagaagatgagagaggaggagcttagagtcagagtagtacatgga

SEQ ID NO: 4734 - DNA, 99 bp, Homo sapiens
tcatactgtacatcagacattgtcaggctctctgtcagctttcatgacatatggtatagaaccatggagttaggcacttcctggatttttttttttagg

SEQ ID NO: 4735 - DNA, 250 bp, Homo sapiens
cagactggagggagagattctgcactatgcgtccagcagcttggggcaaggtgctggagaagtctggcttcgcgtcgactgtccgcaacacagaccagacctacctgctgtgagtacagggggcagcccagcatgttcccaggcttttcctgctgacccaaacccttactggactaagccctccaggagctgaggcgccttaccatgcgtccaggggccccggctccttagcccacccgttctcaaggga

SEQ ID NO: 4736 - DNA, 286 bp, Homo sapiens
ggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatga

SEQ ID NO: 4737 - DNA, 480 bp, Homo sapiens
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattaccccgggaccattctgatcatctcactggacgcacaggggcaagagggtg

SEQ ID NO: 4738 - DNA, 393 bp, Homo sapiens
ccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccgggtcacccttaatatttattaagtgcctgagacacccggttaccttggccgtgaggacacgtggcctgcacccaggtgttgctgtcaggacaccagccttgtgcccattcttccgacccctacccactttcatttccgtgggttttcttgcactttctcagttcagagttgtacactgtgtacatttggcatttgtgttattattttgcactgttttctgtcgtgtgtgtttgggtggggtcc

SEQ ID NO: 4739 - DNA, 351 bp, Homo sapiens
agcacctctagaaagagttccagcctcccaggggaagcgctaggagaacaccttcctttgaaatgctgaagttccaatgcacttttaaaaaaatccccctagcattccctcatccacatccaccctttttatttgcaggaccagactggagacaggtcctgctgcacctcagcccaccctgaggctcatgtcctgatgccagactccagccaggcatgtagcacagtctatgtgggtctgctgaagctgtcacttcatttcctcctttctccttaacaaggaatgacttacccacggttaccacatatctatttatcagcagatcataagcccagtcttctgagatcttgt

SEQ ID NO: 4740 - DNA, 400 bp, Homo sapiens
ctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctagggtccgtgaagcccaggccaggcagccaaatcttgcctgtgctgggcatacaaccctctgctttcacatctctgagctatatcctcattagtgaaggtggctttgctttatagttggctgggagcacttaattcttccctttcaaaaggtaatgttg

SEQ ID NO: 4741 - DNA, 471 bp, Homo sapiens
  misc_feature 3: n = A,T,C or G
ctncaggtcgacactagtggatccaaagaattcggcacgagctaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttatactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggacgagaggagttgaagctggacacactatgtgactt

SEQ ID NO: 4742 - DNA, 346 bp, Homo sapiens
caaacagagatatcatttgtcagattgcttatgcccgtatagagggggatatgatagtctgcgcaggtattgcacacgaactgccaaaatatggtgtgaaggttggcctgacaaattatgctgcagcatattgtactggcctgctgctggcccgcaggcttctcaataggtttggcatggacaagatctatgaaggccaagttgaggtgacttgtgatgaatacaatgtggaagcattgatggtcagccaggtgccttcacctgctatttggatgcaggccttgccagaactaccacttgcaataaagtttttggtgcccttaagggagctttggattgaggcttt

SEQ ID NO: 4743 - DNA, 294 bp, Homo sapiens
ctcgtgccgaattcggcacgagagtgacctccccaagacccacaggaagctgctgactgatcatttctacaacttacaaaattttcagtatgttctaagttaacatgggaaagttaacttatttcatttcaacttatttttcccctttggattaagtatctggactagctaagaaacttgattggggtggggcatgggatagttttttttttttattatttaatgttagggaaataaaattaaaaggtctcaaaaaatgtgtaatcaattcagtaaaacataggtaggttcctt

SEQ ID NO: 4744 - DNA, 195 bp, Homo sapiens
ctcgtgccgctcgtgccgaattcggcacgagtgaccacctcgtcaagacccacaccagagtctccgtgcagcggactcaggctccagctgtggctacaacatagggtttttatacaagcaaaataaagtgaattaagcgtgaaaaaaaaaaaaaaaaaaacttgtttggtkcccgatttcggaaggccaaaaggg

SEQ ID NO: 4745 - DNA, 230 bp, Homo sapiens
gtgcamtgtgatcaagrattyggcacgagagggaaagggcccagctgtcagggtgcagataatcagagggcacaggcccgggcttgccagagggcagaggcttcacataatcagagggcaggggcccaggtatcaggagctgtaagtctcagctgtcccagggaccacaaggacaagcttccagagccaaggcccggaacacagttaaggaagtgtaggtctcagaccct

SEQ ID NO: 4746 - DNA, 275 bp, Homo sapiens
acgccccgctctagggacttcagcccagccccagcttctctgcccactcatttctaggtcagccgcaattcagcaggtccctcttgggggttccccacaacctctcttttggcccagaggcgcagaggaccacagtgagagtgtccacaggagggccccacagagccctgtctgtgctcctctgctctctctcttcacacctctgggtgtggggcttctccgaccaccatcttcttctctcctcatagtagtcgtcatcatgacgaccagcaaca

SEQ ID NO: 4747 - DNA, 359 bp, Homo sapiens
tcgcctgggctgcctgcctcagaagtggggacccaaagggtgcaaggacgcctggtctgccttgtgggtcctggacggagcccctacctctgcaaagatgacttgagagacaggccgtcctgtctgtcttgcttctccgccgtggtgtctcctgtatatgtctgagagagggacccagtgtatctgtggagaccatgcagatagcgagagaagaggcgagttaagatgcaaaacagaagattttcatgcaggaatcagatgcctcgaatttcctcacgaggcgcggcaagcggtcccccaagtcccgagatgaggtcaatgtggaaaacaggcagaagcttcgggttgatgagctgcgg

SEQ ID NO: 4748 - DNA, 265 bp, Homo sapiens
agacgctcgtcaccaggacccaaggacccaaaattgcatctgatggtctcaaggggtcgtgtgttttgaagtgaagtcttgcctgatttgcagattgatgaggttgcatttggaaattcaaggctgataactgaggatgtctcagggtaaaactctccctgctctactctcccatgggctatgatatcttccccctgtgcacaaatgtgtgttcctatgggacaaaaatatgcggcagacagtgtttaggcgctcacgtttgatg

SEQ ID NO: 4749 - DNA, 230 bp, Homo sapiens
ttaccaaaattggctgtttacagtgcatttagttcctgatatttataaagatgacatttcacagaattacctttaaaattaggtttgaaattcctatatagtttaggacatcgttcacacctggagcacaaattaaatgtgtccatatattttttatgtgtagcgcgctctacacacagtgtacctattgcacagagtatatctgattaattgtgtaatagataggttgt

SEQ ID NO: 4750 - DNA, 180 bp, Homo sapiens
gtcaaggttgcaatgagctctgatcctgccactgcactccagtctcggtgacagcaacctgagaccctgtctcaaggagaaaaaaaaaaaggccttgcaacggtggcttaatcccttcattccaaccatttgggaaggcttgaggtggacccgtcacattgggcccccgggagtttagag

SEQ ID NO: 4751 - DNA, 120 bp, Homo sapiens
ctgctttcctgtggaagaggcctcagcacctgccactttgccggcctcccagctgggaggctggagcctcggccttaggagcccctcttccagacctaactgggccccttcggtgcccaa

SEQ ID NO: 4752 - DNA, 315 bp, Homo sapiens
gttatcaataagctcctagtccagacgccatgggtcatttcacagaggaggacaaggctactatcacaagcctgtggggcaaggtgaatgtggagatgctggaggagaaaccctgggaaggctcctggttgtctacccatggacccagaggttctttgacagctttggcaacctgtcctctgcctctgccatcatgggcaaccccaaagtcaaggcacatggcaggagggtgctgtacttccttgggggatggccataaagcacctcgatgatctcaagggcacctttgtcccagctgaagtgtactgcactgtg

SEQ ID NO: 4753 - DNA, 236 bp, Homo sapiens
ctcgtgccgaattcggcacgaggtcacagaagacctcacgtcttcccattcatttgacattgcacccattggacatagggaggggccgcagcaggaattcggtgttggacatagggccggtctgcttcttgtaaaaacctgaacccagaaacaacacaatccgttgcaaacccaaaggacccagtgacttttcaatctcagtcactctaggactctgcactgaatggctgactgac

SEQ ID NO: 4754 - DNA, 263 bp, Homo sapiens
ctcgtgccgaattcggcacgagggtaacaagaaataccgtgccctgaggttggacgtggggaatttctcctggggctcagaggcttgtactcgtaaaacaaggatcatcgatgttgtctacaatgcatctaataacgagctggttcgtaccaagaccctcgtgaagaatttcatcgtgctcatcgacagcacaccgtaccgacagttgtacgagtcccactattcgcttcccttggccgcaagaagggagccaagctctcttc

SEQ ID NO: 4755 - DNA, 184 bp, Homo sapiens
aagttttgtaccatttattttatgacattttacaatgtaagttttgaaactaactgttggtaggagaaagtttcttatggaacgaataccctgctcaacatttaatcaatctttgtgcctcaacatacttgttgatgtcttagtatgcctcagttgggtgaggaaattcccatttgaggtgttc

SEQ ID NO: 4756 - DNA, 225 bp, Homo sapiens
gtggggcaaggtgaatgtggaagatgctggaggagaaaccctgggaaggctcctcggttgtctacccctggacccacaggttcttttgacagctttggcaacctgttctctgcttttgcatcatgggcaacccccaaggtcaaggcacattggcaagagggtcttgacttctttgggggattccattaagaccttgattattttaagggcaccttttcccaactt

SEQ ID NO: 4757 - DNA, 170 bp, Homo sapiens
cacagttcaaaagacccctttcgtcacccaccctgggtatgacactgggaatggtattcagcttcctggcacttctggtcagcaacccagtgtttgggcaacaaatgatctttgagggacatggttttagggcggacccaaaccgccacaacggccaaccccattaggca

SEQ ID NO: 4758 - DNA, 200 bp, Homo sapiens
ggttcctgaaaggatgtacagaggatccccaaccgcctgcgaaacccaagccgccgcgtaggagcatgcgttcgggccctcttcttccacctgttcgactccccatccccaggatgtcaacctcagtccctcaaggccatacctcgacccaccgggtgaggaaggacggtgaggaggagggcccccttggaccagcttga

SEQ ID NO: 4759 - DNA, 258 bp, Homo sapiens
tcgtgtgagcacaccatatatttacagtaggaatagacgtagacacacgagcatatttcacctccgctaccataatcatcgctatccccaccggcgtcaaagtatttagctgactcgccacactccacggaggcaatatgaaatgatctgctgcagtgctctgagccctaggattcatctttcttttcaccgtaggggcctgtcctggcattgtattagcgaactcatctctagagcataggtactatacgggacagt

SEQ ID NO: 4760 - DNA, 343 bp, Homo sapiens
tagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctgtgagtttttgtgaaaaccaaaaacaactaacaagaaaccaagtatctttgagcaaacagaatgtaggcgtttcaaatcgagctgagaagggatgctgaacagaagatttaagagcacaagactttagacacagcaagggaaaattggagagaaagccacattatatgtaaaaatgctataggagact

SEQ ID NO: 4761 - DNA, 260 bp, Homo sapiens
gcaaaatgtcatcatatgcattttttgtgcaaacttgtcgggaggagcataagaagaagcacccagatgcttcagtcaacttctcagagttttctaagaagttctcagagaggtggaagaccatgtcttctaaagagaaaggaaaattttaagatattgcaaaagcggacaaggccccttatgaaagagaaatgtaaaacctatatctctcccaaaggggagacaaaaaaagaaggtctaagggtccccatgtacccaga

SEQ ID NO: 4762 - DNA, 157 bp, Homo sapiens
aacagctcctgctccttggaggtggtgggaacttctttttcttttgtacctacttcaacccccatacagttacattaggcctttcttccttaagtgtcttggcagtaaggactctgactctatattcaggagcccctataagtatgagacatataag

SEQ ID NO: 4763 - DNA, 141 bp, Homo sapiens
ctcgtgccgaattcggcacgagtgcttacttttcaccctctcttcaactgccttttgcttcttaaggcttttcttttcgacctcttttctctttaaaacccttctctcacagagtgtgagagccatatctctccggcgtct

SEQ ID NO: 4764 - DNA, 160 bp, Homo sapiens
gcacagtgcggcacaacggacttcaacgcactgtaattcaccaagtgcgggacacaacttcttcagcacacaacccttgttgttccgttccgcaaaaggacacacttgggcacacacacggtgtaaggcacactctccccagtgttgtcacaggcgccct

SEQ ID NO: 4765 - DNA, 118 bp, Homo sapiens
acgtgacgcggggccaggcggccgtacagcagctgcaggcggagggccttgagcccgcgctttcaaccactggacaacgacggttcttcaggggattcccggccttggcgaattttct

SEQ ID NO: 4766 - DNA, 105 bp, Homo sapiens
ctcgtgccgaattcggcacgaggacttctgcagtgtgtggctatccctacaagggccacccaagggatgcccaaaggccaaccttcttcagggcttcgaggccaa

SEQ ID NO: 4767 - DNA, 180 bp, Homo sapiens
gaacaatggaccccaagtcatgtcagtgtggcccctgctaccctcaccatcttgcaccagcagacagaggcagttcttggagagtgttgggtgcgttttctctctcctcctggcgcgtgtggcagagaatgtccacacgcgttttcatttatatatatgctcgtgccggcccagactctc

SEQ ID NO: 4768 - DNA, 205 bp, Homo sapiens
gtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccacacgcgagcggagttcttagatcatagttccactc

SEQ ID NO: 4769 - DNA, 215 bp, Homo sapiens
aaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaaaaaaaaaacctcgagagtacttttagagcggccgcggcccatcgattttccacccgggtggg

SEQ ID NO: 4770 - DNA, 299 bp, Homo sapiens
cctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtgtgatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccctttcacgt

SEQ ID NO: 4771 - DNA, 301 bp, Homo sapiens
  misc_feature 41, 91, 93: n = A,T,C or G
cggcacgaggtgaaaatacccttaagtgatgacattccacnctgtgatttatttctgcaccatcttgactgatcaatgtgctttgtaatcnancccacccttcagaaggctctttgtaatcctccccacccttgagaatggacttggtgagatccaccccctgcctgcaaagcattgcccctaactccaccgcctgtcccaaaagctacaagaactaatgataatcccaccatactttgctgactctctattcacactcagcccgcctgcacccaggtgaaattaacagcctcgttgctca

SEQ ID NO: 4772 - DNA, 300 bp, Homo sapiens
ccaggccctgccagctatggcagaaatggccgagacggtgagcgaggccccccaggggtggccaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacacatccaaagctggggcaaagatgattaccttcagcaatgattacaatgtaatta

SEQ ID NO: 4773 - DNA, 302 bp, Homo sapiens
gaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctcctt

SEQ ID NO: 4774 - DNA, 300 bp, Homo sapiens
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaacctgaacccagaaacaacacaatccgttgcaaacccaaaggacccaagtactttccaatctcagtcactctaggactctgcactgaatggctgacctgacctgatgtccattcatcccaccctctcacagttcggacttttct

SEQ ID NO: 4775 - DNA, 301 bp, Homo sapiens
ctcgtgcccctcgtgccgatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaaggagggccctgctcctccagggctccaacgagatcgagatccgcgccgagggcaacagccgcttcact

SEQ ID NO: 4776 - DNA, 365 bp, Homo sapiens
gatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggagttatttcatttactttaaggtaggagttactgtgtaatttattaattcatgagttctcataacatttcagcataagtgtagcaaagttgctaataacgggaggggatcatagtggtgttgaatgtaactctgaagtagggaatggccttttaagtctgagagagacatttgaatc

SEQ ID NO: 4777 - DNA, 260 bp, Homo sapiens
gtcttgttgacaaggattcccaagaaatggatcttttcactggctgactctcccatatctgcaagagattctgcaggaacttggtgttacacaaggtgttgtaggcagttcaggtacttaatatttaggatttgtgtgaagttcactgtattgctataattttgtagataaatataaactcacatataattgtgtaatcacatctctctttcgctgtatagagattgctctatatacactctctctctcacagacacatt

SEQ ID NO: 4778 - DNA, 150 bp, Homo sapiens
gacagagtgagactcttgtctcaaaaaaaaaaaaaagtaaaaatcctagtttccctccttaccagctgccctaattattggggaaagcttagctattttgactcttgagtagcatcctcttacgggcactgcacaaaaggttatgggcag

SEQ ID NO: 4779 - DNA, 149 bp, Homo sapiens
ctcagtaggaaactaacccaagacctaaatgttttcttttctagagaataaaaaagttaagtacatgtttccctctgtgtagctaacatccttcatatttttacactatggtatttctttagggcttgaagggtatccatatacacatt

SEQ ID NO: 4780 - DNA, 125 bp, Homo sapiens
tttcttcctcctctcccttttctttttgacccctccctcacctccctcttctgccatgtaactggaggatgtgctatgagtttgcaaacagcttggctgtcaggctgctttttttccagatggtt

SEQ ID NO: 4781 - DNA, 215 bp, Homo sapiens
ctcgtgccgaattcggcacgagaacagactcagagatgtttgtgactcctgaatttcacatagatagcaagttgcagagtcagaatttagggtgtaattcacctgattccaataactcctgtgctttcgggataacagcctttccattcacaggttctggagcaacttgggcaggagcaccttgggttgggagatgtgtgttaaacacacaccta

SEQ ID NO: 4782 - DNA, 270 bp, Homo sapiens
cagatcagaagttcggattgagttgtctgtttgtttctggctaagattaagacaagacattcaatcacagaaatatacttgtgcaccaaccatttttgcacatgcaagtttgataaggatggatagaaccaacgtgcattacaggaccattagggatccgtgcttttggggagatcacatggcaaatgtttgaaatcatagggtatatgtggttggctaagtggaacagggctgtctgttccattctcactctctttctattagattctt

SEQ ID NO: 4783 - DNA, 355 bp, Homo sapiens
ccttctaccctaaggaagattctacaatcctctactcagtgttgaagattcttcctcttctgtccaccccatcttgggggagcagatggtcctatgcaattcacacagttaattccgccgaagaggcagtccctaccagcgttgatcccactgctctaagcgacccctctcatactggatctactgttagacatgacagatccaccacccattcccaaaggacacagagataggactcagtgtctggcccttagatcaataccagtatgatcagctctgcctcatgtttgcctctacactacctgtgagctggctccagtctccacctacatgggcccctccgtaggtgtcacct

SEQ ID NO: 4784 - DNA, 300 bp, Homo sapiens
agaaggccctgctcatccagggctccaatgacgtggagatccgggcagagggcaatagcaggttcacggacacttcccttgaaggatggcctcacgaaccatacccggtaagtggggcaaagacttttatcgagtacccggtaaaggaggaccctaggcctcccattatttgaattgcacccatgacataggaggccccaccaggactttcgctctgacataggcccggtctcttctataaaccctacccagaatctcaattcgttaacccaaggcccaagatcttcgttgaggtactga

SEQ ID NO: 4785 - DNA, 280 bp, Homo sapiens
gtttgctctgtacccatgtgtacagcctacccatgcagggacttggattcgaggacttccaggcgcatagggtagggccaaatgatagggtaggggcatgttttctttagggccttgtaaggctgtttccctttgcaactgggacttacctatatattggcttcaaatagggcttaattcaatttggctatataggggcccagagagagttttaacctctatatttggggtatagttgggaaaaaaaatctgatctccattggatatgtaatattgcact

SEQ ID NO: 4786 - DNA, 273 bp, Homo sapiens
tcttggttcatcttcaaaatcagagactgagctttgaaactagtggtttttaatcaaaggttggctttataggggggggtataattgtatgcactacctgttttaaaaggaattaggtgtaaggtctgtttttcgtatgaatcaggccccattcatggaaggcctaaggctttgggaaataattgtccccatagagcctgcgcaaaatggtatagagatgagatcacagttgtaaatagaaaactctattacaatactctctgtatcaccccc

SEQ ID NO: 4787 - DNA, 335 bp, Homo sapiens
gtgtgcacgtcagacggcacaagggggtgaggaagtttgagtgcaccgagtgtggctacaagtttacccgaccaggcccacctgccggaggacattggggatccacgaccgggtaggggaccttcaaccccccggcagcaaaggttccgaaacctgatcatcgaggccgagaagatggtggtggtggcttacagccccttacagagctgagaggtggtctcgcggaggacaatttggagtccttcgcccagggcggcctcgtcttcccagctccccgacagagactttttgcagagagagcttcaccggcccaggtctctggagccgccatatca

SEQ ID NO: 4788 - DNA, 275 bp, Homo sapiens
ccagaatttgaaggaatatgagtttccaaatcaaaaagacccagcaagttaccagcacaattgggtgtaaatagaccacggaaaggcaaaacacttgaaattcaggattacttaggccaaggaggattatttggacctcaaaggggtaagggcaggcaaccaaccaccaagacgcgattggcgacatataggtttaaggatttaaatggctggagacttctcaatacaccactagactctagatatgacgcaacacctccgaactcctcaaagaa

SEQ ID NO: 4789 - DNA, 235 bp, Homo sapiens
cctggcaagcccatgtgtgttgagagcttctcagactatccaccttttggtcgctttgctgttcgtgatatgagacaaacaagttgccggttggtgtcatcaaagcagtgtgacaaggaggctcttgggcttgcaaggtcaaccaaggtttcccagagaagctctaagaggttaaatggtatattaccccaaatccctccaaccccactttaatcgatggtggaaagcacggtct

SEQ ID NO: 4790 - DNA, 315 bp, Homo sapiens
gtgatgtctcacagaaagttctccgctcccagacatgggtccctcggcttcctgcctcggaagcgcacagcaggcatcgttgggaaggtgaagagcttccctaaggatgacccgtccaagccggtcaacttaaaagccttccttgggtacaaggcttggattgattacaatggtcgcggaatgtggacagcccggctcccagggtacacagaaggaggttgtagagctgtcccaatttgagagacacccccatggtgtttgtgggcattgtggtctacgtgaacccctggagtcttccgcacttaagactttttt

SEQ ID NO: 4791 - DNA, 250 bp, Homo sapiens
aaaaccttgcttcctatccacctgatccagtctgaaggtctcttagcaactggagatacaaagcaaggagctggtgagcccagcgttgacgtcaagcaggctatgcccttccgtggttaattcttcccmgggcttccaggtcggtccccactgcccgcccttcaaaagggcgcccgggattccagcccaggttttatctgccctggggaatgtcccccgcaaatcttcagaataatcccagggtctgggg

SEQ ID NO: 4792 - DNA, 156 bp, Homo sapiens
atgcaagtccagagtggatgtgtataggccgctatggctctcgaaatgtgagaattgaatagcagcacgcagtcactgctcttctgtgcaaaccagatgaggaacgggctgtgggtctcgcactgtggtcctgcatgaagcagtagctggggtcct

SEQ ID NO: 4793 - DNA, 335 bp, Homo sapiens
aaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccaaggagatgggacccttgtgccaccttggccagcaaagaggaggggtcagagaacagctgaaatactgtcactagtggtagtgacttgcttttcctgtgcacaaatgtagcccatcaggacagccagccgacgggtcacgccaggggccggcacgacttgcacctggcccaggagc

SEQ ID NO: 4794 - DNA, 323 bp, Homo sapiens
gttctcccaaggtctatgctaaattatagcaagagccctgggcaaccccaaacctagtcctggtagctgagcaccctgtaaggcaggagcaggcagctcagcttgagcagacattgggtggggggtgggggtggtttagggggaggcagcacagtgcagcaaatgtttcttgggagggaggaggctgatccatcaccatctgcttgactatgtagcttggattctcctttgtacctatccctttcgattgggctttacctcatctatctggatcctttctggccaaatatctctggcccaaatgaacattgtacatgatctct

SEQ ID NO: 4795 - DNA, 257 bp, Homo sapiens
ggcaaaagtggatgagtttccgctttgtggccacatggtgtcagatgaatatgaagcagctgtcctctgaagccctggaggctgcccgaatttgtgccaataagtacatggtaaaaagttgtggcaaagatggcttccatatccgggtgcggctccaccccttccacgtaatccgcatcaacaagatgttgtcctgtgctggggctgaaaggctccaaacaggcatgcgaggtgcctttggaaagccccagggcact

SEQ ID NO: 4796 - DNA, 319 bp, Homo sapiens
aagtacttagatttgccacttttttgatgcttgctacatcagagagacctgacctgtaataggtaaggagtaaaaattaaaatttgcaaatatatttctctcctattattcatacatttttgttctcccccaacccccagaactttatgaaatcttcctctcaggagcaaaggacggtggacagtttcagtgaacaggttcagagactgatacagagggtgtgatttctttttttaaataggatttgaggatgacaattcagatactgggcatgtatcagagctgtggtatcgcttacatatatcatcttatttaatct

SEQ ID NO: 4797 - DNA, 332 bp, Homo sapiens
gcaactttgaaaatgtctgtacagccaacggtttcccttggggctttgaaataacaccaccagtggtcttaaggttgaagtgtggttcagggccagtgcatattagtggacagcacttagtagctgtggaggagagatgcagagtcagaagatgaagaggaggaggatgtgaaactcttaagtatatctggaaagcggtctgcccctggaggtggtagcaaggttccacagaaaaaggtaaaacttgctgctgatgaagatgatgacgatgatgatgagaggatgatgatgaagatgatgatgatgatgattttgatgatgaggagctgagg

SEQ ID NO: 4798 - DNA, 262 bp, Homo sapiens
cttctacaaccacactcatggccgggaaatgctggacatctttgtgcaccagctgctggttttggtcgtctttctgacaggcctcgttgccttcctagagttccttgttcggaccaatgtacttctggagctattgcggtcaagtctcattctgcttcaggggagctggttctctcagatgagatttgtcctgtatcccccagtggaggtctccatggcatctgatggatcatgaaaatattttgtttcctcacatatgctt

SEQ ID NO: 4799 - DNA, 246 bp, Homo sapiens
gtcaaggacacatctctacatccgagaggttatctcctaatctgctaaggttgatttgagataaaagctccaattcctatcttttgggactttacgttagaattttcagaatccttgtctctggcccttgatccattcaactagggctactcctctttccagctctagacaaaatttcttctgtaagaatcaccccctcacacctatccctcccctctattgctaatggagtcactgggagttatc

SEQ ID NO: 4800 - DNA, 364 bp, Homo sapiens
ataacaatgcagctccatgtgatccttgcaccttcaagagaaatgccttgcttgccagctgggttctctggccaccctccagcccaccttgctgcttcttggatggaggttcgtgaagctgctctcgcctatccaaatggcagtaacattaacattcattcagtcaggcaacatccatggagtgctattcatgccatgctgcccatgtggaggcagcaaagcgttcagtaaaggctgggcactgcatgagacacaggttgagtccagctcttgctactgctgtctgagctgctgaactcgtagctcactacctcagctgcaaatgggatgataataagacctctaatggctcactgacagacaa

SEQ ID NO: 4801 - DNA, 274 bp, Homo sapiens
aaagctccacgactctgtttccccgtcccttctgaatttatttgcactaagtcatttgcactggttggagttgtggagacggcctgaggtctcagtacgagtgtccgtgagtgtgagcacctctggcaaggtgcctgttgcagggcccggccgccctccatctggccgggtgactggcgccgctgtgtgccgaggcctcaccctgccctggcctaggtcttggagctcgaccgacatacgagcagccttcagcattccattacgcccatctggt

SEQ ID NO: 4802 - DNA, 330 bp, Homo sapiens
gacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagactccctaagagttctcataataaatcatctcatcacaaatcaatacggtatacagagttaaagtggattgaggtaagagatacagctacagaatatagttgcgtttatggga

SEQ ID NO: 4803 - DNA, 360 bp, Homo sapiens
ttcaattgcatatagcttggtttccataacatagagcattggttgactgtttacagaagactcactcaccaggataaacattgctgtatgttacagtaaagctatctggagagacacataaatgattttggcataccattagagagaccatttgtaaaactcaaatgaccacataaagcttatcaaggagtctagattggttttgttttataccatatgggatgaggaaatagaaatgtcagtagaactcattgagggttctctgccacctcctgaaaatagaagttcgctctctcagatttggtttgaagctggacaatttgcttgttgataggataagcttttctaagtcctcatctc

SEQ ID NO: 4804 - DNA, 300 bp, Homo sapiens
ctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtaagagttccgaagctgcagccgaggccaccaagattattggagcttgagccggagagccattt

SEQ ID NO: 4805 - DNA, 260 bp, Homo sapiens
gaaacatttaaaataaaatctcttactaaaattgaatattgtcatttgagataaatcctagctaccagtaaattcacttgaggaattgctggatattttgccgtgctatacctttgatttctatgtatttaaaccaaatttttagagattggctcttaagttttcctctgtgatttgtgaaggtgctcaccagatattttgagaagacgcacacatatacattctactgtgccatactagtagcgtactactactatact

SEQ ID NO: 4806 - DNA, 256 bp, Homo sapiens
ctcgtccttcggaggcgttcagctgcttcaagatgaagctgaacatctccttcccagccactggctgcccagaaactcattgaagtggacgatgaacgcaaacttcgtactttctatgagaagcgtatggccacagaagttgctgctgacgctctgggtgaagaatggaagggttatgtggtccgaatcagtggtggcaccacaaacaggtttccccatgaaggcagggtgttcttcacccatcgccgtctccgct

SEQ ID NO: 4807 - DNA, 288 bp, Homo sapiens
tgggaattaccaaggattttaaagtgggtggatcctgcagaagaaggctagagatgatcctttaaagatattttactgttaattgaaaacgtttttatttaatgtttgctttcacaattttggtgaacttttgctgagcattacttggcttctgatgcatcctgtgtttcagaccagcatcgtgaatacttgaaatcaaaattgtgatggacaggcagggtgatagtaaccttggagagaaagatttcaacatttctcaggatattccttcccgtccttcctttcttt

SEQ ID NO: 4808 - DNA, 317 bp, Homo sapiens
gactaaggtgactgtgcaacaggtccctgcagcactgccggcctggcgcagagggtgaacctggtgccatgggacccagggaagacccggtccccgggacacgttgggccaccagggcctccagcagccaggaccagctggatctctgcagtgggtctaaaggagacccaggagccaccggagaaaggggccttccagccttcccagccagccccgcccccctgacaccctgcccccaggcgaccttgtacggatggtcagctgcaagaggacccctgaaagcaggaatctatgacctctgcccaaggtgatcagga

SEQ ID NO: 4809 - DNA, 276 bp, Homo sapiens
gttgcccaggctggtctcaggctcctgggctcagatggtcctcctgcctcagcttccaaaggcacaggccaagttgtagctttgtcccttgccatcatgcccaacaagaggttctatacctcttaatgaattgactttcataaattggttatgttggtgggcaagttctttaagctggaaattgtaaattcctcctgaaatgttttttcatgcagttaccatgaactaatactacaataaaggatggtcttgggtgtcaaaaaaaaaaaaaaaaaa

SEQ ID NO: 4810 - DNA, 379 bp, Homo sapiens
gccaaagtgagagtccagcggtcttccagcgcttgggccacggcggcggccctgggagcagaggtggagcgaccccattacgctaaagatgaaaggctggggttggctggccctgcttctgggggccctgctgggaacgcctggtctcggaggagcaggatctccactgtggagcatgcagggctctggtggatgaactagaatgggaaattgcccaggtggaccccaagaagaccattcagatgggatctttccggatcaatccagatggcagccagtcaagtggtggaggtactactactgctccccaaacaagtagctactctgctttgatgaatcgactctaaaaggacctggtttatagaataagaacagctag

SEQ ID NO: 4811 - DNA, 328 bp, Homo sapiens
ctcaaaagggtgaatctaagagttattggccttaaaaaagaagttaaaaaagagctggggtagaaagtttattcaaaggaataataacagagaacttcccaaacctagggaaagatatcaatattcaagtacaagaaggttatagaacaccacggagatataacccaaagcacacctgaacataccagtcacacgtaagaggatcacagctgtaataaaaaaagtctctcagcaaagaaacccttaggacctgatggcttcttctgaattttgcaacatttaaggaagactatagcaatcctactcaactatctgacaatagagtatt

SEQ ID NO: 4812 - DNA, 340 bp, Homo sapiens
cggcttcctagtgagtcggcggctgatttagaaggaggttcaggctacggtgagccgaagtggggttggtgaaagcgtgtggggcccgttcctaggggcccagctcccttttgccccaagagatccagctcctcgcctttcctggggcttccgcctttatttctggtttctcctgcagtgtagcctccatccttctttgctgccgctaaagccttgtttttcttagaggtgtggggacttcaaggcgctcaaagaccatcttgggaagccgtgcctatttccagatagacaaactgctccattcgcgtcctgtttctctcaagcggacacagtactatat

SEQ ID NO: 4813 - DNA, 312 bp, Homo sapiens
tcaacatggacgatcgggttactgcgtgtgcagaacattctcaaaatttggcttacctgaattgacaaggtggaggagcggcgggaggctacaatggacttctatgacatcgtgctggagaaggacgagactctggatgtggtcaacgggctactgcagcacaacctgtcccagggggtccagctggagatgcaaggcccctaaaggcgcagctccagccggccttcagcttgggttaggagggcgcctcccagagtcttctccccgtaacaaggacagaggcaagtgcagcagtgctggtcttccggccct

SEQ ID NO: 4814 - DNA, 260 bp, Homo sapiens
gaagaaattataatccagtccctgtaatttttcatatacagtgtttctcatccaataaaagttacagttcatgctaagtgacagaacagaatgacagaaagccaagagaaaaatagataataaaaacaaactcatgggtgattcagagattagagttatcagagtagagtttttaaactgttactgacatttaagaaatagtggaaaaggtatggaaatagatgaaagagaataattttaccagagaattgcagtttgta

SEQ ID NO: 4815 - DNA, 165 bp, Homo sapiens
ctcagagagaaccaccataggtctgtctcctgccgacacgaccaacgtcaggccgcctggggtaaggtcggcgcgcaccgtggcgaggtatggtccggaggcccttgagaggatgtacctgatcttcccaccaccaagacctactttccgacttcgacctagcca

SEQ ID NO: 4816 - DNA, 173 bp, Homo sapiens
tgataggaacaggtcagtgagcagtggaattaccttttaaggtatttgaacacgttggacaagcccacactcaaacctaatgtgtactggagaaagtataacatgaccctgcattcatacacatatgcatgtgtagatgctaaataaatgcatgtgtagtaactcacatgcca

SEQ ID NO: 4817 - DNA, 344 bp, Homo sapiens
gggacgcaaccaaaccatatcagctgggattaattactgcccactggagggaggtacccagttggaagtaactgaataatgagggcaggtctttcccgtgctgttctcatgacagtaagtgtcatgagatctgatggttattttaagggggacttttcctgcaaaagctctcctctcatctgccaccaagtgagatgtgcctttcaccttctcccatgattgtgaggcctccccagccacatggaactgtagtcaattaaacctctctttcataaattgcccagtattggggtatttattagagtgtgcaaatggactaatacactggctaagtccatgcctac

SEQ ID NO: 4818 - DNA, 286 bp, Homo sapiens
ccacccactcctgctcagtacctggcgttggtacacaggcaaggattggcacaaccaaaattggccttttttctccctcttaatattgaagaaattcccacatttctcatttggtaatggtgttgtggcctcagatttcttctagtatttgcttctgatgaatgattatggtctatacataaaaagtaagactaagtattgctgaatttgcagttattgtgtcgtgtatagagctacttccagttggtacaaatgaacccatggatgatgacttcatgttcttctc

SEQ ID NO: 4819 - DNA, 193 bp, Homo sapiens
cttccatatatctttcattaacttacttgctgccttttttttttcttggtacacatttaaataaagtaatccttaacctgtgctgtaaagttcacccttggcatgctgttccagaacctgggtttgaatcccaatcgttgtgaacatactcagtattgataaaaccttttaataggtatgcaggcagccaagg

SEQ ID NO: 4820 - DNA, 251 bp, Homo sapiens
tttaagaataatatgtaacctaagtacaacacccagcatttaagtatgtagaaagtaatcttattctctggggcacaaattgagttattaaatgcagtacattgttttaacagcacacattctggttattactttgtattgcatcattaattaattacattgctgtttaccttgtttaattagatttgacatatgttactgtgtaggtgatcctaagccatcattctaaaacaaattagtggagccctatg

SEQ ID NO: 4821 - DNA, 319 bp, Homo sapiens
gaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctcctcctgccgactcctgggttgagctgttgcctcagtcccccaacagatgcttttctgtctctgcctcctcaccctgagccccttccttgctctgcacccccatatggtcatagcccagatcagctcctaacccttatcaccagctgcctcttctgtgg

SEQ ID NO: 4822 - DNA, 307 bp, Homo sapiens
cacaagtacagaccagagacaaagcaagagaagaggcagagactgttggcccgggcgagaagaaggctgctgcaaaggggacgtcccaacgaagagaccacctgtccttcgagcaggagttaacaccgtcaccaccttgtgaggaacagaaagctcagctggtggtgattgcacacgacgtgatcccatcgagctggttgtcttcttgcctgccctgtgtcgtaaaatggggggtccttactgcattatcaagggaaaggcaaggcttggacgtctagtcacaggacgacctgcaccactgtcgctc

SEQ ID NO: 4823 - DNA, 275 bp, Homo sapiens
gtggtgccagacccctgcagcaggccaggttgggatgaggacgaggacgaggaggacacggccccagagtccgcacttgacaaattccttgacaagttccttcttcgaggatgccggtaaccacttcctggggtcggcacacattcccaagggccccgggcccggccttaaaaggggacccggaagaccaaggaggaaggctcccttcagagacacaggagggcgtcatcagcccaggccccaggcacaatatagagaccacacacacagatact

SEQ ID NO: 4824 - DNA, 164 bp, Homo sapiens
agaggagctgtgttataatcctttcagtgctgctgaatatactgataatggaaaataaacaggggtgcacttggtttcttgggcctgtaaaccaaaaaccagatttcagtgtgccaaagctgtgtttttgctttgcaagggccaaggaatgttttctttcagag

SEQ ID NO: 4825 - DNA, 125 bp, Homo sapiens
ctgtgcgaattcggcacgaggcgagtttttcacttccttcaaaaaaggaaactgaggcagtcatcaaattccagccagttcccaagaacaacaagggacccgtcaagtcgtggtggaaagagcct

SEQ ID NO: 4826 - DNA, 250 bp, Homo sapiens
gcacacaggctctcaactgtggtcaatgctgaccagatcctcgtcatcaaggatggctgcatcgtgtgagagggggacggcacgaaggctctctttgtgcccgaggtgggggtgtatgctgacatgtgggcagctgcagcagggacagagaggagaacctctgtaagacactcaggcctcagaaccattggaacgcgttacaaaaggtgttggccactttcctctcaaagactatacccgagggggatta

SEQ ID NO: 4827 - DNA, 285 bp, Homo sapiens
caacagcaaaaccccattataaagtgatagtggtgtgagattgagctcaaagaggtactgaatatgtgatttgcatgaattgaggtttagactctcatgacacctactgttattgcattgctgcctgtccttcaactcactcttctgacctcataggggaggttccccctgacttgggaggaaaaaaattcaggcctggtgtacatatgattctgtggtgatatgctgacacagataggagggatttggtgcatattttggcccacctcggaggtgtctggagtg

SEQ ID NO: 4828 - DNA, 318 bp, Homo sapiens
ccccttcttacccgcaaaagacaagtctttacagaatcaaatgcaattttaaatcttagagctcgctttgagtgacttggttttgtgattgcctcttaagcctatgtatgccatggaggcactaacaaactctgaggttttccgaaatcagaaagcgaaaaaatcagtgaataaaccatcatcttgccactaccccctcctcgaagccacagcaggggtttcagggttccactcagacctctttggcaaggtgacatttccatgcataaatgcgatccacagaaggtgctcgtggtatttgtaactttttgcaaggca

SEQ ID NO: 4829 - DNA, 104 bp, Homo sapiens
ctgacctgatgtccattcattccaccctctcacaggtcggacttttcttccctttttttctaagagaccggaactgggcagagcttgcaaaataaaatctcggt

SEQ ID NO: 4830 - DNA, 310 bp, Homo sapiens
cacgtccggctaatttttgtattttcagtagagacggggttttgctatgttgggcaggctgggctcaaacttctgacctcaagtggattcacctgcctctgggctttccaaagtgtttaggataaacagagtgtttagcccaccttgcccccgctctaagattttttcttaattgcaatataatatctcaaacaaattttttctaatgagaaaagaatttttgtgtatcccctgaaagtgtttcatcatttaaaagagcgttgcagcagatatgattactttgacgacgaaggcggctaatactactaag

SEQ ID NO: 4831 - DNA, 315 bp, Homo sapiens
gccagtttgaatataatgtagaaggagtgacttccaaggaaatggctacccaacttgccttcatgcggcttctggccaactatggctttcagaacatcaccctaccactgtcaagaacagacattgcatacaagggtgtggggggacttggccacctctaaaaaggctttttattcttacaggggctctctatttatgtttaaactctttttctcgggggcaaccacagcggtttactatacactacttttttgttgggggggggcccttctctaaggccacagatgtggggggggaaaaatagtctgtagtact

SEQ ID NO: 4832 - DNA, 286 bp, Homo sapiens
aagagatcgacttcctaagaagcagcaagcaagtgcttccactgatgggtgtcgataagctttcttgggaagagcagagttttacttcttttgaagttagaaaagttgctgaaactaaagaaaaagagcaagcatctctaaaaccaaaacatgtaaaaaagtacaggatggcttatctctatattttcagagaaaatttctcaaagagagagcacagcgctgaaaacttctctaggagaataaaaaagcagcagcaacaaaggggcgctctaggagaaaaagagac

SEQ ID NO: 4833 - DNA, 286 bp, Homo sapiens; identical to SEQ ID NO: 4832

SEQ ID NO: 4834 - DNA, 190 bp, Homo sapiens
gctggtcttattttaggtgtaagcccatcttgctggcaaggctaagattagaacagctcataggagagtcatgattttgaatcacccagataaaggttgatctccctacggagcagcccaaataaattaagaaaaagacttcctaggacaacccccaaacattgatgcttaaggagcacactcaaaggga

SEQ ID NO: 4835 - DNA, 325 bp, Homo sapiens
accttatatttgcagagcactttgcactttgtcagacatgaccaggcttgtgttttttcatccagcccgcaaatgcttgtccagtacctactgtgtgccaggtggtagaaaagtaaacacggttaggttgatgtcttgaaggagcctacaggctgggggaaacatataaaacaaataagtataagagatggtgagtcagagatatgtgatagactcgggcttaaaggaggggtgttttgttataccacgggatatcaggggagggctttttagaggaggaggcatatagggggcacatataaacactatttttgggagactctct

SEQ ID NO: 4836 - DNA, 311 bp, Homo sapiens
atccatctttgacgcctggcagaaggggcagcgtcaccaaaccttgcagacaggctctctctggggcacaggttcttccgggtggcaggaggacaggcctggcctagcacattgtttgtcacgctgtgtactgttgcccaaaaggagagtgcttgtctgtacagacgtgtgaggcccggattgtgtgtgctcgaggccaggaagaggaagggagctgctgcacctgcttgggtgacaaacagtgatgaatagcacctcacagcaattaggatgactgtcatcaaagacacagaaaatagcaagtgtgagcc

SEQ ID NO: 4837 - DNA, 306 bp, Homo sapiens
ctcgtgccccttcagcacaggtgagcgcaagagccggccacatggggaccgtaagtcctgtgagatgggcctgcagctccgccagactttcgaggcagccatcctcacacagctgcacccacgctgccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagc

SEQ ID NO: 4838 - DNA, 306 bp, Homo sapiens
cttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggtcctg

SEQ ID NO: 4839 - DNA, 301 bp, Homo sapiens
gaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtatttggagcataaaatgtatgctgttgtgaccaataatataaaatatggtaattggatttaacttcacaccatagtatgcattgttatacatactgtgtacctaattatgtatagcagtgtaggctcaattatatct

SEQ ID NO: 4840 - DNA, 303 bp, Homo sapiens
gcggctggctctcgttttccggataacgactacagctccgactgtcagtgccggccttcctcgtgtgaggggatctgccggacccctgcaaattcaatttctttcccattccgggcccttccctatcgtcgccccttcaccttggcatcatgttcaagaaatttgatgaaaaagaaaatgtgtccaactgcatccagttgaaaacttcagttattaggggtattaagaatcaattgatagagcaatttccaggtattgaaccatggcttaatcaaatcatgcctaagaaagatcctgtcaaaa

SEQ ID NO: 4841 - DNA, 302 bp, Homo sapiens
gtttctccatgttggccaggctggtctcaaactcctgacctcgtgatacgcccgcctcagcctcccaaagtggctggggattacaggcgcgacaacccatggcccggccagtggtcctttcttatacacgtacatacatggatgatgggcttgagtgcagctggcagggcagtggggcttaatgagaggggatctttgtaaagacagctcttcacttcagctcagtagctttggtcataggcaagtttgttttccattatcataatttgatgattctagtgatgaattcaatgctagttctt

SEQ ID NO: 4842 - DNA, 303 bp, Homo sapiens
tttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgacttggcgccggctgtgtgcccgaggcctcaccctgccctcgcctagtctggaagctccgaccgacatcacggagcagccttcaagcattccattacgccccatctcgctctgtg

SEQ ID NO: 4843 - DNA, 299 bp, Homo sapiens
ccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtgactgccccagcccaggccagaagacctccttcaggtg

SEQ ID NO: 4844 - DNA, 297 bp, Homo sapiens
tctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagacttttgcccaagacagtgaaagtaattataaaaacaagctttgaccacttaccaagtatctgaagagatgagttcatactatgatttagaaagtggttcaa

SEQ ID NO: 4845 - DNA, 292 bp, Homo sapiens
cctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttc

SEQ ID NO: 4846 - DNA, 295 bp, Homo sapiens
agagaaggctcacgatggtggccgctactaccgggctgatgatgccaatgtggttcgtgaccgtgacctcgaggtggacaccaccctcaagagcctgagccagcagatcgagaacatccggagcccagaggcagccgcaagaaccccgcccgcacctgccgtgacctcaagatgtgccactctgacttgaagagtggagagtacttgattgaccccaaccaaggctgcaacctggatgccatcaaagtcttctgcaacatggagactgtgtgagacctgcgtgtaccccactcag

SEQ ID NO: 4847 - DNA, 290 bp, Homo sapiens
ggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggacttgacttagctccctaggtgccacagtcagatgccggacacaggatttatatataaatatatatatatggg

SEQ ID NO: 4848 - DNA, 245 bp, Homo sapiens
aatggcggtggggggggatggtgctgtatgagacagacgtagttcctgccctaagagacatacagttgagcagggtgctcatgtcacccccaccagccagagggaccagccagaggaaaagagagttgggttaggtcgtaccaggggtttgtgcctcctcttgataccttggagcccacggggtgaggttttttttttagattgattgggagggcttcagccttggccttggcttcccttgggtg

SEQ ID NO: 4849 - DNA, 285 bp, Homo sapiens
ggaccttggcctgagatgtgatctgtctagctatgatacaacactgcttcacagataaagtaccagcttcaggaattggaaggttattgatttttcttggataacatgggtacatttcagtcatatttgaattttaatttagttggattctcacttatttgtaaagctaaccggtttgtattggaaatattataaatattctggggagtctcaaatggtggatttaatactagcttttaggtaatttaggataaattaccatttaatcctataaccatctctcta

SEQ ID NO: 4850 - DNA, 295 bp, Homo sapiens
cggaggtggcagccatctccttctcggcatcatggccgccctcagaccccttgtgaagcccaagatcgtcaaaaagagaaccaagaagttcatccggcaccagtcagaccgcatatgtcaaaattaagcgtaactggcggagacccagaggcattgacaacagggttcgtggaggattcaaggggccagacctgaatgcccaccattggtaatggaggcaccacaaaaccacaggcacatgtctgcccagtggcttccggaggtccctggcccacaccgtacaggggcgctggga

SEQ ID NO: 4851 - DNA, 285 bp, Homo sapiens
agtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagacgagcagcatttcggttgaagggctttgattcccatttgcgggcaggtgcttggacggtgtcccgagacccaccgggagggcggcgcattgcctttaaccccacctgtcaggttttggccggttttctcctaggttg

SEQ ID NO: 4852 - DNA, 150 bp, Homo sapiens
accacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatccg

SEQ ID NO: 4853 - DNA, 297 bp, Homo sapiens
agaaatcatggaagaaaggtatacaagtacttgcctttactcctgcatgtagaagactcttatgagcgagataatgcagagaaggcctttcatataaatttatacagctctgagctgttcttcttctagggtgccttttcattaagaggtttggacagaagggtaaagctattaggattgaaagagtcatctatactggtaaagaaggcaaaagttctcagggatgtcctattgctaagtgggtggttcgcagaagcagcagtgaagagaagctactctgttttgtgcgggaggagc

SEQ ID NO: 4854 - DNA, 190 bp, Homo sapiens
gcacgaggttttcaagagctgaattgagaaggaaagagactggagtggttaatggtgatttgatttctggcattctgagttttctgctacaattagctgcattacttggtgccaaagagcagttgggaattgttgagttgctgtatcctttaaaaaaaaaaaaaaaaactcggggggkacttytdgggsg

SEQ ID NO: 4855 - DNA, 263 bp, Homo sapiens
cggcacgagctgtactggagccacccgcgaaaattcggccaggggtctcgctcttgtcgtgtctgttcaaaccggcacggtctgatccggaaatatggcctcaatatgtgccgccagtgtttccgtcagtacgcgaaggatatcggtttcattaagttggactaaatgctcttccctcagaggattatccggggcatctactcaatgaaaaaccatgataattctttgtatataaaataaacatttgataaaaaaaaaaaagg

SEQ ID NO: 4856 - DNA, 349 bp, Homo sapiens
ctcgtgccgaattcggcacgagaccaagccctgaggtttcattaagcccctctaaggcagaacttgtcctcccagccccaggagccttcttctcagtcttttcagccgtccagctcttactttctcttgggtttctgaatcttatcttgctcatgcatagtcaggaattatttaaggattttagcagagttgtatgcatactttgaagctacccactctgtgggtctgtcttttcaggaatttttctcctcatatatctagctgctgtgacagctccagatacctctgactcctcagtatctcaggactttcgctttctgctttcacactctttctcttctgtctgcac

SEQ ID NO: 4857 - DNA, 230 bp, Homo sapiens
ggaaatttgcccatctgcatggcaaagacccacctttctctatctcaccaacctgacaaaaaaggtgtgccaagggacttcatcttacctatcagtgacggtccggccagcataggcgctggggtcatttacccttttgtcggaacgattagcaccattccaaggcttcccaaccgggccttcttttattacatagagatttgataacccgaacagagacacagtgtata

SEQ ID NO: 4858 - DNA, 225 bp, Homo sapiens
gagaagtcccccctgcgggtgaagaacttcgggatctagctgcgctatgacttccggagcggcaaccacaacatgtacccggaataccgggacctgaaccaacggcaggcgctgtcaaccagtcttaccgagacaagggtgcccgccacccggcccgagcccattccattgagatcatatgggtggggagatatacgggccagacgataccgccggccgtctgtt

SEQ ID NO: 4859 - DNA, 138 bp, Homo sapiens
tgtcctctgccagcctacaggaggaaaagcaaggcttacagaaggatgttccttcaaggagggaggcagcactaaaaggcactctgaggtcaaggattgaagtggggaaacccactcaattaaaccacatttttggat

SEQ ID NO: 4860 - DNA, 238 bp, Homo sapiens
tgtagatttggtcttttcacacagtcacatatttcttagaggctttgtttatttctttttactcttttttctctaaacttctcttcttgcttcaattcattcatttgatcttcaatcactgatactctttccttccacttgatcgaatcagctacttgatgcttgtgcatgcatcatgggtgttcttgtgccatggttttcagctccacagggaatttagggcttctctacgctgtta

SEQ ID NO: 4861 - DNA, 258 bp, Homo sapiens
cctcaattgacctccacctccaaggagcaggagaaagtctgtgatgcttgatgtctttccattctcaggcaacaggagtcttgactcttcccacatatcttacccgcatgaaattggtgaaaactatcaagtccacactcaaaaaaaatcataggacatgtttcctggcccacagtccttctcctcacatatttatcacaaggctgattttcacagtagggttctgcatattatggggtgcaaatgccaaccctgtcg

SEQ ID NO: 4862 - DNA, 295 bp, Homo sapiens
ggagtcttgttggggacatgagacttacttgggacaagagtagaaaacaacaggttaaagtggcaaaatgtacattgtggattttcagtgctgttatcagtttagaggaaattattttgggccaaaaattttagtgatgtctccaggagaagcaggattttatttgggtttttaagagtgggatttggaaaattcaggagaggacattcccaggtgttggaatggcataagcaaaagagtgagtgtgtgtccaatgtgtgtgtatgcaggggtgcttgtcgtctgtgtatttagc

SEQ ID NO: 4863 - DNA, 262 bp, Homo sapiens
tcccagaggccctttgtgaactcaggaggctaatgaaatgcacgagaatgttattaaaatacgttcgcacacgttttgagagtcttgccttagatggattgctgcttcagtgccctccttgcctcactttttgcctttcgctctgtaaagctgccttgaggacctcctgctcgaggggcacacatccttgtgtcacccttattccaagggctgggcacagtgcatcattttgctcttgtctctctttatgggtcagggcttt

SEQ ID NO: 4864 - DNA, 260 bp, Homo sapiens
ctggaagcacccctgccccctttttcagggatttttatctcgaggcctttggaggagcagtggtgggggttagctgtaacctccaggtatgattaagggaggatttgggtagaaactctccagacccatgcctccaatggcaggtatgctgcctttcccacctagagaggggaccctgtccatgtgacagcctcatcagagcctcaccctgggaggatgccgtggcgtctcctcccaggagccagatcagtgcgagtgtg

SEQ ID NO: 4865 - DNA, 220 bp, Homo sapiens
ctgaattatgaggacactatttgagagttagtggccagaaaacgatgaaatcttatagatcttttgacagttctctgtttaggggagcctagactgatatcaagttctccatatcaagcttcattggtgacctcatttgctttacaggtgaccagccatcttgcaggcttacatgcttctgagagcctcactgagaggatgctgctggagtcacagctga

SEQ ID NO: 4866 - DNA, 190 bp, Homo sapiens
ggagcgcggctgcgcgcgcgcgtcgagggggagaggcagcagccgcgatggacgtgtttcctcatgatccggcgccacaggaccaccatttttaagggacgccaaggagtccagcacggtttttcgacctgaggcgcatcgtcgagggcatccttaagcggcctcctgacgagcagcgccttatacaagg

SEQ ID NO: 4867 - DNA, 212 bp, Homo sapiens
gtcactcagcataatgagcatttaacatacagaggcaatgtactgttttgtgttgatctatgtaaaagaatacaattcttttttacataattagtgaaattttattttttattgggaaccactaaatggtgtaatattccttttgcttttaaaaaaattcctggtggcaaatcaagttaaataattgctccaattctctcgcgcaatcactg

SEQ ID NO: 4868 - DNA, 240 bp, Homo sapiens
cacctcgctgctccagcctctgggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcacccagatcggtgccaagttctgggaggtgatcagtgatgaacatggcatcgcccacaccggacacctaccacg

SEQ ID NO: 4869 - DNA, 165 bp, Homo sapiens
aagaccttcgggtcaaggcagaggcaggaaactaactggtgtgagtcaaatgccccctgagtgactgcccccagcccaggccagaagacctcccttcaggtgccgggcgcaggaactgtgtgtgtcctacacattggtgctattctgtgtcaaacacctctgtat

SEQ ID NO: 4870 - DNA, 140 bp, Homo sapiens
cctctaggcaggagaagaggcgattggcggcgattggcatctctcgggcgccctggcgttgcttccttgctgtccagccttttcccggttgttaacccggaggccttccttggggcccaagattaaccctttccttactt

SEQ ID NO: 4871 - DNA, 135 bp, Homo sapiens
ggggacctctaactccacacatactacacccggggggttggtggggccacccctcttggtctggtgttagggacagaggaaaactctgtgtgcctccttggttgtaacagacctggatcctctgcataccccagc

SEQ ID NO: 4872 - DNA, 137 bp, Homo sapiens
atctcaacgttcgagtaaactggaggactgtggctattcctgaaccttctttgagacagaatcctcagaatctcacacttataaccttcctaaccttttaacttgaatgctttgccatattacaggcacagagcact

SEQ ID NO: 4873 - DNA, 255 bp, Homo sapiens
cctgtgtattggtgacttggaggtgctaacctaggaagaattggtttgatcaccaacagagagaggcaccctggatcctttgacgtggttaacgtgaaaaatgccaatggcaacagcttttccacttgactttccaacatttttgttattggcaagggcaacaaaccatgggtttcccttccccgagggaaggggttctcccttaccctttcctagagagagacacagagtttcgcgccaaccagcagcagtggc

SEQ ID NO: 4874 - DNA, 239 bp, Homo sapiens
aaattatgttattttttacaactaattttgtactctcagaatgtttgtcatatgcttcttgcaatgcatattttttaatctcaaacggttcaattaaaccatttttcaggatttaaggggattacttcaaattcagtattcaggaaaccttcaggatttaggtaaaagggtggttggactgggcacaggtctttatacctctgtcactgtacaggtactcattaagaggatattgattg

SEQ ID NO: 4875 - DNA, 277 bp, Homo sapiens
cagctctgagctcccttctgctccccagggccaccggcttggcctttaggacagagataaacctagcccgggaggttgggaaaggcaaaggttgaggccaagttcaagggaccgcggggccaagcaagttttcccttacttccagcttccttgggagttaaggggccgttcccttccttacacccgaggcttggagggcgcgcgcacagacaggacagcctgtctctctagccctggagtgtcttggagaccaactcaggcgcttagtccacgcaat

SEQ ID NO: 4876 - DNA, 132 bp, Homo sapiens
agaagacctcccttcaggtgccgggcgcaggaactgtgtgtgtcctacacaatggtgctattctgtgtcaaacacctctgtattttttaaaacatcaattgatattaaaaatgaaaggattattgggaaggt

SEQ ID NO: 4877 - DNA, 288 bp, Homo sapiens
attaaaaacccaaaggaacctgagggaagtgttgcagcacccaagatcagatgcagtggttttcagatgcctgacttttcttaatctaatcaggaaaccctccagccttatgttaattctttccacaaaaggctcctaaggctttaattctgttcctggctctgcactagatatatcttccttgggtgatttgaattacacctcaaatgatttaattcacaggttagggacagcgtgatttatcatcatctgctggcctcccagagctcagctagactaggctgctgt

SEQ ID NO: 4878 - DNA, 188 bp, Homo sapiens
tgaaagactgagaatttaccactcatggacccttgttaaaataatttttaacagttggcttcaccaggaggaaatttagtccagagggttggtgaaagatgcaaggaggcaatgtgaggcggtaaacctgttgcttgggtcagtagggctatgctttcaaaacctattttggaaaggctttccattag

SEQ ID NO: 4879 - DNA, 282 bp, Homo sapiens
gcgggtccgacggtcacacctacttccagatctgccgcctgcaggaggcggcccgcgctcggcccgatgccaacctcactgtggcacacccggggccctgcgaatcggggccccagatcgtgtcacatccatatgacaattgggatgtgacaaggcaggatgttatctattggctgttaaggtgtttgccacccaatggcctcatgagtggagaaggatgcttggacatcagctccagggtatgaccccacatctctgtgcagtttaggggttagacccaga

SEQ ID NO: 4880 - DNA, 138 bp, Homo sapiens
gttttgtggaccactttggttttcttttttgcgtgtggcagttttaagttattagtttttaaaatcagtactttttaatggaaacaacttgaccaaaaatttgtcacagaattttgagaacccattaaaaaagttaaa

SEQ ID NO: 4881 - DNA, 180 bp, Homo sapiens
cggctttcatgtcccagagacctgttgtgctgtgtattttgattttctgtgtatgcaaatgtgtgtatttaccattgtgtagggggctgtgtcttatctttgggttcaaaacagagactgtattttttgcctttaaaattaaatatatataaacgggaatataatgagccctatctgtgt

SEQ ID NO: 4882 - DNA, 145 bp, Homo sapiens
ccggtcaacctgaggcttgtggtgccggccacccagtgcggcttcctgatttggaaaggcgggtgtaaggttaaagagattcccgagagtacgggggcgcaaaggtccagttgccggggatatttctctgccaactctcacccca

SEQ ID NO: 4883 - DNA, 130 bp, Homo sapiens
actgtatgcagtcaatgtataaattcagacatagtgcacaatgccagaagttggactagtaatctttaaattatgctaggaaattgttttggaacacaatttccagagaccctatgtcttttggattttt

SEQ ID NO: 4884 - DNA, 112 bp, Homo sapiens
gccagtacaatccccaggcgttttctgtgttcagaagtagtaagaatgcctttaattcaaaggattatctaagctctttaaagctgtttttcttccctgtcataggcccctc

SEQ ID NO: 4885 - DNA, 125 bp, Homo sapiens
cctaagcaagaggaagtgcccctctcaaccttttcgggcttcttcgtcccaggacttagacggagggcaaccccggcccctaggccttaaggcttctttcttattcaaataaatgtttcttaatt

SEQ ID NO: 4886 - DNA, 130 bp, Homo sapiens
cgtgccctcaggaagaggtccaacggtttccctgagcctttgggtctccaggttacccaggcccctcagccatttgcagaaaatgccgagacgggtagcgaggccccccaagggggtgcaagaaattcct

SEQ ID NO: 4887 - DNA, 280 bp, Homo sapiens
aatactatttgttatagatcataatatgcataaaactgtacagaaatattttgtaatgtgttgattttaaaaaaaggatctgtaaataaagttttaaaaaaagagtttaaattgcacacgctgaaatatgtaggtatttttgctatttatttaaaggagtattttagggatattgaactatctgacattgacagtaatcaaaggtccaatcatctgaatgcttttcctcgaggagatgtgagctcagaactgactgcattacgggccttttttgcacctc

SEQ ID NO: 4888 - DNA, 142 bp, Homo sapiens
acggggcgcccccagagatggccagcaatcggaagttagcaaacttcgcaagtcttcagccccgcggcaccattctgcaggcttcttctgtaccacgggacggtttcatcaggttccatacccgaaaatctctcgggttcca

SEQ ID NO: 4889 - DNA, 280 bp, Homo sapiens
gcatcttcagtattcgcaaatgacgacaaaagggaagagagagcaccgagatagtctctaggcctttagaaacatagagttgttcctttggcacatatatgcgatctataaggaggggatattgtagacatcaaggggatgggtactcttcaaaaagggatgtcccacagtgtttaccatggcacaactcgtagagtactacaatagtgatcccagcatactgcttcgcgatgttgtaaacacacacgatgatgaggagagactcgtcacgagaagtaat

SEQ ID NO: 4890 - DNA, 215 bp, Homo sapiens
gacaagtgacgcgtatgatggagcagctcagacggcacctggcacacatcttcaggcaatccggccaaggagctgttcaaccgaggatgttggaagaggtcacactacccgaagcctgtagagaacacagagtttccagagggcacacccttagaagggcgcggagagtggtgtttcgcttttcttcagtgctatagcgtcttcgagacatacac

SEQ ID NO: 4891 - DNA, 255 bp, Homo sapiens
atgatttctaaccctagcatcatgacatgtatatagtgtgttgtaaggcatttgccagctaatagttaccagtactgaaggcttgtgattacggttaattgaggaaacttttaagcaggttcaaaagttataccccttatagagtggacatcttaattgtatatatatggctcttccctttttatattgtatcacagggatattaaaatgtgtatatatgacacatatccctgagtttataagcatattataatg

SEQ ID NO: 4892 - DNA, 250 bp, Homo sapiens
ggtaagtggggcaagactgttatcgagtaccggtcacagaagacctcacggcttcccatcattgacattgcacccatggacataggagggcccgagcaggaattcggtgttgacatagggccggtcttcttcttgtaaaaacctgaacccagagacaacacaatccgttgcaaacccaaaggacccaagtactcttcaatctcagtcactctaggactctgcactgaatggctgacctcaactcatgtcc

SEQ ID NO: 4893 - DNA, 295 bp, Homo sapiens
gccggcttggcccgctgcaggcctcaggcaggcggggccatggttggtccctgcggtgggacccgatcttggcctgcctcttagaagccctgagctaccttggggtcttgggttggtttcttggaaagtgtctttcccagaactttcccttgctctctctgtctcgtgagtgtgtgtccacagagggcaccccagactgagagccctcaccgcggaaggagggagagccccgtaggcacgtgtccactcttaatcagagggacagagctctctaatataactgctcgcagtgcac

SEQ ID NO: 4894 - DNA, 155 bp, Homo sapiens
ggaaactaactggtgtgagtcaaatgccccctgagtgacttcccccagcccaggccagaagaccttccttcaaggtcccggcgcaagaacttttttttttctacacaattgtgctattctttgtcaaacacactctcttatttttttataaacaa

SEQ ID NO: 4895 - DNA, 116 bp, Homo sapiens
tgacccttctgcaggagagggcaaataagttggtgaaataactgatgattaaggactacaaggagattcccatcaagcgcgcagacattcttaaggatgtcatcagagaatattat

SEQ ID NO: 4896 - DNA, 108 bp, Homo sapiens
ctgagctggacctcatcagccgcctttccagagaacatggggcttttgcatgccgtgaagtgcactcacttggacagcaagggggcaagggagcccttagcccttgct

SEQ ID NO: 4897 - DNA, 292 bp, Homo sapiens
gcgggatgaggctggccccctcctctgctttagccccggcaagcctcccgtggagctgtaggagctggagatggcatttcgtttggtgctcgagctcgtccaggatgtcttggatgtgttgktatatctctatttctcgagctctctggcgtgtgagagtctcgtctctcagagagccccgggcctctggcacacaagaggagagagggcctccatatgtgcccccagaggcccacaaatacagagccgtgcatatccccgtgagctctggggaccgctcttctgatcatca

SEQ ID NO: 4898 - DNA, 268 bp, Homo sapiens
taagtgctgtttgggctaacaggatctcctcttgcagtctgcagcccaggacgctgattccagcagcgccttaccgcgcagccgaagrttcactatggtgaaaatcggcttcaatacccctaccggcgtgcaaaaggaggaggcgcgcgcaagacgtgtgagagcccttctcgagcgcgcacggtcagagactcagatactgaccgcgcaaggagctctcgcgtgtgtcacacagggagaaaagagaggctcctctctggagatgtat

SEQ ID NO: 4899 - DNA, 245 bp, Homo sapiens
ctcgtgccgaattcggcacgagcagaagtgtcatctctctctgagcacgcattcccctgcagcagtcgaggaatgagcagattgagttatgcttgggcagagaggccttggaggaaaggttttcagccagtcgtttgtaaggcgctcgtcggcaccctctgaaacgcgccccacctctacagaccccatatctcacagactgtgctctaaatactctacagcacgagtctcaggatatttagggg

SEQ ID NO: 4900 - DNA, 230 bp, Homo sapiens
cttgaccttatctaactaccagaccaacaaagccaagcatgatgagctgacctatttctgatcctgactttggacaaggcccttcagccagaagacttacaaagtcaatcttcgtctaccagagcgtgcacttgtgtatcctaaaatataggttcactctctccgggctgtgtcccctcttgggttgggagggggcacggtatctctcagagtctctctttgtcacatat

SEQ ID NO: 4901 - DNA, 275 bp, Homo sapiens
cctggaagagggactccaatgggcatgccccctccgggaaatgcggcctcctccccctgggatggcgaggccttctttgacccttggccacagagtatgggagtagcttcccagaggcgttggctcgatttctcaaggccacgttaacacagagactcttttgtttacttatagctcgtttgttcgtggagtctcatatggattgtctctgtgttcccctacacaggtccccttccccccggggatgcgcgccccaacaaggcctagagtcatat

SEQ ID NO: 4902 - DNA, 210 bp, Homo sapiens
ctccaggggaagcctggtcagatgggaaattcaggcaaaccgggccaacaggggcctccaggagagggtgggaccccgaggacccccgggggctttcttgcaggtagaggagaattagggccagttgggttcccagggcttccagggtaacttgggtcttctgggatggcctttggcttccttggcttctttggcccctttagtgtccta

SEQ ID NO: 4903 - DNA, 290 bp, Homo sapiens
ggcagccatcaggtaagccaagatgggtgcatacaagtacatccaggagctatggagaaagaggcagtctgatgtcatgcgctttcttctgagggtccgctgctggcagtaccgccagctctctgctctccacagggctccccgccccacccggcctgataaagcgcgccgactgggctacacggccaagcaaggttacgttatatataggattcgtgttcgccgtggtggccgaaaacgcccagttcctaagggtgcacttacggcaggctgtccatcatggtgttacc

SEQ ID NO: 4904 - DNA, 292 bp, Homo sapiens
ccaagatttgccacttgcatcttctgaagttgtggcctgagccacacatggacctgcttgagccatggtgggaagcagtgaaagagctctctgctggaatgcaggaagcagagatgtgaggtcggtctgggcagggagcctgtgtaggttgctcctagcccaacccctcaaactattctgccctctgagagctctggggcctgtgatgagcagggcagcctcaaagatctctgaaatgctttcagggtctatctccattgtattgatggtggctctcttctgtctgtgttaa

SEQ ID NO: 4905 - DNA, 288 bp, Homo sapiens
gcttgatggtgtgtacaaactcacctgaatgggacttttttagacagatcttcatgacctgttcccaccccagttcatcatcatctcttttacaccaaaaggtctgcagggtgtggtactgtttcttttgtgccattttggggtggagaggttggatgtgatgaagccattaattcaggacttattcctccttgtgttgtgttttttttggcccttgcaccagagtatgaaatagcttccaggagctccagctataagctgggaagtgtctgtgtgattgtaatcaca

SEQ ID NO: 4906 - DNA, 208 bp, Homo sapiens
ctggccgagagtccaggccttgctcccccgaccgccatggagggggcagcccggcacagctgctgggagcccttgtgtgtctggtcacactttttaggcgtcacgccaaaggccagcctcctggccccaatacccattttggaggcccctgtggccgtgtggatgtcggtaacagttgtataaaataaattctatttatcgctattgt

SEQ ID NO: 4907 - DNA, 292 bp, Homo sapiens
tctctcttcatgttgactttctctaccagcccaggccaggagagtccggtggagtccttcatagcctttctactaattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctcttcttg

SEQ ID NO: 4908 - DNA, 240 bp, Homo sapiens
gaaatcctgaagtcaaagtcaaaggatttgatcctgtgataaatcagattattgataaactgaagcatgttgttcagttgttacagggtggatcacccaaacctgacagtgggaactccttcagctgggcagtggtggaggcatggttgaacacgtcagtggggactgtgatgatgaagatggttgcgggggatcaggaagtggagaagtcagaggacactcaagttcacagactggatg

SEQ ID NO: 4909 - DNA, 250 bp, Homo sapiens
gtcatttaatgaaacccctctttttccttgaaccaaaagagaccttgtttttcctttgaggaaggcagggagttccacttttaattttttatggaccatctcacaccactttccacctaaccctacgtactgttaatatggggctggcctgtcaagtctgggcaagattagtgataggatgctatcaggtcagaccccatgattgttagagtagctgaaagattcaggagttcttattttgaactctggc

SEQ ID NO: 4910 - DNA, 282 bp, Homo sapiens
ctgtgacaagatggcatcagatatcgaagatcatatctaccacgagctcacgagcacggacatgaagtaccggaaccgcgtgcgcagcgcataagcaacctcaaggaccccaggaaccccggcctgcggcggaacgtctctcagtggggccatctccgcaggtcttatagccaagatgacggcagaggaaatggccagtaatgacttagggagttgaggatgcatgacccaggaggcatccgtgagcacagatggccaaggcttgcgcaacacactgaactc

SEQ ID NO: 4911 - DNA, 209 bp, Homo sapiens
tccctcttctgccatgtaactgggaggatgtgctatgagtttgcaaacagctggactgtcaggctgctttttttccagatgttcctcctctgcctcccctttcccttctctcccctccttttccttccttccttcctttccttggtgcactgagcaccatttggaagcttgtagagaaaccaaaattaaagagagagagagagagcgtg

SEQ ID NO: 4912 - DNA, 246 bp, Homo sapiens
agagcaggatttctctgcctcttccaaacttttcctccctgaacctgagggaaactaatctggattcactccctctggttgatacccactcaaaaagggacacttctgattaagacggttgaaactagagatggacaggttatcaacgaaacttctcagcatcacgatgaccctgaataaaaattgcacacactcagtgcagcaatatattaccgcaaggataaaagagagattcatatcttaaaa

SEQ ID NO: 4913 - DNA, 147 bp, Homo sapiens
ctcgtgcgaattcggcacgaggagtcaagacctccatgcccacctcttaaaattatcttgaaaaacaaatgagctgatgtatgtgacagcagattttcagcagtaaggcgctgtactggtataggttgtaatgaatttttgaatacc

SEQ ID NO: 4914 - DNA, 185 bp, Homo sapiens
cctggacctaacagacctaattttccaatgggtcctgggtacagatggtcccatgggtggattaggagggattgagttcacattcacatggaattggctctttagggctcaggagatattggacagtatttccaagaaattctccccaataatatgagcctcagtaaatcaacccgggcactcca

SEQ ID NO: 4915 - DNA, 121 bp, Homo sapiens
aaactaaagagcttctgcacagcaaaagaaactaccatcagagtgaacaggcaacctacagaatgggagaaaattttttgcaacctactaatcttacaaagggctaatatcccagaatctt

SEQ ID NO: 4916 - DNA, 161 bp, Homo sapiens
catctatgtgggcccacttgtgtgtctttgctcttgtggctttcaaatccttggtccaactgtgagctttcctcttctgtgaaggtttccacttcctaaagtcaccccgcatttcccgacttttaaatcacagtgaccccaaatttttactctttttgcaa

SEQ ID NO: 4917 - DNA, 168 bp, Homo sapiens
ctgaggctagtgctgcattggacttcttctaacaaaaattgaaagcaaacattgaaaggatcaaatttgatttaaaataatttatttgtgtgctagaacaaagtcccagggtcctttaagataatacagtaaactccgcacccaggatgtaaaattcacaatggcccg

SEQ ID NO: 4918 - DNA, 150 bp, Homo sapiens
accatgaagagcctgatccttcttgccatcctggccgccttagcggtagtaactttgtgttatgaatcacatgaaagcatggaatcttatgaaccttaatcccttcattaacaggggaaattcaaattacctcatatcccctcagcagag

SEQ ID NO: 4919 - DNA, 247 bp, Homo sapiens
  misc_feature 218: n = A,T,C or G
aaatataatggatgatgatgagggagaagttgtggaatatgtggatgacctcttggaactggaggagaccagctagcccacagcaaccaaagagactttctcttggcgttcaggaaacacagattctttgtccttttcccaacagcccaggctgttgatacctcagagccttctctttactctccaaagttaaagggaggccccgtctctctaactgncatgtcatcagggggtgagcctgtccttt

SEQ ID NO: 4920 - DNA, 245 bp, Homo sapiens
agttgcccttgttgcaagtaatgaagcctgatttgattatgaagctgcttaatcactcttcatgtgttcagaattactgttttttttgtttgttttccttttggtcactgtgtacattaaaattttggaggatgctttactatgtaaggatatagatggtcattttaatccattcagccacatacggttgggctggtacacagcttattctgatacacgagtgctggggtgcatatggagagatt

SEQ ID NO: 4921 - DNA, 241 bp, Homo sapiens
caaactgaaggtatgtgcactgcgcgtgaccagccgggcccgcagccgcatcctcagggcaggggggcaagatcctcactttcgaccagctggccctggactcccctaagggctgtggcactgtcctgctctccggtcctcgcaagggccgagagtttaccgccatttcggcaggccccaggaccccggcacagccacaccaaaccttacgtccgctccaaggccgcaagttcgagcgtcc

SEQ ID NO: 4922 - DNA, 244 bp, Homo sapiens
atgacaaagaaaagaaggaacactggtcgtgccaaaaagggccgcggccacgtgcagcctattcgctgcactaactgtgcccgatgcgtgcccaaggacaaggccattaaggaaattcgtcattcgaaccatagtggaggccgcagcagtaaggaccattcctgaggcgagcttctccgatgcctatgtccttcccaagctgtatgtaaggttacatcactgtgtgagttgcgcattacacagc

SEQ ID NO: 4923 - DNA, 100 bp, Homo sapiens
ggagagattcagaaagacccccctatcagggtgggagaggagggctttggaagagcagttagagaacaaaccaggggggttcttttggttgtttaatttt

SEQ ID NO: 4924 - DNA, 277 bp, Homo sapiens
aggtcgacactaggttttctctgtgtggttcagctacttttcatttgggtattacacagtcaaatttacattaatctattaaaaattggccattttatttaaaccatttcatggcaccggtggatccaggtgttgtctgaacatattccttggttcctttttgggtatttggcgtgacttaaaaggggttaatctcgggcagagcacatatgtgataaagagagagttgcgcgttaaaatatatttctgagcactgtagagcacaacacagagcgcg

SEQ ID NO: 4925 - DNA, 244 bp, Homo sapiens; identical to SEQ ID NO: 4922

SEQ ID NO: 4926 - DNA, 220 bp, Homo sapiens
ctcgtgccgaattcggcacgaggctgattaatatattctgtgaaagaactcttctcatctgaaggtaattctctactaatctttattaccacaaagatcccgtctttgtacacatgaaattagtaactgcattttcaacatgatgaaccatttgaaatttacattttctgtaaagagaatagtgcctgcacgttgtttcactacctctttcccttcaaac

SEQ ID NO: 4927 - DNA, 215 bp, Homo sapiens
ggagtatccttcatctaaatttaccaattaacattttgtttgcagaagttgcagttattgtgacaattcaaccctcaaatattttcagagtacaagggcacacttttacataaacacgatctaaggctcacattcaggagaatttaacactgacataatattattatctaacatgcaatctgtattcagagttctccaattgtcctcaacagtgt

SEQ ID NO: 4928 - DNA, 193 bp, Homo sapiens
attatgttgaattgtagtcctcataatttcttgttttatttcctttactgtaaatgagagaaaaagaaaagaaattattattaaagtaaaaaaaaaactcgagagtacttctagagcggccgcgggcccatcgattttccacccgggtggggtaccacggtaagtgtacccaattcgccctatagtgagyctt

SEQ ID NO: 4929 - DNA, 205 bp, Homo sapiens
agaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagatacagacgccacccagccctggggggaggcccacgcctgctggaccaa

SEQ ID NO: 4930 - DNA, 238 bp, Homo sapiens
cagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggagataccgctgcctctgtggggggcagaatcacataggcaaaagctttgaaaatcat

SEQ ID NO: 4931 - DNA, 238 bp, Homo sapiens
cggttgcgcagtgaaggctagaccccgtttactggaattgctctggcgatcgaggggtcctagtacaccgcaatcatgtctattatgtcctcataacggaggggccgtcatggccatgaaggggaagaactgtgtggccatcgctgcagacaggcgcttcgggatccaggcccagatggtgaccacggacttccagaagatctttcccatgggtgaccgcgctgtacatcggtctgtg

SEQ ID NO: 4932 - DNA, 170 bp, Homo sapiens
tcgccatgaaggtcgagctgtgcagttttagcgggtacaagatctaccccggacacgggaggcgctacgccaggaccccacgggaaggttttccagatttcttaatgtcgcaaatgcgcagatcggccttttcctcttcccaagcaggcaatccctcgcgccagcagtaa

SEQ ID NO: 4933 - DNA, 223 bp, Homo sapiens
gtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattgggtttgatgagtatattaactctgtattagatgatgcagaagagattcattctaaaacaaaggcaagagaacacctgggtcgg

SEQ ID NO: 4934 - DNA, 185 bp, Homo sapiens
agatggcggaggtgcaggtcctggtgcttgatggtcgaggccatctcctgggccgcctggcgccaatcgtggctaaacaggtactgctgggccggaaggtggtggtcgtacgctgtgaaggcatcaacatttctggcaatttctacagaaacaagttgaagtacctcgctttcctccgcaagcgg

SEQ ID NO: 4935 - DNA, 224 bp, Homo sapiens
cagagctgcctggggaatacagcatgaaagtgacaggagaaggatgtgtctacctccagacatccttgaaatacaatattctcccagaaaaggaagagttcccctttgctttaggagttcagactgttcctcaaacttgtgatgaacccaaagcccacaccagctttcaaatctccctaagtgtcagttacacagggagccgctctgtctccaacatggcgatc

SEQ ID NO: 4936 - DNA, 245 bp, Homo sapiens
ctgtccattggactgtaaggtttatgtaggcaatcttggaaacaatggcaacaagacggaattggaacgggcttttggctactatggaccactccgaagtgtgtttggttgctagaaacccacccggctttgcttttgttgaatttgaagatccccgagatgcagctgatgcagtccgagagctagatggaagaacactatgtggctgtccgtgtaagagtggaactgtcgaatggtgaaaaaag

SEQ ID NO: 4937 - DNA, 230 bp, Homo sapiens
tctgcctttgttggcctgatgtgctgctgtgatgctggtccttcatcttaggtgttcatgcagttctaacacagttggggttgggtcaatggtttcccaatttcaggatatttcgatgtcagaaataacgcgatcttaggaatgactaaacacagatatatgtgcagatttagagctgtcacaaactcggtaaaatgtactgttagataaaatgtttgttaatttagttg

SEQ ID NO: 4938 - DNA, 167 bp, Homo sapiens
gtccactctgcacttggtcctgcgcttgagggggggtgtctaagtttccccttttaaggtttcaacaaatttcattgcactttcctttcaataaagttgttgcattcccaaaaaaaaaaaaaaaaaaaaaacctggggatacttttagggggcccggggccccatgg

SEQ ID NO: 4939 - DNA, 140 bp, Homo sapiens
gagacgtggcggcggttgggccggtgatacccgggcgctttatagtcacgccggcttcttcgtacacctactcctcctcctgctcctctcctggagcagaggaggttgtggcggtggctggagaaagcggcggcggagga

SEQ ID NO: 4940 - DNA, 249 bp, Homo sapiens
ggagtggtcagcgggtcacagctgcccccactctataaagcagggctaattgtgtaccctttgcaagaaattgcttttggtctcctacccaaatactcacaagggtcttatcagacggccgtcttaaagtccagcatgctcagggaccctgtgtaggatctcgtttgtgtgtgagtgggctgctctgaggtctccactcgggctgtccatttagccatgtgccatctctgtaagtcagaggtgtttgac

SEQ ID NO: 4941 - DNA, 253 bp, Homo sapiens
gaatgccgtacttggaaagaaagtccctctgcaattgcatagttcagaagccctcacttttcagccccgaggatgggtttgttcatcttccaccacctttgaggacctggtgtcccaaaagactttgcctatcccagcaaaacacacacacacacacacacacacacatataagagacacacaagggcgtctgcacagagagagagagagatctcagattgccacgcagagtttactatcacacagactcaga

SEQ ID NO: 4942 - DNA, 164 bp, Homo sapiens
gcttcctgaaaacttctttttttacaaaggaaattagatgtacatgtataattcagtgtgctttgtctttctccagattaatatcggttacactgctgatgtttgtaaattaaacagatatttacttcataaaaaaaaaaaaaaaaaaacctcggggggtactt

SEQ ID NO: 4943 - DNA, 282 bp, Homo sapiens
gctgcaggtcgacactagtggatcaaagaattcggcacgagctcgtgccgaattcggcacgagggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacct

SEQ ID NO: 4944 - DNA, 279 bp, Homo sapiens
cttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcccttttttttaagagtgtcttgtttaaatagtggccaatgtttaaggctgttaaaataagccaactcttactaatttgggggtgtata

SEQ ID NO: 4945 - DNA, 295 bp, Homo sapiens
cgcggcccgggttcgtttcccggtcagggaaccactggcagggagagacattcttgactcctctcttccctggtgtgttgtgatccagggaatgaaaagaaatttgaccctcgattggttctctccttggacttaaggaatcttacctctttcttccacaaagttctcccaggcaaggagcagctgcccattctgagcccagggcagcctcttcaaccattattggtctaacctcgcttgtcaggaaaccaagcccacccttccacattgggcctggctgctctattctgtacca

SEQ ID NO: 4946 - DNA, 151 bp, Homo sapiens
ccatcaccctacgtcccctcccccttcgacttgtcctcatcactgcatattgagctttcactttggcaaagtcttcaccttccagtaccatcacctttggggcttaaggtttcaagatatttaatttgtgggaggacacacacactttagk

SEQ ID NO: 4947 - DNA, 125 bp, Homo sapiens
ttaagatagatcgccatcatgaacgacaacctaactatccccactaggaagttcatgaccaaccgactacttcagagaggaacaaatggtcaatgtatgtcccctcacccccgggaaggcgcaca

SEQ ID NO: 4948 - DNA, 206 bp, Homo sapiens
ctcgtgccaattcggcacgagctttgtgcttgtctcaatcttatggctgtcaacaactgtgggcttgctggtgggtgccctcctttctccccaatatatacgtctttggtagactgttggtgcatgctacaaaaagagggggaatatgagccgcgggaatagcttatttttcccggagtgccccttggggagacttattgttgtga

SEQ ID NO: 4949 - DNA, 182 bp, Homo sapiens
cggtggctttccagaatttatgccagttgcaccagcatgcagaatatttgtaatgcatttcaaagtggatataatggcaccctttgtcagaatcacaaagctcactgcggcacttctacaagaggacacttagggaaatcttgccctatgtaacctagtcaaccccaagcaaaaagaatgac

SEQ ID NO: 4950 - DNA, 212 bp, Homo sapiens
gatccagctcgagtcaacgtccctgtcattggttgccattctgggaagaccatcattcccctgatctctcagtgcacccccaaggtggacttttcccaggaccagctgtacagacactcactggggcggatccagggagggccgccacggaggtgggtcaagggctaaagccggagcagggctcttccacccctcttccatggcgtatgccg

SEQ ID NO: 4951 - DNA, 100 bp, Homo sapiens
gaaaaacttaattggcaaggttggaattttggaggcaagaggcaaatttttttttggttaaggttattttggcacactaattggagagatctctttaagc

SEQ ID NO: 4952 - DNA, 110 bp, Homo sapiens
aaaaaccctaatatttgaatctatttatgtctttcaatttaaattcacttcagttttggttattgtaatatattaccttttaccatggtattatcaacttataattttaa

SEQ ID NO: 4953 - DNA, 140 bp, Homo sapiens
agaaggagaaggtggaggagaaggcaagccggaaagagcgaaagaaagaagtggttgaggaggaagagaaccgggcttaggaaggaggaggaggaacctcccaagattgaaagaaggagattaaggggaaggagaagatt

SEQ ID NO: 4954 - DNA, 200 bp, Homo sapiens
attgaccttggggtccatgtggatggcttcatcgctaatgtagctcacacttttgttggtgatgtagctcaggggaccaagtaacaaggagggaagcaggtgttattaaggcagctcaactttgtgctgaagctgccctacggctggtcaaacctggaaatcagagacacacacagtgacagagaggcttgagacacaga

SEQ ID NO: 4955 - DNA, 235 bp, Homo sapiens
gaagatggcggacattcagactgagcgtgcctaccaaaagcagccgaccatctttcaaaacaagaagagggtcctgcttggagaaacttgcaaggagaagcttccgcggtactacaaggacatcggtcttggcttcaagacacccaaggaggctattgagggcacctacatttacaagagattgccctctcactctgtaatgttgtacactcgagggcggaatcctctctctgcg

SEQ ID NO: 4956 - DNA, 265 bp, Homo sapiens
gaataatccataagtatctcccacagggacataatgatttaaattaaaaaggccttagaaagccatttcatttaggaaggcaaaatttttcatttttgaagtagtaataaaaagatcagataccctatggatgattttttttctttgaatctttctagtttcagatctccattaattcttttaagtgtataggtttcatttttttcactatatatattctctttgggggaattatagtgaagtgagtgaagatataagagtattt

SEQ ID NO: 4957 - DNA, 250 bp, Homo sapiens
tctcagccaattgtcccaaccattttgagggtcactaccagtacaagagcatccctgtggaggacaaccacaaggcagacatcagctcctggttcaacgaggccattgacttcataggtaaatggaatggatgccttgggcttttctgcctttctcttctcattttagccactaaggcccaaactcttttggcaagagcttcaaggtttctgagcctcttcccacaattcagtatcagacttgcgttggg

SEQ ID NO: 4958 - DNA, 316 bp, Homo sapiens
ccacagggggacactttgcccataatatagctcctaacagaggtgtgtcttgtacttgcagtgactatttctttctctattctggacatcaccttggcctttattttagaggcaaacgcacagaggaacccagggtaagtctgagtcattcttcactcaaggacttcagtaataactccaaagatagctgacagtggggaagactggaattttgagtgctgagttattctcctatcccaggcacctcacccccttagcccaatcaaagagccagggcactccccacccagacttcagagtgtagtccgaatacacc

SEQ ID NO: 4959 - DNA, 317 bp, Homo sapiens
gcagccttcatgaaactggacacaccagctacttcagatcccctctctggtaagggcagaggctggagtgcccagggttgtcaaacatactacacatgtactgccattcccgccttgattcagtggcagacatcactaattaggctctttcccttctgaacccttcagcacactctagtgtcatttaaataatacttcattttggatgtcagataggagctatttgcaccccagagaaattgatgacgcctgaaagtgtaaattctgaggagctctttcaagatacagtagggtgtacaacctgtatcctttagagt

SEQ ID NO: 4960 - DNA, 315 bp, Homo sapiens
cacaaacgctgcccagagttcttctacccagagctggtgaagaatatccgagggaagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtattgttattatgaatccgactccttcatcgataactctgaggcgtattatgagcttgttccgcttctttgactacgagtatggaggagtttacattaactctgggaacccgcagtttag

SEQ ID NO: 4961 - DNA, 180 bp, Homo sapiens
taacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 4962 - DNA, 316 bp, Homo sapiens
gatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctcgtgaagaattgcatcgtgctcatcgac

SEQ ID NO: 4963 - DNA, 316 bp, Homo sapiens
gcgaggcgctggaacagtccgggagattctcgctctgctgctttagcttcggagtgtttggcgacggggcagcgcgagatgtggaggctcatgtcgaggtttaatgcattcaaaaggactaataccatactgcaccatttgagaatgtccaagcacacagatgcagcagaagaggtgctattggaaaaaaaaggttgcgcgggagtcataacactaaacagaccaaagttcctcaatgcactgactcttaatatgattcggcagatttatccacagctaaagaagttggaacaagatcctgaaactttcctgatca

SEQ ID NO: 4964 - DNA, 313 bp, Homo sapiens
tacatcgacaagacgatccgggtaaagttccagggaggccgcgaagcagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccggggcgcggggggtgcagggcaggcccagcagctctggtttccccc

SEQ ID NO: 4965 - DNA, 292 bp, Homo sapiens
atgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggcccaaatcaagagtgagatgtagagaggtgtaaaatagagaaagttgagtttgtgaatc

SEQ ID NO: 4966 - DNA, 279 bp, Homo sapiens
ctcgcctcggcctcccaaagtgctgggattgcaggcgtgagcacccgctcccggcaagggaggctttcttaatggcgccaggaaaagtccgagggccaacgcccattggactaacttgggtcatgtgtctgtctctgaagtagtcactgggtctgacccttcctggctttgacgacatactcctgtttagagctgaaagtggaaagtctgtccagaaaacgggaggccgaccaggcctggcaaggaggtgccatgcacttctctcctcatgtcccaggg

SEQ ID NO: 4967 - DNA, 175 bp, Homo sapiens
gtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggagc

SEQ ID NO: 4968 - DNA, 283 bp, Homo sapiens
gaaagagttagataccttccaaaagagaaaaggaatgtaatgggaggagagataggcaacagaaaacaagcatctgtcccttatggagaaaaatgtatttttaacagatactagagaatatagaagttgctatatcaacaaaaaatttttatttgctcaaacaggtggataagccaatgtgtatttactgaataaatgagtatgtgctagtggagatcaattagtgagtgtaataagtgtaacacgtaaatggataaactcagtaggggacacattatttctt

SEQ ID NO: 4969 - DNA, 260 bp, Homo sapiens
tgtggtggtcgcaccagctctctgctctcccagcgcaggccgccgccctgcccctccagcttcccggaccatggccaacctggagcgcaccttcatcgccatcaagccggacgggtgcagcgcggccttgttggcgagatcatcaagcgcttcgagcagaagggatttcgcctcgtggccatgaagttcctccgcggcctctgaagagcacctctaagcagcactacatttacctctaaagaccgcccactctttcctct

SEQ ID NO: 4970 - DNA, 100 bp, Homo sapiens
atattgtagacatagtaaagttttttggggatatgcgccggaatagcatgtatatagaccccattttaggcttggcgaaatgagttaagcaggttgcaat

SEQ ID NO: 4971 - DNA, 237 bp, Homo sapiens
gacactagtggatccaaagaattcggcacgagcctgacaggccttccctcctctcaaacctgggcagatggggggcctctctgggagaggggagggggccctgttcacttgtaccagagtctctcttttacacttaacctcctcctgcagtcagactgaaatataaaaaaggttggtggtggtggtgaagggcctggtggagatgtgggacccgatctcctatttttaatttcctgt

SEQ ID NO: 4972 - DNA, 288 bp, Homo sapiens
gagccttttgctcatcccaaattatgaatcttaaaaggtgcatgattaaggaggaaaaaaaaattatgtcctctgcctgtgtgaacttcctatgtgagggggcatggaggccagattgtttaaggagattttgtaaagcagggtctgaccactcagtgactggacaggcaacttacttttccctgaggctgggagttcccccttcatgctttcactgtggtacttcactagtagctcaggcagatcttttttaatatgcattgccacctttgaatttgtaaggcacgc

SEQ ID NO: 4973 - DNA, 200 bp, Homo sapiens
gaacgtcttgaggttatcaataagcctcctagtccagacggccatgggtcatttcacagaggaggacaaggctactatcacaagcctgttgggcaaggtgaatgttggaggatgcttgaagagagaacccttggaaggctcctggtgtctacccagggacccaagaggtctttgacaagctttgggcaacccgtcccctg

SEQ ID NO: 4974 - DNA, 291 bp, Homo sapiens
ctcgtgccgcacagatggaagagtgctgtcctgtgctactcaccctcggacagacagagttggcccagttccgcggtgaaaggaaggttcaagtctcagctgccagatctcagttgccctcacagctacagtccggggagaaacagcgtggcttggaagcaaccccgcaaagccaaggctctggcagtgctctggcgctacagaccccgtgcacgggagcccagctccgcagggtggcgcgcctctgctctagcttttccgccctcttagagttttgcgctgcgggtctcg

SEQ ID NO: 4975 - DNA, 165 bp, Homo sapiens
taaccttgaatctagtcacaataataatatcctatgtattgcaaaccagagatctcagtcagatcccctaaggggactggagaatacacactatgattttgactttcttgctctttctccctcttgcttttttttctctttctcccttcagagttagcccctcac

SEQ ID NO: 4976 - DNA, 150 bp, Homo sapiens
accagatccaggcagccttccgggagccacggcttcttgtggttactgaccccagggctgaccaccagcctctcacggagggatcttattggtaaacctacctaccatttcggtttgtgtacaaaaggttctcctcttgcgctatgtgga

SEQ ID NO: 4977 - DNA, 166 bp, Homo sapiens
gaaagaagcagtctgatgtcatgcgctttcttctgagggtccgctgctggcagtacccccaactctcttctctccacaaggcttcccggccccaacccggcctataaaaagcgcgccgctctgggtctacaaggccaagcaaggtttacgtttatatatagggatt

SEQ ID NO: 4978 - DNA, 181 bp, Homo sapiens
gaaaagctctgcattactgtgcaaataacattcaatttctgttttgctaaaagaaattgggaagctggacaacccgattacttgggtcattgccattggccaaggagaggccttgtcttgggttaattttttgttgggcagtggaacagatttccatttgtgaaggacgtcaataacttca

SEQ ID NO: 4979 - DNA, 62 bp, Homo sapiens
ggtcgacactagtggatccaaagaattcggcacgagtgggaggctgaggtgggtggattacc

SEQ ID NO: 4980 - DNA, 228 bp, Homo sapiens
gggccatggaaattccttctatccctcttaacttagtgtcaacaaaaagtcttagtgcaggcaaacccacttgactttattttgggggaaaaggccatggggaggaccctttagattgcacttccaaactagaaaccaaacgggggtgcctccaaggggggtcgttctcctttgtctttagaaaaagggaatcgagaagaaccctttagaatgaacctccgaactaca

SEQ ID NO: 4981 - DNA, 117 bp, Homo sapiens
ctgcaggtaatcctggggaacctggcttgagagggccgtagggaagtcgggggcttcctggagttggaggacaaagaggaaccacttggaccccgggttttcaaggaagaccagggt

SEQ ID NO: 4982 - DNA, 116 bp, Homo sapiens
aagctgtgggcaggcaagcccttcggtcaccgtttggctacacagaccccttccctggtgtcagctcaggcactttgaggtccccgaccaacaatttcaggggttcctgcttaagt

SEQ ID NO: 4983 - DNA, 175 bp, Homo sapiens
ggcgccatcatgggagtggacatccgccataacaaggaccgaaaagttcggcgcaaggagcccaagagccaagatatctacctgaggctttttggcaaggtatataaggttctttggcgagaggacccaatctcacaaattaacccaggttgtgttgaggaggttgtttatgagy

SEQ ID NO: 4984 - DNA, 216 bp, Homo sapiens
cagaggtgtgcagagccacaacaggtgctgagggagactctaatgcatgattcaggttaaacccagcaggaagaaaggactctcccaggtaactctccagtatatagcgctcgctattataggtgggacttacatagaacacaaaggccttccgagggcacagagccaatatatgtcmaaatattttgtatgtaggagagactatattatgtgata

SEQ ID NO: 4985 - DNA, 116 bp, Homo sapiens
ggaaaatcacaattacaccactttagaccctatgtgtaggaagggtaaaacttaaccttgtgtgtttaggagtgtattgaataacctctataacgttgaggaaagctgtttacttg

SEQ ID NO: 4986 - DNA, 170 bp, Homo sapiens
ttaacattgggtcttcccaagactttatagctttatagtgcctattatacttcaggttactttacaaactcattttataaccttacggcacaaaattggaaaataggaaagtagggtttttggcttcaacacatttttaggaaacatttgcattgactgtaccacggggt

SEQ ID NO: 4987 - DNA, 140 bp, Homo sapiens
tttcagagtcagtcattggttatacatgtgtagttccacagcacataagctaggaggaggagatattctaggggcactaccatctgttttcaacaatgaattgccacaaaatagggacttccacaacaatttcatattcc

SEQ ID NO: 4988 - DNA, 170 bp, Homo sapiens
cagcaatgatattaatcacctctttggggcttccccacaccaaccctcctagagctttgttttgtccttcttccaaaaaaccaggaaaccaaaaccatttcttcaaaaatgcaggattctaaggtggattagagagtggggtagaggcaaggagagagagatggtagtcg

SEQ ID NO: 4989 - DNA, 122 bp, Homo sapiens
ggagtgcaaaggaggcgacctgcaacagaggagtcccggtcaccagcaaccatgacggaccagcaggctgaggccaggtcctaacctcagccgaggagatgatccgctgaagttcaaggcct

SEQ ID NO: 4990 - DNA, 155 bp, Homo sapiens
cagacacctggcttttcaatctatgccacctcccctatgctcttcaacttgtaggggcagattcttcctttcactcccttccttttttgccttttcattgttatactctaaaaaaatttcaaaaccaaaggtgcaaacaatactgattggtttca

SEQ ID NO: 4991 - DNA, 108 bp, Homo sapiens
aagcaagtttgcatttaataaattatatatgcatcacaaaatttatcttccatagagagagatatattatgtacatagaggtgcacatttttattatgtaccatagaa

SEQ ID NO: 4992 - DNA, 117 bp, Homo sapiens
cgatattttcatgaaccatcacctgcaggaaacaggtttcacaaaagaagcctacaagaagtacatcaaagattacatgaaattccattcaaaggggaacttgcaggaccagagccc

SEQ ID NO: 4993 - DNA, 175 bp, Homo sapiens
tttatgggctgggaatgtattttgaccgttgcaacatgccatagagatataagggaattagtcctatcattgtcattgccatgtgaatcaattggaggggcaaggctccagtggcaagccctgcaagagttcaaggccaagggaaggagcaggtttcaaggggcaaatttggggt

SEQ ID NO: 4994 - DNA, 160 bp, Homo sapiens
cgggcgcgacccttcgaatgtaatatatgtttggagactgctcgggaagctgtggtcagtgtgtgtggccacctgtactgttggccatgtcttcatcgtggctggggacacggccagaccggcaagggtgtcccagtatttaaagctggggtccgcaaga

SEQ ID NO: 4995 - DNA, 213 bp, Homo sapiens
ttgcctgatgtgtgtatcatcggtgggatgacagaacaaacatatttatgatcatgaataatgtgctttgtaaaaagatttcaaggttattagggagcatactctgttttttaatcatgtataatattccatgatacttttatagaacaattcttgcttcagggaagtctaggagcaatatttctttcaaataaaaggtgtttaaacttttwa

SEQ ID NO: 4996 - DNA, 325 bp, Homo sapiens
atcgtagtacaggacttgtgacctcattattataacacaactagaacactgagctcttgtgcttcagatgttgccttgtgtgtaacaaaaaataacaataggaaaaggttattttgattccaactcactaatgtttcttttggagaggttacaaggttttgggtacctaaaggaaggcaatcaacctctatttccatacaacctcggtgtgaattcaaagttctaaaaggggaaatcaaaggaaaggctctctttaaggtatggtcatatttcgagttatatggggttcacggtgaattcaccaacacactcctatttcagagat

SEQ ID NO: 4997 - DNA, 326 bp, Homo sapiens
ccgaatacgagttcttttggggctcccgggccagccggggaatcaccaagatgcaaattccgggggttcctgggccagggtttttaaagaaagaccccccaggcctggccctccccgatacagagaagctctggaggaggccagagctctcgcgggaggctaatcccactgcccactaccctcgcagcagtgtctctgaggactagcaaagtctggaggcagatgaatggttcctgaccctcaccaggcctgttgaagggtggggggtgggcattatagtatttcaggatttacagtccagtattcacgtgtaactttaaagtttt

SEQ ID NO: 4998 - DNA, 323 bp, Homo sapiens
ggaccaccagggcctcgaggtaacagaggtgaaagaggatcttagggcttcccaaggccacccagggaaactaggccctcctggacctcctggtgcccctggtccttcctgtggtggttttggagccgctgccattgctgggattggaggtgaaaaagctggcggttttgccccgtattatggagatgaaccactggatttcacaatcaacaccgatgagattatgacttcactcaagtctgttaatggacaaatagaaagcctcattagtcctgatggttctcgtaaaaaccccgctagaaactccagagacctgaaattct

SEQ ID NO: 4999 - DNA, 326 bp, Homo sapiens
tcaaagtatactgtgatttctctactggcggaacctgtatccggggccaaacctaaaaaaatcccagcaaggacctggtttaggagctccaaggaaaggaaacaggtttggttaggagaaactatcattgctggcagccagtttgaatataaatgtagaaggagtgcactctccacggaaatggctacccaacttgccttcatgcgcctgctggccaaactatgcctctcagaacatcacctaccactgcaagagcagcattgacatacatggatgaggagactggcaacctgaaaaagggcttgtcattctacagggctctaatc

SEQ ID NO: 5000 - DNA, 332 bp, Homo sapiens
cagcaccatggcggttggcaagaacaagcggcttacggaaggccgcaaaaagggggccaaggaggaaagtggttaatccattttttaagaaagattggaataatgtaaaagcacctcctatgttccaatataagaaatattggaaagacggctcgtcaccaggacccaaggacccaaaaatggcatctgatggtctcaagggtcgctgtgttagaagtgggcctgtgctgatttgcagacgttatggaggttccatttaggaatttcatgcctaattacttaagttgtcaggggaaaaactgtcctcaactaactctccatggcatgcgtct

SEQ ID NO: 5001 - DNA, 210 bp, Homo sapiens
caagaacacacacatatacacgaatagacatcaaactcaatgctttatttgtaaaattaggtttttttttaattcctcctgccaaatgaatgtgcaaaaccttttactggttgcaatggaaatcggccaagttttatatcctctaaatctcaatgttcctcaaagctctggaataaatcaatataggaagttaccctctctgcgccacat

SEQ ID NO: 5002 - DNA, 254 bp, Homo sapiens
ttgtatttgagagaaattataagagccatcacctccagctacaggtcaatcccgttccaatcaagcttgttcttacttacttaatgacattaaagaatgccttcattaccaaggcacaggagcagcagatagagctgttggaaatccaagagcactctgacatcaggcagattgacacagccaggagcagcatatttattatgtggaactgagaaacaggagaaaagctttttccacagcattaaaaacagaat

SEQ ID NO: 5003 - DNA, 192 bp, Homo sapiens
tcttcacaaaggatttggacaaggccaattacctgtcccaggccctccaggcggggcactgtgttgggtcaacctgctattatgtgtttggaggcccaggtcaaccctttggtggctaccagatgttcggggaagtggcccgcgaagtttgggccgagtaccgggctgcagggcattaccatgtaggtgaaa

SEQ ID NO: 5004 - DNA, 178 bp, Homo sapiens
ggttcctgcccagaaagccacaggccagaaagcagcgcctgctccaaaaagctcagaaggggtcaaaaagcttccagccccagaaagcaccttcttccaaaggccatcttggccaagaaaggcattaagttggccattcattaaaaggttattaagggttccttttttgaccctcttg

SEQ ID NO: 5005 - DNA, 245 bp, Homo sapiens
agaatcttaggagagagcgaaattcgcgatgcaatgatggcaaaggccgagtacctcttcccggataggtgacaaagagggagcctcttacaagccttttcgcaaggcaatattaccaaaactttggccctgggtaacccgattggatatttaattcttattctcctagggattgggcttatttatatatgggataaggatctcatcacacgagacacagaaagggccaaacgcttattagagga

SEQ ID NO: 5006 - DNA, 151 bp, Homo sapiens
aagtctggtgatgctgccattgttgatatggttcctggcaagcccattgtgttgttgagagcttctcagactattccaccttttgggtcgcttttctggtccgtgatatttaggcaagacaattgccgggtgggtgttcaacaaatcgatt

SEQ ID NO: 5007 - DNA, 125 bp, Homo sapiens
ccatttgttagcatcgtcacacgattgtgaattttttattgtcaaaagaagcacaaaactttgcaatacctatttttttaggccaggcaaaaaaaaaggaatcttaatggtattaaaaatggtgt

SEQ ID NO: 5008 - DNA, 103 bp, Homo sapiens
gggggctaggcatgagatcacttgacccaggaggtggaggttcagttaaccaaggtcaaacactgcacttccagccttggcgacaaaattagagtcttgcttc

SEQ ID NO: 5009 - DNA, 140 bp, Homo sapiens
tctacattacccatctcctcttttgcctctgagaagagtatatatgcttctgtaccccactggggggttggggtaatattctgtggtcctcaggccctgtacctttaataaatttgtatgccttttctcttaaaaaaaaa

SEQ ID NO: 5010 - DNA, 235 bp, Homo sapiens
gcaaggagagccaaagctaagacccccgaaaccagacgagctacctaagaacagctaaaagagcacacccgtctatgtagcaaaatagtgggaggatttataggtagaggcgacaaacctaccgagcctggtggatagctggttgtccaagatagaatcttagttcaactttaaatttgcccacagaaccctctaaatccccttgtaaatttaactgttagtccaaagagggaca

SEQ ID NO: 5011 - DNA, 140 bp, Homo sapiens
ctcgtgtaacggcggcggtgtcggcagctgctgtagcgaagagagtttggcgcgatgtctcacaccatttttgctgggtacagcctaccaaggagggccaggaagggcaggaacttatgcttgactacggaatctgtgaa

SEQ ID NO: 5012 - DNA, 215 bp, Homo sapiens
ggttcggcgagagcatgacccatggattccagttcgagtatggcggccagggctccgaccctgccgatgtggccatccagctgaccttcctgcgcctgatgtccaccgaggcctcccagaacatcacctaccacttgcaagaacagcgtggcctacatggaccagcagactggcaacctcaaggaaggccctgctcctcccagggctccaacggg

SEQ ID NO: 5013 - DNA, 230 bp, Homo sapiens
ctcgtgccgaattcggcacgaggcgtggtctacgccgagtgacagagacgctcaggctgtgttctcaggatgaccgagtgggagacagcagcaccagcggtggcagagaccccagacatcaagctctttgggaagtggagcacccatgatgtccagatcaatgacatttccctgcaggattacattgcagtgtaaggggaggtatgccaagtacctccctcacagtgcag

SEQ ID NO: 5014 - DNA, 210 bp, Homo sapiens
tatcaataagctcctagtccagacgccatgggtcatttcacagaggaggacaaggctactatcacaagcctttggggcaaggtgaatttggaagatgctggaggagaaaccctgggaaggctcctggttgtctacccatggacccagaggttttttgacagctttggcaacctgtcctctgtcctctgtccataatgggcaaccccaaag

SEQ ID NO: 5015 - DNA, 206 bp, Homo sapiens
ctttctaactcattctatgcgtccaacattactctagacattaccctattacccaaataaagatattataagaaaggaaaactacggaccaatatctctcatgaacatgctccagaaatcctcaacaaaattattagcaaattgcagttcagcaatgtttttaaaagagtttacatgtttgctgccagtggggtttttttccaggt

SEQ ID NO: 5016 - DNA, 285 bp, Homo sapiens
tctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcacctccccttttttctcctattaatcaggagacactccaaggttaatgggatggtcggatctcacaggctgagacctcgttcacctccaggcatttcatgaaaaagctgcttctaattaatcatacaa

SEQ ID NO: 5017 - DNA, 288 bp, Homo sapiens
ctcgtgccgaattcggcacgagtctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaagctgggcgtggtagctcatgcctgtaattccatcactttgagaggccaaagcaggaggatcactcaagccctgcaagtttgagaccagcctgggcaacatagtgagaccg

SEQ ID NO: 5018 - DNA, 288 bp, Homo sapiens
ctcggctttaagatgtttgctgtgggtgtgggcaatgccgtggaggatgagctgagggaaatagcctcagagcctgtggcagagcactacttctacacggctgacttcaagaccatcaaccagataggcaagacgttgcagaggaagatctgtgtggaggaagacccgtgtgcctgcgagtccctggtgaaattccacgccaaagtggaggggctgctgcagtccctgaccaggaaactggaagctgtgagtaagcggctggccatcctggagaacacagttgtctaa

SEQ ID NO: 5019 - DNA, 288 bp, Homo sapiens
aaaagctggacagtaaggtgaacatcattccaataattgcaaaagctgacaccattgccaagaatgaactgcacaaattcaggagtaagatcatgagtgaactggtcagcattggggtccagatatatcagtttcccactgatgaggagacggtggcagagattaacgcaacactgagtgtccatctcccatttgcagtggttggcagcaccgaagaggtgaagattggcaacacgatggcacaggccaggcagtacccctggggtgtggtgcaggttgagattgaaa

SEQ ID NO: 5020 - DNA, 286 bp, Homo sapiens
ctcgtgccaattcggcacgagtagaggaagcatatgagctataaagccccaaggcttctttccagaaaaatgaatagtccagattgacagatgcacatgattcaaataggtgagtagtaggaaatagaattatgagaagggcagagttcattaatgctaggctaaaacatttatattttatttagttgacaggaaggagtgactgacaaagtttttgggcaggggagacacatggatcacagctatgctgtggagaaattacacgctgatgggttggaggagggga

SEQ ID NO: 5021 - DNA, 289 bp, Homo sapiens
ccacaactgtcttaactaaatgtgctgtatttttctttaaaagttaagagttctatttggtgttttcaggaatatacgtgaaaagacatgccatgttttggtaaataccatcagagttgtgtaaaggcgtgtactaggtgccaatctcaatttgtggagataatctccatttacccctcctaaaactacactcagtatatacactctcccataaggtgtgtgcagtaaaaatgttatattactccaccactggcaagggcacagcacagcagccttatttgagagagcg

SEQ ID NO: 5022 - DNA, 290 bp, Homo sapiens
atttttactactgttaatttaaataaaatttgttctgtggataaaatgaggttggcagtgaagaaaattaaaaacagcctcattcatgtaactgggttaagtaaaaatacattttcactatgtgttcataaactctttaatgaagctgtttgtctttcagttcaaatataagtgatgtttaggctttatttctgttaatagggctttttaccattgattaaatgagggattgtatctctctgaagagatttatattctgtaaataaaaattcgttgtaacactaaagttg

SEQ ID NO: 5023 - DNA, 265 bp, Homo sapiens
ggatctacagaataagcacaatcccagtcaaaatcccagaagactcttttttttgtataaattgccaagctggttctaaaatacagaaatgaaaagacctagaggattaaaactattttgaaaaaaaaagaccacatttggaggacttactctatgtgctctcagggtttactataaagctacagtaattaagacagtgtagtttccatatagggatagacatgtatcactatatagacacagagtccacaaataagcccacatg

SEQ ID NO: 5024 - DNA, 283 bp, Homo sapiens
cgggaggccaaaatgaagtttaatccctttgtgacttccgaccgaagaagaatcgcaaaaggcatttcaatgcaccttcccacattcgaaggaagattatgtcttccctctttccaaagagctgagacagaagtacaacgtgcgatccatgcccatccgaaagatgatgaggttcaggttgtacgtggacactataaggtcagcaaattggcacagtagtccaggtttacaggaagatatatgttatctacattgaacggtgcagcgggaaaaggctaatggc

SEQ ID NO: 5025 - DNA, 288 bp, Homo sapiens
ggcccctcccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtacacacgtgtacatccacgtgttacctaagagagctttccagcctgtgcttaggagaactgccctacatcatctgcaagtaggacgcg

SEQ ID NO: 5026 - DNA, 210 bp, Homo sapiens
gtgccgaattcggcacgaggatgaggccataccgaacgggggagcccccggcagtccttggggggcctggaggagatctttggctcacctcgactcccttccgggggggacatcgaggccagattgagggcggcccaaccaggggaccccagggacaagccctttcttggcaccttcccaaggacctttaggactttttcccaccccagg

SEQ ID NO: 5027 - DNA, 319 bp, Homo sapiens
tgtcagattgcttatgccgtatagaggggatatgatagtctgcgcagtattgcacacgaactgccacaatatggtgtgagggttggcctcacacattatgctgcagcatattgtactcgcctgctgctggcccgcagctttctcactaggtttggcatgaacagatctatgaaggccaagtggaggtgactggtgatgaatacaatttggaagacattaatggttaagccaggtgcctcacctcctatttggatgcaggccttccagaacctccccctggcaataaagttttttggtccctcaggggcctttggtgggg

SEQ ID NO: 5028 - DNA, 217 bp, Homo sapiens
atggattggagtttgcagtgactctggggccagcaccaggggacgacgttcaaccttagcctgaagggacccgctcccagctcagaggccgtctctgactctctcgtgcgtattttggaccctgatttacactctcctacccttgggaggttctggcgtttggcacagagccccctctccctgtttggagctcagtgctagaccaggccccttgccc

SEQ ID NO: 5029 - DNA, 178 bp, Homo sapiens
ggatggacagtgctgtccgcacgccggctcagctcgccgctgcctgcactccagccgccatagagtcagctcggcgcactctaaccgcatgtccagaggcggccggatgtggaggtgagcttgtggacagctcgggctctgaaattgggaaagagatatcaaaggacaccccatctct

SEQ ID NO: 5030 - DNA, 170 bp, Homo sapiens
ctcgccgggcgcagactggctctggctccttggaaggtctttcctgattatgacctctatatagagtatataggtttgtcctttttcaaggaggtctttgctgtacaatcgatgtatataacttttataaggtacatttcatataccgttttaacactgtgtaaaaaaaa

SEQ ID NO: 5031 - DNA, 224 bp, Homo sapiens
agaggctgtggagaggctggctggtacccagctgcgtgtgctagaggattactctgtcccctgtgcacatgctgcccatgtgccaggcctcaggatcctaggcccaggcatcatggtctcagcctccattggatcaccggtctgaccttctggcgtctgggcgcatggtgaccccacctccatgattagcactgtgtcccatgtccctcatgtggctcaaaggg

SEQ ID NO: 5032 - DNA, 223 bp, Homo sapiens
ctcagtaacagaatcctggtggtgttaattgggtgttttgcctggagattcagattccttctatacctccgattctgcccagaggagggggggattcaccagtgttaacaaaattagaggattgttttgctgtttaagactgattatttgaccactgcagcattactagccaccagtgttaaaggccagatgaggggaaccattttgctttagcagtaatccc

SEQ ID NO: 5033 - DNA, 166 bp, Homo sapiens
gcaagatggtcacagcagctgtacttgagcaccggaaattggccagggttcttgcttttgtcggtgtctgttcaaaccggcacgtcttgatccggaaatattggcctcaatatgtgccgcaagtgtttccgtaagtccgcgagggatatcggtttaataagtcgct

SEQ ID NO: 5034 - DNA, 242 bp, Homo sapiens
gacgtctgaggttatcaataagctcctagtccagacgccatggtcattcacagaggaggacaaggctattatcacaagcctgtggggcacggtgattgtggaggatgctggaggagaaaccctgggaagggttcctggttgtttacccatggacccagaggttctttgacagytttggcaacctgtcctctgcctctgccatcatgggcaaccccaaagtcaaggctacatggcaggagggt

SEQ ID NO: 5035 - DNA, 215 bp, Homo sapiens
gatgattataccgtcagagtgattgatgtgttctatccacagcaggcaggtcagtgtggagcagtgaccagtgtccagctaaatgttggatatttgagcagcaggaggccgggatggttttggtggtatcacagtcacctgcttggtggtggcttctggttggatacacactcagcagactttgaggcctgtcggagagacctgtgcagtggttk

SEQ ID NO: 5036 - DNA, 157 bp, Homo sapiens
ttggctctgacactgcagatcgtatgtagcggatctacagatccatcagatgctttagacaagtgagcatagagaagtgtggcagccccactgacagtagctcacttagattttcactttgatggattaccagggtttagacattccatcaccattc

SEQ ID NO: 5037 - DNA, 191 bp, Homo sapiens
agacgacgtcagaatgcacctgaagggaggaaagaggagacaggtaatagccttggacttaggggcttaggagagattatttgggtcttccattctttcaatccgttaattcaactttttccattctacttatcttctggcaggaaaccatcttccgttgacgtgggagtaggtaaggcagcccgcattat

SEQ ID NO: 5038 - DNA, 218 bp, Homo sapiens
catatcataagcagcgaggaagatctaatagctctgatctcagtttctcatctctacaatagggcagtagatggcatgcacctcccgggcctgttctgagattctagatgcctcccattgacactgggagagcctggcacagacaaggtccaacccaggccttttgatctgtctgtcctttggcctgggacattcctcccaagatacctcctgagggg

SEQ ID NO: 5039 - DNA, 286 bp, Homo sapiens
tggaccccggactctcgcttccggttctgtgagcagctctgcacatgcagctggtagcgagcatttacaaagggcctgaccttgaaaggcttacttctgcatgctgtctgcatgaccacgcctgtgaggagcctggtgagaacacatccaagctgggcaagatgattacctcagcatgatacaatgtttacttcagtatgatacaggagtctacttgacaatacaagtagaggacggtgctatcagtagtctcttccttccgtgggggagcagcagatcatcagtt

SEQ ID NO: 5040 - DNA, 258 bp, Homo sapiens
aaagcatatgcagccaaccaggatgcaaatgttttgaaatgatatgaccaaaattttaaggtagggaaggtcacccaaaccacttctgctttcacttaagtgtctggcccgccattactgtgggaccaggcatgatctggttactgtgatatattaaatatccacagtactcacttttaccaaatgatcctagtaattcgcctagaaattatctttctctcacctgcttattcatcaatttctccccagtatttttta

SEQ ID NO: 5041 - DNA, 248 bp, Homo sapiens
ctcgccctctggcgagacaatcgcagcatgctatgagagaagagagttataagaaattcgagaacttgatcacttccaggagcattgaaagtacagacactgagcctcaacagtgttcgaaacttgagcagtgcacacagatttaagagtacagccatgttaacaaaaggctttggatcagtttgtaacttctccgagcaggaagaaagttaataagcgtcaaggagggttaggtaggggtacaatcg

SEQ ID NO: 5042 - DNA, 254 bp, Homo sapiens
gtggttgaggtaagtcaagtatttagtagagagtgagatgagtaagcagcatgaatatagggaggcatcaagcacatggtattgagtgatgtcgaggagtgataatttagagaagggttgttagtgaaaagaagtttaagtggcgacgagatacgcgattgtaagatatcgatacgagctacagcactcacgatttacagagtatgatgagataagtttgcaatgtctatactttcgcttttggagactacgac

SEQ ID NO: 5043 - DNA, 224 bp, Homo sapiens
gtcgcttcaacattcacatctttgttcctcattgttgttatatacattgatattgtcgtagctgttatgacatattttattagaggtagcattttttcagtatgccaaggtttgcttctgagatgactctatactattaatcttcatgagtgttagatatgagtatctgcatttaacgttggctgcgatgttagactaatgaatatctcatgctctaaagcaaa

SEQ ID NO: 5044 - DNA, 175 bp, Homo sapiens
  misc_feature 161: n = A,T,C or G
tctgcttgggcgatgggcttccagcagaccactgtccagaaagctgatctgtagttatgtagatgcacatatctgtcctaagacctgtttaatccatttgggaaggatgttgggaaggccactttcctcgaggggtacgggacggtagggactctattttnataatacatcgtcg

SEQ ID NO: 5045 - DNA, 323 bp, Homo sapiens
ctgcgttggcgaaaggaagtagcacacttcaatacaaggatgtctaactttcttctaaatgagaattcactgtcttgctgtgtgatataacagatagtccaggtcgtgagttctgtgaaaggtaatcgtagagctagtatattttatattttgtacattgctttttcatggggagcgggtagtattatagtccaacagtcagtaatttttataatctcagttataacagccctaaaacttacaacgttacaagtttttaaaagggctgatacactgatttcttcaaataataggcagctagctaggggtacgcgggaggatcc

SEQ ID NO: 5046 - DNA, 271 bp, Homo sapiens
taactgtctctgtctttgtctctgtctttgccagagtctgtgcccagcattgtgcgataggagagccctgaaaggccagagtgtcctggttaagggaaatgatcaagtctcctcgtatcgctgtcacatgtatcaagtctctcgtccctggtcctctcgtactagggcctctcgtcctctgccctcctcgaaagatgtagaactgaatcatgtaaattgacctctgcattgaggcctaaggtacaagacatctgccccctgtccctgcctc

SEQ ID NO: 5047 - DNA, 204 bp, Homo sapiens
gaagcgttgcagcaaggagatatgcctaccacttctgtagtaaggagagagcccaggacactttccattgacctcttctcctcttcacatgtaggcaggagcctgagccttcagctgcctgcacaaccctgacattggctgctggtgacttaatctgccaatgtgctgcagctcgttttctcccattacagcaggactttcagc

SEQ ID NO: 5048 - DNA, 282 bp, Homo sapiens
caggcctgcagctatggaaaatggccgagacggtgagcgaggcccccagggtggcaggaattcctggagtgcctggacccccgggacctcctgggcttccggtttctgtgagccagcctcctgcaccatgcaggctggtcagcgagcatttaacaaagggcctgacccttgaaaggcttactgctgcatggctgtctgcatgaaccaggctggtgaaggagcctgggtgagaacaccatccaagctggggcaaagtgattacctgcagcatgatacattttt

SEQ ID NO: 5049 - DNA, 359 bp, Homo sapiens
  misc_feature 239: n = A,T,C or G
tgcaattgctcttctccacgtctttcctgctacaagtgttttagatgttactaccttattttccccgaattctattttttgtccttgcagacagagtataaaaacctcctgggcttaaggcctaaggaagccagtcaccttctgggcagggctcctatctctcctccctatccatggcactaaaccacttctctgctgcctctgtggagagattcctattactgcagtacatacgtctncaggggcacctgccactgctcctgctcttctcagcacctgaggcaagatggtgcttttctctcccggtaatgtacttttttattcctccatctgcagctggcctaatactttagtaaagg

SEQ ID NO: 5050 - DNA, 224 bp, Homo sapiens
atcatgcattgttgaggtggctgatgtctgacattacagtttccatgaacgtttattgtgttttaatttatttattaagatgggttctcagatatttatatttttattttatttttttctaccttgaggtcttttgacatgtggagagtgagtttgattgaaaatttaagcattgtttgcttattgctccagacattgtcaataaaagcattgagttgactgcg

SEQ ID NO: 5051 - DNA, 293 bp, Homo sapiens
tcggcggcggctctgagatgcaccctcatctacacgctctgggaggctgtgacgcagcgagagacgagcagtccgacagctcgacgacgcagatctcgtgattcgtcatcatgaccgagcatcactgacgtagagagtgacgtagtagagcaggtcgggttcaggttagcgaccccagagtacagtggctttgctttaacaaccaccattccgaacttcagcatggccacccttattggcctttccatcaaggtcaagcttcttcggtccttctaagcgtttcaagatgacgt

SEQ ID NO: 5052 - DNA, 245 bp, Homo sapiens
atttctgggagcactttgataaggacggctggtccctgtggtactcagagtatcgcttccctgaaggaacctcactcagacccttcattgagcttgcaatctcatcactggaattgttccagcgactggacaagctgagggaggatgccttcgccagtgtcatccttttttggaaccacatagcagctccatttcttggagtctgggtcttccgaggccaggagcttgcctttcgcttgatcgat

SEQ ID NO: 5053 - DNA, 329 bp, Homo sapiens
tgcggctggaggtggcagctgccccagggaccccagcccagcctgttgccatgtccctctcagcagacaaggttccaggtcctcctggcagaactgaagcaggcccagaccctgatgagctccctgggctgaggagagggtgttccaggcctgtgtggagcggcctgcccgtatgagtacgcctctgactgctctcgggaggcagccttggtctaggatgctgaggccttgccggactttggctccagatcccagctgcctaatttcttcttgaggaacttggctagggttcctaggaccttcccagcataccttccttccttgaagca

SEQ ID NO: 5054 - DNA, 240 bp, Homo sapiens
ctgggaccgccgttcagtcgccaatatgcagctctttgtccgcgccaggagctacacaccttcgaggtgacccggccaggaaaccggtcgcccagatcaaggctcatgtagcctcactggagggcattcccccggaagatcaagtcgtgctcctgcaggcgcgccctgaggatgagccactctggccagtccggggtggagccctcactacctggagtagcagcccgatcgttgaggtaa

SEQ ID NO: 5055 - DNA, 227 bp, Homo sapiens
gtctttgagtggacgtgctaatcctttctgtttgtttctttttcttctaacaggcccctctgctgccagtctgctggtgtttgctggaggtcccctcctgaccctgttttcctgggtatcaccagttggaggctgcaaagcgaaaagattgctgcttgttctttcctctgaggcttcgaccagcaggaacctgcagatgccagccagagctctctgattaggtgtct

SEQ ID NO: 5056 - DNA, 114 bp, Homo sapiens
gttttctgaggacgtccgctggaccaccgcgttcacgccgcatcattggtgccgcgaaagcatttcgaaaattcattgacgaattcaaaggttggacattcgctttccacagag

SEQ ID NO: 5057 - DNA, 247 bp, Homo sapiens
cggcgccgctccgcttgcaccgcgctcgctccgagtgtcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtagaggggaagatggtcagtaggacagaaggtaacattgatgacttggttcattggtggaaatgcctcg

SEQ ID NO: 5058 - DNA, 214 bp, Homo sapiens
aatggaatgcaattaagggaagagaaataacaagcttataataaggttcagtatgaggtattcaaaatttaattagtatttttttaagtaattgtcaagactcacaggatgctgtagcaacaatagactgtatacaaatggggtggcataaataaatgtctttataatctacacaatcaccagtggtgtgccttttaaggcaaggtgccatttt

SEQ ID NO: 5059 - DNA, 241 bp, Homo sapiens
tttaatacctttctaggaggtgtcacaatgtagggtaccaagggttggatgtgatgggcatggtcgtacactgctcattgtgccacaggtgtgactggaagcatgatattctaggggttggtttgtagattcaaataatccagagatatacctaataagattgagtgaaaatttgagtcaatatctagggcattcacagagtagctgtgagttcttggtaatgtaaaaaaggccttgtttt

SEQ ID NO: 5060 - DNA, 198 bp, Homo sapiens
cttatattaatccatgccctgtacctgtgcacgttggactttaattactggggtttttctaagaaggaaattgtattatcaccagacattttaaggacagttagttycctcacatgatcatacacattcatcatcattctcattctcattttttaaattaaccggcgtacctcargatcctgattttggcttgtttgg

SEQ ID NO: 5061 - DNA, 183 bp, Homo sapiens
ctccatgtacattgtagcattattcacattagccagataagaattacatgtcctcttacagatgattggatattgaaatattatatgtgtgtatgtgtgtgtgtgtgtgtccacacactggattttattattccagtctaaaaggatggagtttctctggtgtggtcacacaacatattattc

SEQ ID NO: 5062 - DNA, 230 bp, Homo sapiens
ctcgcctttgggcgagggaattgtagcttgctgtgccctgcctctgaatgggacgtggtggtacagtagctgggattacagtcatacaccaccacgcccatccaatttttgtattttgagtgagagatggggatatcaccattgttacatacaggcctgattcttgactctcctgaccctcaggtgatctaccccccctaaaccctcccaaaggtttggggtttacaggg

SEQ ID NO: 5063 - DNA, 215 bp, Homo sapiens
atgtttttggatgcattatctgcaagtactagagttgtaagatatttctcctctgatatattatttcacagtgaaattcagtatttatcactaatgtatgagcaatgatctttatcatttcaaggcacgtgaaaaaattttttagtatgtccatttaatatagaggattctccctcttggacataggatttgggagtacagcataggataagaag

SEQ ID NO: 5064 - DNA, 119 bp, Homo sapiens
catttgagagtctgttgtctctctcatctctgcagttggtcgaaggtttttaaggaatatcatcatttagggtagagatatctattgggggaagatccactctatgagatctaattagt

SEQ ID NO: 5065 - DNA, 120 bp, Homo sapiens
tgtatctgttgtatgactccatgagtccacagaagcactctatttggttctgtgcatttaaatgcgtgcagaggtggcaataagtggggggagtttttttttggttatttggtttttttg

SEQ ID NO: 5066 - DNA, 140 bp, Homo sapiens
atatcagtgttagtacatgctggccattcagctcaagtagtgttactacctctttgttcttggggattagagttatgattccatgaggattttgggttcagtaccacaatcctttccaggaaaatatgcattatggacta

SEQ ID NO: 5067 - DNA, 220 bp, Homo sapiens
gctcggtgaagctggttgtccgttacacaccgcgagtgctggaggagatggaggcccggtttcgagaaggatgcgctctgcccgccggcgccaccagcatcagagctactcgtcctcggagtctcgaggttaaaaccacagatctggacgttacacgtgcactctctcctgctacagtattaattgttcctggcacttatttaaaggatattgcaccctc

SEQ ID NO: 5068 - DNA, 134 bp, Homo sapiens
tcgatcagctggcgacagagcggactctctaaaataatagtaatagcagcgcgtagtcacgcttatccagtcttggggccagcggcagtcatctagtcagggttaccacctcccacatgtacccattctctata

SEQ ID NO: 5069 - DNA, 349 bp, Homo sapiens
ggagatccggccagagggcaatagcaggttcacgtacacttcccttgaaggatgggctgcacgaaaccataccggttaagtggggcaagactgtttatcgagtaccggtcacagaagacctcacgcctccccatcattgacattgcaccatggacataggagggccgagcaggaattcggtgtggacatagggccggtctgcttcttgtaaaaacctgcaccccagaaacaacacattcgttgcataccaaaggacccaggtgctttccatctcagtcactctaggactctgcactgcattggctgacctgacctgatgtcattcatccaccttctcacagttcgggct

SEQ ID NO: 5070 - DNA, 105 bp, Homo sapiens
gcctctaatcccagctactcgggaggctgaggcaggagagtcacttaagacccaggaagtgggaggttgcagtgaggccaagaggtacaccacttgactgcacgc

SEQ ID NO: 5071 - DNA, 105 bp, Homo sapiens
gcctattgggtatttcttcgtgcaaaattatatttttccagattgattggtcccggggactactgcaaagactatagtttttcggttaaaaatgtacttttccgg

SEQ ID NO: 5072 - DNA, 351 bp, Homo sapiens
tgcctcctccgctgtctccctggagttcttgcaagtcggccaggatgtctcaggctgagtttgagaaagctccagaggaggttaggcaccttaagaccaagccatcggatgaggagatgctgtcatctatggccactacaacaagcacctgtgggcgccataaatccagaccgcccgggatgttggactttcagggcaagccaagtgggatgcctcgaatgagctgaaagggccttccaaggagatgccatgaaagcttacatcaccaagtagagagctaagaaaaatccgggatatgagagctggattggttctctccatgtgttatctaactgcgcaatgcttgttttt

SEQ ID NO: 5073 - DNA, 450 bp, Homo sapiens
gtgtcaggtaagtagtccaggccatgggtaagaagaaagtgttgggtcaaggtgcatctcaagggacaaggtttgttcatagatgtggacaaaaatatcagcatcagtgatgtgacacccagttccttggtggttctagaaatgacagctacactttgcacaggatcctaccaacaaggtggactcattggtgtcactgatgatggtgagaagtaccagattcagcttatgaaatgattggtagactggataggcagatcagaagatcaaagagtgatcgacctgcctctagcatccgagctcttcaaagcactggcattcacacccaagggattcttcttgaagagctttggcctggctttgctaataaagggctttgacctaatatgctttgctcttatgacaaaatcattgggattcttattgagaaagcctacttcactcacggaa

SEQ ID NO: 5074 - DNA, 218 bp, Homo sapiens
gaagaaagcagcgtaccaaggaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtacaaataaataagatcagactctgaaaaaaaaaaa

SEQ ID NO: 5075 - DNA, 135 bp, Homo sapiens
attgtgaccaggacagatgccttccagggtgcctgagctttcggtcacttggcacgagtacttgccaggtcaagccggggacacctggttcagccttagcagtggccgtggaccttgccaaggttgggtaagagc

SEQ ID NO: 5076 - DNA, 164 bp, Homo sapiens
cccccattcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggactggt

SEQ ID NO: 5077 - DNA, 277 bp, Homo sapiens
cccaagattgttgaggtgggtgtgatagtcttcaggtgcagtgcgttcattcactaacgctcactgtcagtgcccatgtttgctagctgcctccatgtgcactagtgagctgctggtgaaagtcgtgtgcaaatcctgtacactgtgtatagaacaatgtaattttatgttaattggttattactttaaaacatatctaccatctgattggctggtaccgagagctgtgggtaaaatttgaaattgtatttagattaagaaatttacatttaaacct

SEQ ID NO: 5078 - DNA, 178 bp, Homo sapiens
gaacgtctgaggttatcaataagctcctagtccagacgccatgggtcattttcacagaggaggacaaggctactatcacaagcctgttgggcaaggtgaatgttggagatgctggatggagaaacctgggaaggctcctggttgtcttaccaatggacccagaggttctttgacactt

SEQ ID NO: 5079 - DNA, 135 bp, Homo sapiens
tgcacggccgcaacaacggcaagagctcatgactgtgcgcatcgtcaagcaatgccttcgagatcatacacctgctcacaggcgaggaccctctgcaggtcctggtgaacgcatcatcgacagtggtccccggag

SEQ ID NO: 5080 - DNA, 100 bp, Homo sapiens
gggctaatgtaggaaatggtagcagttcataaacactacttattgttcatcacttcagatgtcactaggcttatgtaaatgaaacccgagatatttggct

SEQ ID NO: 5081 - DNA, 145 bp, Homo sapiens
ccaccgcaccaggttcaaggcatttgttctatcgggactacattgccacgtcggtcttgggtttaaggtctccaaggagttggccaccgcatccttgggccatcatcctggcaagctctccatcgtgcccttcccaaaggctact

SEQ ID NO: 5082 - DNA, 266 bp, Homo sapiens
cagaaccgcagctgtgggaagagccatgtagggaggctattcccaggcatacacttccactgccttcagctgacgtcacagctgacaaatcatctcctgtatcggagccagaagacttcagctccacaaaatgaagtgttctgtcctgaaacattcttgggaggatccaacatcgagaaacggtgtcctgtgagttccacaatgcttcttgttcatgggttcttccgtatggagtggattaagagtgttttattttgttgtctact

SEQ ID NO: 5083 - DNA, 288 bp, Homo sapiens
gcacagggaaggcagctgggccgtttctgtctgtgtcccatcctgctgtccttctgtcctggatgtttcatgggcccggggcccccagggaagcttaccctcctgtgctgggtggaggccacgggacacctcaggtgccacccaccttggccctaaaacagccaccaggaaagcagccggagagccggacagcgggcagcctgtctgggttcctgaggcctcggggtggcagacgagcccacgcggccgtgtcccagcagcagggttgttcagtcggagcatctgggg

SEQ ID NO: 5084 - DNA, 294 bp, Homo sapiens
ctgccttctttccttttgtgaggttcccaatgtctcgtccagaaaagtactttatttatgcaagtcaggtgactcttaggccacaaaaccatttgatgattaacagattatcattaggtgcatatcttcattgatattttgtgaaatgttatgcctatgttgcaaaagttgaatagttttgtctttatatattgctgtcttcagtgtacagcatggttttacttaattgaatgttaatgtttaatattttcttcttatagaggagatcatgccctcttgtatgacatgttttag

SEQ ID NO: 5085 - DNA, 225 bp, Homo sapiens
gagaatatatggtttgtagggcatgactccctagactccttaggtaggaatttgggcaagataaaaaatcagagcttagtcctcaaaaatattctaaaaataagcaatattttattcctttgtcgaaggcccattttcacattataacaatataaatcttattgcagggatatttcattttgagatttaacatacttccttagaatgaattaaatgtgcaacatt

SEQ ID NO: 5086 - DNA, 296 bp, Homo sapiens
aatcaacaccctcctagccttactactaataattattacattttgactaccacaactcaacggctacatagaaaaatccaccccttacgagtgcggcttcggccctatatcccccgcccgcgtccctttctccataaaattcttcttagtagctattaccttcttattatttgatctagaaattgccctccttttacccctaccatgagccctacaaacaactaacctgccactaatagtatgtcatccctcttataatcatcatcctagccctaagtctggcctatgagtgactt

SEQ ID NO: 5087 - DNA, 291 bp, Homo sapiens
gtcaaatggcggtcttatagtttcaattctgaaaatagcaaacttaataaacagccactttaaacttgttctggcaaaccagaccctgctgtagatatagtctaaggtagttaaccatataagcctcttcaactcttaatgccctccacatgaatcagcagttaagagggttctagaacccatgaaagcttttgtatgtattactaggtgttgtttttctcatgtttgctgattttacagttctgactaagctgacctcaatggatcagtttatgtgtaatattctggtgc

SEQ ID NO: 5088 - DNA, 400 bp, Homo sapiens
gcgcaatctcagctcactgcaacctctgcctccagagttcaagcaattctccttcctcagcctcccaagtagctgggactacaggcacccaccacctccattgtctttttactgcccaaggtaaaatcctgtgactgtgtactggatctgggctgcggttgtcatatttattgatctgaggtcaggcagtgtttttaaggtatatgaggtagtagtgagaattgaaaaggatattttacaaccaaatacaggtttctggtgtcttttgaaaatcaaagattggcactcgactaggctccgcaaaacacagtagttggagctgagcggagcagactacaatcacgtggccggcaccatccacactcgtgctctgacagacagtcatcatcatgctgcttta

SEQ ID NO: 5089 - DNA, 360 bp, Homo sapiens
gattttacatatccttggatcaatcagagattcagttgtggaaattctttttgacaagataatgaagagcaatcagttgccactttaatattggattcccttatacagtgtccgatagacaccaggaagcaactagcagagaattttgtagtcataggtggcacttctatgttgccaggatttctccacaagattgcttgcagaaataaggtatttggtagaaaaccaaaatataaaaaggcacttggcactaagacatttcgaattcatactccacctgcaaagctaattgtgttgcctgttgggaagggcctattttgggagcatacaagatatacttggaagccgttctgttcaagg

SEQ ID NO: 5090 - DNA, 266 bp, Homo sapiens
cctcacgcagcatggttaacgtcctaaaaccgccggactttctgtaagaagtgtggcagcaccaaccctataaagtgacacagtacaagagggcaaggattctctgtacgtccagggaaagcggcgcttcatgacaggagcatgcatggttatggtggccaactaagccgatttccggaaaaggtcaaatcacaagagatgtgtcaaggtctgagtgcctgagcccatcgcagattcaggaatgtccgtctttaaagtagcagctt

SEQ ID NO: 5091 - DNA, 320 bp, Homo sapiens
gctggtagagcattggttatagtcatgggaaaggaaggtgtccacggaggcacacttaacaagaaagcatatgaactcgctttatacctcgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccatggatcattgtatgttaccactgtatgtaccaacccttcatctcggcacaaaattccaggccaataatgtttgccatgag

SEQ ID NO: 5092 - DNA, 341 bp, Homo sapiens
gggtttcgagcttctgcctcaggcatctccgcgatctcctctcccctccaatcctatccgtgatggacgatgcccacgagtcgccctccgacaaaggtggagagacaggggagtcggatgagacggccgctgtgcccgggggaccgggggctaccgacaccgatggaatcccagaggaaactgacggagacgcagatgtggacttgaaagagctgcagcgaaggaaggcgagctcgagagtaaggatgtctcagatttaacacagctgaaagggaggcctcatcattacttaatcctgcagccaaaaacctgaaaataggtaccaaaaaaaaaaaaaaaaa

SEQ ID NO: 5093 - DNA, 340 bp, Homo sapiens
cgcagagggaggggaggggctgagctgtgaggagagcggggcccaagaaccatgtctacgcgggagtcctttaacccggaaagttacgaattggacaaaagcttccggctaaccagattcactgaactgaagggccacaggctgccaaagtgccccaagatgtcctgccaaaattgctggaatctttacaggagaaccacttccaagaagatgagcagtttcttggagccgttatgccaagcgttggcaattggaattggatactctgtcattcctttgaggcacggtgggctttccttggttcaaaccacagattacattacccgttcgtaggcggccc

SEQ ID NO: 5094 - DNA, 304 bp, Homo sapiens
caggatcgcggtcctgtagcctttttgtcaacaacttgaccttactgtttaagctggcattatgtctccgtgcagtggctgctgctgccctaatacttttagaggcccttaaaatcacatactatgctcaactcactctctacagctctcataactgccaaaatctattttcttcctcacacctgacacatatactttctgctccctggctccttcagctgcactcatgctttgttgagtctctgcaattaccatttttcctggcccagacttcaatccggcctccacaatattcctgataccc

SEQ ID NO: 5095 - DNA, 307 bp, Homo sapiens
ttccgttgcagtcctcggaccaggaccttggcgtggctagcgagttatggcgacgaggccgtgtgcgtcctgaagggcgacggccagttcaaggcatcatcaattttcgggcaggagggaaggtattggaccagtgaggttttggggaggattaaaggccttgacttgaggcctcaatggatccatgtcaatgagttggggataatacagcaggcttgcccagtccaggtcctcatttaatccttttcagaaacaaggtgggccaaagttgaagaggcgattttgggattggcatttgcttctccaa

SEQ ID NO: 5096 - DNA, 154 bp, Homo sapiens
gcgggagaagcccggcagtttgaagctgcttctcgatttgcattcaatatgaaaatcacctcgggagctggtaaaaggaggcctaacccctgttctttagatttacagtccatgcttcactcagccattttacctcacccccaaaaaaaaaaaa

SEQ ID NO: 5097 - DNA, 316 bp, Homo sapiens
tttctgaccagaagaggaatagatgagatgagaattaccacaactttctttgaacagtcagtgattttgggtccagcaggaaagcctattgaaacccgagatttctttaaaattccaaaattctggagatttgtgataacgtgaccatgtattggatcaatcccactctaatatcagtttctgagttacaagcctttgagggggggggagaagttcttccatttcctgccaacggaaaaaaagggtttgacaaaatgaacagtgggtggtcctcaagttgaagtggagagcccgtccgccgccaagcagttgggcg

SEQ ID NO: 5098 - DNA, 296 bp, Homo sapiens
ctcgccctttggtctgttctacccctgctccagcttgccctgctcgtcctgatcctgtgatttctctgtccttggctattcttggcagggagctggaaaccttctgaggatttctggcctccccctggtttttagtttaagggaacacaggacagcagaggatcccttttgcaagtgggaaaccaaggcagactgagggacagggggagcagagccataagatggtaaagggcctcaagaggagatttggccctcctcccctattaggactaataattgattataaaaaaaaaaaa

SEQ ID NO: 5099 - DNA, 296 bp, Homo sapiens
gtggccgggcgtcgctcctcagcgatgtgcagcccgagcatgctctcgccgtccgagtcgttattgtggcgctgaggctcaagtccaagtatcttcagctcaagaggaggttagaggatgagttccccggccgcctggacatctgcgcgagggactcccagccaccggttctttgagtaatggtagccggaagttgattacttagagaaggcatgctacgtgacaagaagcagttttgagtggtcgcccctcaagccccttgtcagttattcgccgaggcagttccggacttgccc

SEQ ID NO: 5100 - DNA, 311 bp, Homo sapiens
ccccgcatgagtcaaatgaagacccgcacaatccttggactccagcgccccacttaatgaggaaagggaggcagagggagatccccaaggccaagaggccaacctcactgaaggaggattattttgaaagacccgggcaagagagaaagcagcgtctccaagaaaatgctgtgagtccagcttttaccagtgatgaaaaaaagatggagagagtggtggtaatgaccagtttccgaggcaggcagactgtaaggcccagagggattgacgaacctatctccctcttcggttgaggaaagtctaaggccccc

SEQ ID NO: 5101 - DNA, 185 bp, Homo sapiens
cggcacgagggagatggtaggccttgtaaattgacagagaggggaacccgtaaggtggttggttgcagttgtgtagtagttaggactatggcagggagtctcagaccaggaatgtcattgaggagtatttcaaatgcaggaaatgaggagtaaatctttggctcacacaaaaaaaaaaaaaaaaa

SEQ ID NO: 5102 - DNA, 205 bp, Homo sapiens
ccactccaccttattaccaaacacccttagccacaccatttacccaatataagtgatatagcgcgtatgagagttttgaacccctgcgcgcatataagtatatgatgtgccccgcagggcgagagatgagaattatatacccagcgcatatatatggcagggctctacccctcatatcctcctcatatattgatttaacctggaa

SEQ ID NO: 5103 - DNA, 135 bp, Homo sapiens
cctgacatcattagaagcatgccagaaccagactcggtgataaagtaaaccttttcacctccaaaatttacacctcgcaaacctctaaacctgcaaaattttcctttattaaaatttgtcttgttttaaaaccac

SEQ ID NO: 5104 - DNA, 114 bp, Homo sapiens
ccgggacgggggtgggatggggtaagggaaattaatatattttagatatcacgctttagaccacagggagcccccaccccccctccccgctctctctcctcgtggtcgctgtcg

SEQ ID NO: 5105 - DNA, 123 bp, Homo sapiens
gtttacagaaaatcttgtgctagatacttttaaaggtatttgataccataaacctgcttttttttccagaagtatccaccacctggtctctcaataatctttgagactaaaaaaaaaaaaaaa

SEQ ID NO: 5106 - DNA, 357 bp, Homo sapiens
cagttgtgactgtactgctaggagctcctgtcaccacgagacagagtgcatgataacagtataagaagctcatttggcacacctaaaggccaacccttttggagtgctctcatgcaaaaggaatcgtgctgtaaaagtaggagttgaagccaacagccaagttctgccattaggaggtgtgtagggtcagctgatcaggattggcaggaaatcacagcctttgtacccatgacggtgctggactttttgaggaaatgatgagtctgtgctggattggtcgcaaggtcatctgtggtatattcctggagtcgctttaggtagtcaagtagccatgttctttttggccttacaaggcag

SEQ ID NO: 5107 - DNA, 163 bp, Homo sapiens
tctggtgagcctatgagaggcgcctcttggaatgacagtgataagagtgatgatgatattggggtacagcctttgaaataacaggatgtctagccgttccgaagtgggcaaggtgtgaacaggtggatatgcagagcgggaggttaaggtcagggagagaagg

SEQ ID NO: 5108 - DNA, 183 bp, Homo sapiens
  misc_feature 122: n = A,T,C or G
tcatgcattaaactgagaatgaagatcattgatagccatagcttttctattctacatggtcaaggcgtagttgttgttattaggtcctagctcttttcttactctcaaggttggaacagatnttggcaggatcttttccccacaggtcttttctaggtgtttgatggtaggctcaggggggtt

SEQ ID NO: 5109 - DNA, 210 bp, Homo sapiens
ggtagtgtgttctgttggctttagctctgtggtgcctgaggcaattaagaggaaatggaaattttaatttgagtcccagaacctagtgattttttttagatatggaatgaggggtaatgacatgcttccatattgagagaccgggtttatttgagtgctaccattgtggagagagagattttttaaaccacaggaggattaatgaggagg

SEQ ID NO: 5110 - DNA, 153 bp, Homo sapiens
attcagatgaggggaccatatgatttgtttttgggacagcaagagggagctcagagacagtctcatttccaattcaaggctttattggggggaggaggtcccagggatagttaccaagaaaagggagggctggcctcattccagacacttggc

SEQ ID NO: 5111 - DNA, 146 bp, Homo sapiens
cgggcatggtggcgcgtgcctgtgatcccagctgctcaggaggctgaggcaggagaatcgctttggaccctgggaggtggaggttgcggtgagctgagatcacgccattgcactccagcctgggcaacaaggcgaaactttgtctc

SEQ ID NO: 5112 - DNA, 235 bp, Homo sapiens
cactttgcattctgacaagcgtatgtagtgacatctcaatgtggtttaattgcatttctttaatagctaatgatgattaccttttcatctgcttatttgccatctgtaaatcttcagtgaatgcctcttcatgtttttttgctcattttctaggtggatttgttttctaatgtttcttaccttttctacctgcttaggtaggtactcagtcattaatttattttagctctcttaa

SEQ ID NO: 5113 - DNA, 335 bp, Homo sapiens
gacatagggctagttcttttcctgctccttatttgtccttcctagactatagcacctgctgggtggcccttgctctattggctccagctctcactagaaaccggtactattccttccttgccttcccttaggatgttaacagcttctactcttggttccttgactggccacaactctgcagtagtgccttcattactgtctcttgaaccacctcagctagatctgtcttcccgctggggcccgaaccatatgcacctttccacatcaccctaatctgcaaaataaatctaatacccagggacgtggggcctaaatgtccacgtcataaatcattg

SEQ ID NO: 5114 - DNA, 275 bp, Homo sapiens
ggcatgatttatgattcctgattatgcaagaaaatgaacccaaacatagacttgcaagacatggcctgtatgagaggaaaagacctcaagaaagcaacgaaaggacgcaagaacagaatgaggaagtcaggggactgcaaggccaatgttggtgctggcaaaaggtagctggagattggatcacagccgaagagtaaaggtctgcaattatgttagctgtggcactgtggattttcgcaggacattaataaactaaaacttcatgtgaaaaaaaa

SEQ ID NO: 5115 - DNA, 300 bp, Homo sapiens
aacaggttgtataaacctgtttcttatactttaacaaaataatttccaagtgtactatgcgatttttaattctagaaggttttctattaaaatgaaaatgaaatgtatgaaatctgtctcttattatttcagtcttctataggttttcgagtgtaaattagggagaaatgcagaataatttaaaattaaagttacttatagagaaagctgaatagaaaataatgtgtatatagcatttgttttcctagaataaagtaagcacttatttagcttttaggttcactatatcccttctcttga

SEQ ID NO: 5116 - DNA, 265 bp, Homo sapiens
taaaggtagaactttttttttttaagttaaagctattactagtaaagccaacgatgtatctattatttttagttgtacacttcgctacaggttttaagtcatatttaaaaatattttgttatgtcttcagttggtactttagttgcctgatagttagcgtgattcaataagttaataagtcagcaaatatttattgcctacctcctagtactggggacaaagccatgaacacagagtccgtatctaaaggtgtaacattggatgg

SEQ ID NO: 5117 - DNA, 240 bp, Homo sapiens
gacgagtccaaccatgaccctcagtttgagccaatagtttctcttcctgagcaagaaattaaaacactggaagaagatgaagaggaactttttaaaatgcgggcaaaacttttccgatttgcctctttagaacgatcttcccagaattgaaggagcgaggcacttggtgacgcaagcttccttaagcacaaggagaaaggggccatccgccttcctcatgcggagggacaagacccttaa

SEQ ID NO: 5118 - DNA, 240 bp, Homo sapiens
ttaagaagcagttgttttattgtcaatgtttttttttccccaagcatatttcttgtatttctgtttccatatatatatatatatataaacttcccaattcaggatattgcccccgccatccatgaaaactgttctggcaccaaagtaatgacaatgttaagtgttaattatagaaaggtagggcaaagggcctttagctgcagtttttacatacctggataaaacattaaaacatctttg

SEQ ID NO: 5119 - DNA, 260 bp, Homo sapiens
cttaagggacaaacttgaaaagcctgttcttcagaaggtgagtggttgagggaggcagtaatatgaagtgactctgtgtattttaactaccagattttttatatttgccactgttaaatagttggagaggggaaattctgattaagcgaaagtggtatcatcctagggaagcttatttcagaacaagtctaatatttcagattctttctttccgcctgtatactctgagtgatgacttactgtaaggggggtatataacc

SEQ ID NO: 5120 - DNA, 315 bp, Homo sapiens
gagaactacaacacaaaagtgcagacttatatttgagaattaatgttaacctttgtgtctagtttgaagcttcttgtatttgtctaaaacaacaagccagaattttgtatctcctttgataaaaagtgtgtataatgtaaagtagttttgcatattctgtgctgcacatgggctgaatttttaaattttttttaaaaacttgaggcagaacctggtaatttgtgtaaatgacaagtgtaaaatcctaccataaaatgctaaaatatgcactgtttcaaataaaccaggaatgcggcattaaaaaaaaaaaaaaaa

SEQ ID NO: 5121 - DNA, 384 bp, Homo sapiens
ttgccatgttggcaggctggtctcaaattcctgacctcaagtgatccgctttccttggcctcccaaaagtgctgggattacaggcatgagccaccacgccccgctgatttttatgtttcctaagtctcttttaatagtttcctcttcctttttttgtttcaaattatttaagaaactataaaatttgtcctcagaattttccgtaatctggattttagtattgttttgttgttgttgtttgaagcagagtcttgctctgtcacccaggctggagtggagtggcatgatcttggctcactacaacctccacctccaaggttcaagcaattctcctgcctcagcctccatgtagctgggactcaagcatcaccaccacgcccgcta

SEQ ID NO: 5122 - DNA, 320 bp, Homo sapiens
tgagacttctccgccgcctccgccgcagacgccgccgcgatgcgtacgtcgcctcctacctgctggctgccctaggggcaactcctccccagcgccaaggacatcaagaagatcttgacagcgtgggtatcgaggcggacgacgaccggctcaacaaggttatcagtagctgaatggaaaaacattgaagacgtcattgcccaaggtattgcaagcttgcagtgtacctcctggtgggctgtagcgtctcttctgcccagctctcagccctctcttggttctgccctcctgcagcagagagaggaagatagagaggagag

SEQ ID NO: 5123 - DNA, 375 bp, Homo sapiens
tcagaagccctttccagaagaggctggtcttcaagaagtctcgtttcttgccctgagtcagtttcaggggaaggatgtgaaatttttccgtgtagaggttacagccttttatgctgttgagctcccaggtaccaaaaagcttggccaacgcttgccagccagccagctgcaggtcgcatctgccaggaagggaggcgccacctcgccaggccagcagggcgtcgtttgttgccattttgttgacgttatgggttatgggtgttctggactgtcttgtgcattcgttgctgttgtgtacctactgtcccatgtccaccacgtctacgcattaggaggacttggtagacggcctaccctctgtttcctccagcaggc

SEQ ID NO: 5124 - DNA, 215 bp, Homo sapiens
aggacacattttcatgccttctctcacagggctctgcggctccggttcacttctgtgtctttacactcccttcacagagacacttgctccccttctctcgttcttggcatcccctaggaccttgcacacccaggtcttctggacttctggacctgcttcttaccatgccgtcttaagcagtcaggagtggctgcctgggtccggtcctagttaaa

SEQ ID NO: 5125 - DNA, 230 bp, Homo sapiens
ggcaaggtctggcagacgttctaggacagtgcacgcaggtcgcgtgattcatggacgacacgagccgatccatcatccgcaatgtaaaaggccccgtgccgcgaggcgacgtgctcacccttttggagtcagagcgagaagcccggagttgcgctgagcttgctgctcgctgggtctagatgtcgggttcgccacttggccgatgggaatggtctgtaaagtctcctcct

SEQ ID NO: 5126 - DNA, 230 bp, Homo sapiens
ggaacaggccactaaatatttgatgatgtatgatttcaaatacagtgaattcctgggagtcatcaaagaagaccggcattttatggttgtttttattaagtgtatatcctttgctcctggaaatgttattaaataattggtttaggccgggcgtggtggcctcatgcctgtaatcccagcactttcaaaggctgagcgaggcagatacctaaggtcaggagtcgaaaccc

SEQ ID NO: 5127 - DNA, 230 bp, Homo sapiens
ctttgtgcgcccctgctgaggagcagccccaggagggaccagagggatgctgtgtcgctgcctgggatctcggggttggcctttgcatgggaggcaggtgggcttggatcagtaagtctggttccggcctccctgtctagagaggaggcaggagccccaggccggcttgtgtttgtcatgcacagaaacttgtgtggggtccttggtaaaaacggtattggaaaaaaaaa

SEQ ID NO: 5128 - DNA, 205 bp, Homo sapiens
cggcgcgtggtctacgccgagtgacagagacgctcaggctgtgttctcaggatgaccgagtgggagacagcagcaccagcggtggcagagaccccagacatcaagctctttgggaggtggagcaccgatgatgtcggatcaatgacatttccctgcaggattacattgcagtaaggggagtatgccaggtacctgcctaacgtgc

SEQ ID NO: 5129 - DNA, 230 bp, Homo sapiens
gacaaagtagataaaccacaaagatgggaaaaacagagcagaaactggaactctgaaaagcaggagcacctcttcctcctcaaaggacgcgagttccaaccagcaacggaacaaagctggacggagattgactttacggagctgagaaaggacttaagacgattaaattactccgagctcaggaggaaattgaaaccaaggcaagaggtgaaactctaaaaaattggaga

SEQ ID NO: 5130 - DNA, 280 bp, Homo sapiens
gatgttcgtcgtggcacttgctggtgacagaaaaatgaccaccatgagcagctggcttcactgctcaggtgattatcctgaaccatccaggccaataaggcgccggctatgccctgtatggattgccacacggctcaacattgcatgcaagtttgctgagctgaggaaagatgatcgccgttctggtaaaagctggaagatgccctaattctgagtctgtgatgctgccatgtgatatggtcctgcagccatgttttgagagctctagctattcaccttg

SEQ ID NO: 5131 - DNA, 140 bp, Homo sapiens
tttcactcaggcctttgcctctaataatgctgaggtggctgatccttccattctgtcttcgggtcattctgtaggtcttctcctccactgtcaagtaagcaatcaggtccgtgacaggattggacatatgaccaattaag

SEQ ID NO: 5132 - DNA, 240 bp, Homo sapiens
agcttagtctgacataatctaagggtatggggcaaggatcacatctaatgctgtgttccttatactctattatatagtgtcattcatgattcagctgatcttacaaattcgtagcagtggaccttgaaatgcatgtggctagattatgctaaatgatctcagtagcatttagtacactcaagctttttttgttgtttctggcttaataaagcttaggattattgagagcaactgttaatt

SEQ ID NO: 5133 - DNA, 120 bp, Homo sapiens
gagcagatacattcactttcatagaggtttagtatgctggattctagttttagtttgtagtaaccaaatgatgtagacacgtccgtagtcccatttacccttgtcacgccttggcctgtg

SEQ ID NO: 5134 - DNA, 125 bp, Homo sapiens
gcaaaaccccactctgcatcaactgaacgcaaatcagccactttataagctaagcccttactagaccaatgggacttaaacccacaaacacttagttatcagcctaggcacccaatcaactggct

SEQ ID NO: 5135 - DNA, 250 bp, Homo sapiens
ggcgcgtggtctacgccgagtgacagagacgctcaggctgtgttctcaggatgaccgagtgggagacagcagcaccagcggtggcagagaccccagacatcaagctctttggggaagtgagcaccgatgatgtgcagatcaatgacatttccctgcagattacattgcagtgaaggagaagtatgccaagtacctccctcacagtgcagggcggtatgcgcaaaacggtttccgcaagctcagtgcccat

SEQ ID NO: 5136 - DNA, 363 bp, Homo sapiens
cggcagagcagcacctacgctggacagcaatatggagcggatcatgaagccagcacttcgggacaactccaccatgggctatatgatggccaaaagcacctggagatcaaccctgaccaccccattgttgagacgcttctgcagaaggctgaggccgacaagaatgataaggcagttaaggacctggtggtgcttctgttttgataccgacctgctatcttctggcttttccttgaggatcccagaccactccaccgaatctatcgaatgatcagctaggactaggtattgatgagatgaagtgcagcagagaacccatgctgcagtcctgatgagatcctcctctcgaggcgataggatgct

SEQ ID NO: 5137 - DNA, 316 bp, Homo sapiens
gtcgcggcgacatggccaaacgtaccaagaaagtcgggatcgtcggtaatacggaccgctatggggcctccctccggaaaatggtgaagaaaattgaaatcagccagcacgccaagtacacttgctctttctgtggcaaaaccaagatgagagacgagctgtggggatctggcactgtggttctgcatgagacagtggctggcggtcctggacgtacaataccacttcgctgtcacggtaagtcgcatcagagactgaggaggtgaagacagtagacgtctctactcttgagcattactggctatataatggtatt

SEQ ID NO: 5138 - DNA, 308 bp, Homo sapiens
gattgagctacttcaggacttaaaacaaaccttgtgctcttttcaagaaatagagatcttattgtcaaggttctacatcaatatcatccctgtcttattaggggattaccgctttcctaagcccaagagtcaatgtcaaaatttgcaatcaggctcaaaaccagagaccaggctgtgaaatccacacatcttttagacctagtcgtctctcttggcctcagcagctctcctgttcttactggttgacatttgatcactctttgcacatcttgtgtttttgctcatgtcacatccagcactagtatgct

SEQ ID NO: 5139 - DNA, 290 bp, Homo sapiens
aaaacacccaagccctcccaggaatgtcttgtgcacttccatagcacactatgttaactccatccaaccacatccacaatcctactcaacttgcatgtttcactgtctgtatctccgtctaggctgtgtgttccttgggaggaggactatatatggctcaccacagtatccaccatgcccagcacttgacacagatgtttgctgaagggaggggggttgaataaattaaaaatatctctacttatactcccaaatcatcttgaactggtctcattcttactaccaggacc

SEQ ID NO: 5140 - DNA, 303 bp, Homo sapiens
gccttgggtgccagctcagccacagtaggataaaacaccagatagattcaaggttctgactctaagccctggttgctggatggcatctatagacccatctgtggttgtaggggacttgtgaccgtgaaggggataacatgaacctagccagcctttgacaacttctgactgtagagcctagggccttgggcaaacctaggcagtagcaaggcagtgattactattggcttgggtgataccagtcctatactgcttcaggtctgtatacagtcagttccagtggtggtggccaagaggtctttg

SEQ ID NO: 5141 - DNA, 305 bp, Homo sapiens
gttcaactgagtttaataggggattaaaaaaacaagctgttaggttcatggcactggtctcatagggttctattggtgataactagctttaacatggggcaaggagtttgtgaatcagggagataggataaattaaaatttaaaatatatagaggagtcctctcgattgctcagcatgatgttagataaatgagttggtcagaaatatcagtatacgctgtttaccaatgttatttatttacattcttctaaggcattatgggtattgtattattggaggctaacctacataggtatcctgtccc

SEQ ID NO: 5142 - DNA, 258 bp, Homo sapiens
cagggggcaagatcctcactttcgaccagctggccctggactccctaggctgtgcactgtcctgctctccggtcctcgcaagggccgagaggtgtaccgcatttcggcaaggcccaggaaccccgcacagcacaccaaaccctacgtccgtctaagggccggaggtcgagcgtgccagagccgacgggcagacgaggttacaaaaataacactggatctactttttattaaaagatttttgtgaaaaaaaaaaaaaaa

SEQ ID NO: 5143 - DNA, 275 bp, Homo sapiens
gactaattgtcggtgttacaaaatggattccactgagccaccctacagcagagggatatgagggaattgttaagggaggcagcacttacattaaggaaattggctacaaccccgacacagtagcatttgtgccaatttctgggtgggatggtgacacatgctggagccaaggtctacatgccttggtcaagggatggaagtcaccctagagtggcaatccagtgacccacgctcttgaggctctgacttcatcctcacacttgtcacttacaggc

SEQ ID NO: 5144 - DNA, 316 bp, Homo sapiens
cttgactctagggcaggctagtgctattgtggtgtcagttgatatttagtttcatttgctgaaccccaaatttgagtgttagttaggggagcctccattctgtgggagagtgtggaaaggcactcttttttctccatattagttaacaagaggtgtctttaggccctggatgttaccatctcatttggtcaagcccctcatacctagtttcacatggatgctaacgtggatgtaatatagttgtgacagcctatgcacaaaagcattacctgatcttaaggttgggtatttcttaaccaaagttgacagactgtgc

SEQ ID NO: 5145 - DNA, 208 bp, Homo sapiens
gatcactgttttcttctttatactttatttttgacattcctttaatggacatgttattacttttataacaaaaattttaaggtttgtttctttttttctaactttatgttttgatataatctcaaatttacaggaaaggtttcaggacagtacaaataattttcatatactcttcaaattccctcaaatgtgcacattttgacacggg

SEQ ID NO: 5146 - DNA, 172 bp, Homo sapiens
ctcaagcccgccgacaagaacaaggggaagtacgggcagttcagtggcctgaaccctggaggccgacccattatcccaccccgcaattccgccaaagccaagaaatagcccccgcacaccaccctgtgccccagatgatggattgattgtacagaaatcatgctgccatgct

SEQ ID NO: 5147 - DNA, 132 bp, Homo sapiens
acctgcattttgggaaatattttcttaaatagagtgttaaattctactaggtgggtattaaatgtctcctaggtagatatttaaaagtacaaaagcagaatagcaccatccaggaaccttaatattttaggg

SEQ ID NO: 5148 - DNA, 147 bp, Homo sapiens
ctcaggcaggggtggagaaaaggcgttggtcgcagtgattggtgaacacagcggggggtgggtggtagcgctggggggtgattttatgtcaagcaagaattgggagaactccacggttgcgaaaaagaaaacctccgggtggcagtt

SEQ ID NO: 5149 - DNA, 160 bp, Homo sapiens
agtttatcagctatttacaaccttcatttcatcacaatctgtgggcttacaaaaaaacaaaaaccttttgtaggttttgtatgttactctatcttcttacctgatatcccatgatgatcccatggtaggtcttctcacctcggatggtgcataacaggat

SEQ ID NO: 5150 - DNA, 150 bp, Homo sapiens
cggcacgagcttgcggcccgtgtttgactcaactcaactcctttaaccgctaataatttccggcaaaaatcccattgctttggggttttgtgtcgtataacccttgtaaccggtttgcaaatccccaataaaaggatttaaaaaaggcaa

SEQ ID NO: 5151 - DNA, 158 bp, Homo sapiens
attggggtgaaatttgagattgtaggccaactgtattttcaagcttctgaacttaggcaaaatattcatcgcaaagtctctagcgtgcatattttttctcaccccaaattacggtttccacggggattattttatatatagttgggtctatctctgca

SEQ ID NO: 5152 - DNA, 113 bp, Homo sapiens
gttgggttccaagtctttgctcttgtgaatagtgccgcaataaacatacgtgtgcatgtatctttatagtagaatgatttataattcacttggggtatatacccagtaatggg

SEQ ID NO: 5153 - DNA, 138 bp, Homo sapiens
  misc_feature 90: n = A,T,C or G
ggtcacctcacctgcaaggctttgtggactctgcacaccgtatgacccccgggttttacagttttttagctgttgaattttggagagtgnggcactggggtgaaaagggtcggggggactgggctcttgttagtcaca

SEQ ID NO: 5154 - DNA, 124 bp, Homo sapiens
agtatttaggatgtatgcatgtctgtttatatgtaagcttggttggggctttcgcttttgtgctacccttcttgggtttttgtaccagagatgttctaaactgatgaaatacattgagaaggtt

SEQ ID NO: 5155 - DNA, 102 bp, Homo sapiens
ccaattcggcagagactgttcaaaaggaatgccccacaagtgttaccatggcaaactggagagtctaaatgttacccagcatgctgttggcattgttgttaa

SEQ ID NO: 5156 - DNA, 131 bp, Homo sapiens
ccaaagccactgcgagattccaaggagaagatttacaaagagcttttttttgttggctgagggaggtgtactgactttctgtagagaccacccataggcccctgtccctaagggcagttttggtggtctct

SEQ ID NO: 5157 - DNA, 130 bp, Homo sapiens
cggcacgagcttagctaccaaaatttcctggggccacttttaaacactaaacatttcatttatcctctaagctaaaatggggctgagttatttaaatctgaatgtaaaatgcattaaatctagcttgggg

SEQ ID NO: 5158 - DNA, 120 bp, Homo sapiens
  misc_feature 32: n = A,T,C or G
cttgtccaattcgcacggcctagttagaactnaaatgtaagtcctttgagtacagagatcatgaattacgaggtgtatatggtatatttgcttgggttgtcttcatgggagcatttcacc

SEQ ID NO: 5159 - DNA, 125 bp, Homo sapiens
gaatcgctttaacctaggaggcgaagtttgcagtgagccaagattgcgccacttcactacagtctgggtaacagagcaagatcctgtctcaaaaaccaaaacaaaccaaaacggaaaaccctttt

SEQ ID NO: 5160 - DNA, 123 bp, Homo sapiens
ggcacgagtwaaagttaaaaaagaacacacattttaattacagggttaaactttgttatactgaacaaggatggtgaaagcactgtggattgtgaatataggaaattgaaggttttaatctag

SEQ ID NO: 5161 - DNA, 275 bp, Homo sapiens
tcaggatagagataatctcctgaaaaacctgaatttcagagattcttagactggctgccaaaggatgaagctagtaaaggagaaaaagcttaaattccatcttgagctcttggattgtgataatacaatgagtttcataagcttttcatttctgtataacctgttcatttgggagtttaatggcttgacttctttgttcattttggatctaaacttctctgttctgtcttcccattcacatctattagaggactgcatcaccatttctttggccc

SEQ ID NO: 5162 - DNA, 148 bp, Homo sapiens
gagaaagcacataccaaggccaccacacaccacctgtccaaaaggggccttcgatacggggataattcctattttatttaccctcagagggtttttttttccttcgcagggattttttccttaggcctttttaccacttccaagcctg

SEQ ID NO: 5163 - DNA, 205 bp, Homo sapiens
ggcaatagcaggttcacgtacacttccctgaaggatggctgcacggaacataccagtaagtggggcaagactattatcgagtacccgtcacaggagacctcacggcttcccatcattgacattgcacccatcggcataggcagggcccgagcaggaattccagtgtggacatagggccggtcatgcttcttgttaaaacctgaac

SEQ ID NO: 5164 - DNA, 205 bp, Homo sapiens
tccgccacggccgtctttggagagcagcagccatggccctacggtaccttatggccgtggcctcaacaagggccacaaagtgcccaaggaccgtgagcaagcccaggcacagccgccgccgcgggctcttggcccaaccacaccaagttccgtccagggccatgtttcgggagtttgttgctttgccccgtccgacgcagcgcgc

SEQ ID NO: 5165 - DNA, 240 bp, Homo sapiens
accctgcagccgcagagatgttgatgcctaagaagaaccggattgccatttatgacctcctttttaaggagggagtaattggtggccargagggatgtccacatgcctaaggcacccggagctggcagacaggaatgtccccacccttaatgtccatgaggcccattcagtcttttaggtcccaggggctacgtataggacacagttttcctgtgagacatttcttctggcaccttacac

SEQ ID NO: 5166 - DNA, 260 bp, Homo sapiens
ggcacgaggtcctatttcgatgaacacgacttcgagccgtcggaccctgagcaggagacgcgaaccaacatgctgctggagctcgcaaggtcacttttcaataggatggactttgaagacttggggtttggtagtagattgggaccacaacttccttcaacagactgtcaagactatggttgagaaaccttcccaggacaaatcatcaagagctctcaaggctgagctcaagtgcccccctgtgtcttttgggaattgag

SEQ ID NO: 5167 - DNA, 296 bp, Homo sapiens
aaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacggacgcactcacagtcgcatcataatcctctctcaaggacttaaactctcctccc

SEQ ID NO: 5168 - DNA, 100 bp, Homo sapiens
ctcgtgccgaattcggcacgagggtcgatggagtcgaagcgctgaagggaatagggcggctttccttccagcggagcatcattcggctgttacccaaaac

SEQ ID NO: 5169 - DNA, 173 bp, Homo sapiens
gtttttttttggtggggcggggggcggtaatagggtctcgctctttcaccaggctggagtacagtaatgacttctaactgcagcctccacctcctgggctaaaagtgatcctccaacgtaaagcctctcgagtagctaggactacaggcacatgccaccaccaaagcccacgc

SEQ ID NO: 5170 - DNA, 340 bp, Homo sapiens
cacgaggcttcgggagccgcggcttatggtgcagacatggccaagtccaagaaccacaccacacacaaccagtcccgaaaatggcacagaaatggtatcaagaaaccccgatcacaaagatacgaatcttttaagggggtggacccaagttcctgaggacatgcgctttgtcaagaggcacaacaaaagggcctaagaagatgcaggccacaatgccaggccatgtgtgcacgtgccgaggctatcaaggccctcgtaaagcccaaggaggttaagcccagatcccaaagggtgtcagccgcaagctcgatcgactttcctacattgtccaccccaagct

SEQ ID NO: 5171 - DNA, 206 bp, Homo sapiens
acggccattgctctcaccattggggaatctgaagagtcttggggtatatcaagtccatgaaggaatcctgagagtggctacaggacttaaaaagctgaatcctaaggcttgttctctgagtaaaacatcctgttaaggcaacttacggtgaaggataccccgcgccccagagacactcgccctccatatccagaggtacacacgtg

SEQ ID NO: 5172 - DNA, 150 bp, Homo sapiens
ggaaagccggttagtacgcaaaggaaatgcatcctgggggtttggggctttctagaggccggggctcttggttgtaggatagatacttggggatggttcttgaaacatcagaggttaggccttgagccccaaatcttaggttcctaacta

SEQ ID NO: 5173 - DNA, 201 bp, Homo sapiens
agaaggccctgaagctgatggggtcaaatgaaggtgaattcaaggctgaaggaaatagcaaattcacctacacagttctgggaggatggttgcacgaaacacactggggaatggagcaaaacagtctttgaatatcgaacacgcaaggctgttagactatcctattgtagagtattgcaccctatgtacattggtgggtcc

SEQ ID NO: 5174 - DNA, 163 bp, Homo sapiens
gaagcatcgttaaagtctctcttcaccctgccgtcatgtctaagtcagagtctcctaaagagcccgaacagctgaggaagctcttcattggagggttgagctttgaaacaacttatgagaggccttaggagccattttgagcaattgggaacgctcacggact

SEQ ID NO: 5175 - DNA, 172 bp, Homo sapiens
gctacatgaccatcacctcggagcggaggtgcccgctgacgtgttccagatccaggcgacctccgtctaccccggtgcctacaatgcctttcagatccgtgctggaaacttgcagggggacttttacattaggcaaatcaacaacgtcagcgccatgtgtggtcctctgccc

SEQ ID NO: 5176 - DNA, 201 bp, Homo sapiens
ggagcgcatagtcagcggtgagaagcaacacctgagcctggttaacttagagccccaatccacctatcggatttgtttagtgccactggatgcttttaactaccgccgcggtagaagacaccatttgttcagaggccaccacccatgcctcctatctgtaacaacggcagcgaacacagacgtgccagccatgagcagacg

SEQ ID NO: 5177 - DNA, 222 bp, Homo sapiens
gctgtgttcactcaccaggtacctgcagaaggcctacagggtgccaggcacttctttaatgtgttctttctttatgtgattatttgattaatctctgcctcccccactagactttaagctccctgaaggcaagaatcctgtgcttatgctcaatattagctctcccttggcacagagtaggcactcaacaaatgctccccaaaaggctgtagtggctctact

SEQ ID NO: 5178 - DNA, 211 bp, Homo sapiens
ctcgtgccgaattcggcacgagctaggcctctgaggaggcgaatccggcgggtatcagagccatcagaacccccaccatgacggttggcaagagcagcaagatgctgcagcatattgattacaggatgaggtgcatcctgcaggacggccggattttcatttggcaccttcaaggcttttgacaagcacatgaatttgataccctttgact

SEQ ID NO: 5179 - DNA, 180 bp, Homo sapiens
acaaaaagtacctgatgatcggaagagtatttgaccaaagagcttctggccctggattcagttggaccccgagggacgagccgatgttcgtcaggccaggagagacggtttcaggaaggttcagaccattttgggaaaacttggaccaggaagccattgattttccaggtctaaggtcag

SEQ ID NO: 5180 - DNA, 111 bp, Homo sapiens
ctcgtgccgaattcggcacgagttgttccttaagtcagaacagcagacttaagctctgacaattctgattcgaatgacaactgttcagggattcggaatcctgtcgattag

SEQ ID NO: 5181 - DNA, 221 bp, Homo sapiens
agcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaagtagaaatttaattgcccaaaaaactgaagagtcagctgatgccagaggaaagccgaaatgctaca

SEQ ID NO: 5182 - DNA, 181 bp, Homo sapiens
  misc_feature 169: n = A,T,C or G
ccgcggcgcgccccctcgccaaaggtgggtcttccgggatccgtatcggtttaagaagcggacggagctgttcattgccgccgagggcattcacacgggccagtttgtgtattgcggcaagaaggcccagctcaacattggcaatgtgctccctgtggcaccatgcctnagggtacattcg

SEQ ID NO: 5183 - DNA, 203 bp, Homo sapiens
gggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagggccctgcaggttcctgggtccttcttccaaggaagggg

SEQ ID NO: 5184 - DNA, 140 bp, Homo sapiens
gccggctccagtcccggcaagccgccgcgcctggtgggaggccccatggacgccagcgtggaggaggagggtgtgcggcgtgcactggactttgccgtcggcgagtacaacaaagccagcaacgacaattaccacaagcc

SEQ ID NO: 5185 - DNA, 145 bp, Homo sapiens
ggcaattgccagaccttctcatcttccactgtcatctcctactccaatacgggtgatggtgcccccaaggtctaccaagagacatcagagatgcgctcggcaccaggcgggatccgggagacacggaggcctttttcgggattca

SEQ ID NO: 5186 - DNA, 185 bp, Homo sapiens
gccgcgtccagtcaaggaaactcttgagggaaattttgagtcactggaccttgcggaatttgctaagaagcagccatggtgggcgtaagtgtttcgggcaggaatctggacctccagcagaaaagtttagcgttggcaacccagcttttccattggaggtttcattggattggtcgcacaggttt

SEQ ID NO: 5187 - DNA, 140 bp, Homo sapiens
  misc_feature 45: n = A,T,C or G
tacatagtaggtatatatatttatgggttacttgagctattttgnatacaggcatggaatgaaccaataatcacatcaggggtaaattgggtatccctcacctcaaacatttatcttattttttagggtgagaaaattac

SEQ ID NO: 5188 - DNA, 172 bp, Homo sapiens
tagtccaagcgggaagccctggtgcggtgggcatgatgggtcctccaggactcctgggcccctgggtacccaggcaagcagggcccccatgggcaccctggccctcggggcgtttcctcgggatcgtgggaaccgtgggtcagatccgcaacacaggggcccaagggaaaac

SEQ ID NO: 5189 - DNA, 305 bp, Homo sapiens
tgcacggtgcagttgactggaacagaaaataaggcattattcatattatagtctagaagcatggtgtcaaggaaaggtcgcctattaataaaattttatgtggatttgaaatgtaattcttttgattcttaaagtgggaatatcattcttttagctacagtattagctactttaggaggcccaatacaattttgtgcatttcctactttttcctttcaccctccttggtccaaatgacctgccaaggattaaattaattctacctgtatagggaaaactctgtatctaatttcctatcttaatat

SEQ ID NO: 5190 - DNA, 270 bp, Homo sapiens
ctcagcccgactgacttgctgcgagtgctggtggagctcacagacggcggctggtggatggtggacttttaacctcactttccctatgttcagcagcacaaaggggaggaggccaccacatcagcccaggagccctgagccagcacaggcagtagggccactcactttggccatccgcacccaaatgcaatcaatcacccaagcttcgggagctaaccttaggtctcgtcaattaactgctaagagccatcaactggctaaagaagggtc

SEQ ID NO: 5191 - DNA, 339 bp, Homo sapiens
cgttcttggcgtcgggaccctacctgacccatcagcaaaaggtgttgcggctttataagcgggcgctacgccaccttcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttcctgactctcctgggggcacctcctatgagagatacgattgctacaggtcccagaatggtgcttagatgactgcatccttctgagaggcaatgtatc

SEQ ID NO: 5192 - DNA, 280 bp, Homo sapiens
gacgccctctcggggcctgtgccgcactagcctccctcttctctgtccccatagctggtttttcccaccaattcctcacctaacagttactttacattaaactcaaagcaagctcttctcctcagcttggggcagccattcgcctctgtctcgtttttgggaaaccacggtcaggaggccgttgcagacataaatctcggcgactcggccccgtctcctgagggtcctgctggtgaccggcctggacctggccctacagccctggagccgctgctgacca

SEQ ID NO: 5193 - DNA, 280 bp, Homo sapiens
tctacatataatatattcgatagaaatgaaaatcttccgttgaattaactaataaggaggaacaataaacttcatatttaggattcaaaggctataaaggataattttacaagatccccaatatcaacccccagttaaaaagtgttaattttaaaccaattttaaaccaaggcctttttaatttcaatcagaggagccaaacacacacttggaccatgtgtggatttcccaaaaaatattgaagggagatccccccagggacaacccactaattttaaaa

SEQ ID NO: 5194 - DNA, 110 bp, Homo sapiens
ctcgtgcgaattcggcacgggttcaaaaggcagctcttccggaagcttctccaaaaaaaggaacctgggtctaaggggtcctcttcttcctcttcgctgctcgctcgctc

SEQ ID NO: 5195 - DNA, 190 bp, Homo sapiens
ggttgctgccgaaatgggcaaggttcatgaaacctcgggaggttggtgctcgtcctggctggagttactccggccgcaaagctgtcatcgtgaggaccattgatgatggcacctaagttcgcccctcagccatgtctctggtggctggaattagcccgctacccccgacaaagtgacacctgccatgggc

SEQ ID NO: 5196 - DNA, 260 bp, Homo sapiens
ccaagaagacccgtgtgaagctgccctgcggctacaagaaggatatctctcaggcaacagagctggtggttggtgtggtcggctgaaggtcggccgattgacaaaacccaaccttaaggcttggccggggcgtacccacaatttatagggcaagaggggacctcttgcccacgagtcacgggggtgtggccatagatcctctggagcatccttttgagagggcgcacccaccagcatcatcggcaagccctacaaccatt

SEQ ID NO: 5197 - DNA, 255 bp, Homo sapiens
gttagtccaaagaggaacagctctttggacactaggaaaaaaccttgtagagagagtaaaaaatttaacaaccatagtaggcctaaaagcagccaacaattaagaaagcgttcaagctcaacaacccctaacctaaaaaatcccaaacatataactgaatcctcacacaccatttggcccatctctcaccctctagaggactcatgttaggggtaaaggaacacaggaacactactcctcccggataaagctccg

SEQ ID NO: 5198 - DNA, 215 bp, Homo sapiens
gacacgtactacgttgtagctcacttccactatgtcctatcaataggagctgtatttgccatcataggaggcttcattcactgatttcccctattcctaaggctacaccctagaccaaacctacgccaaaatccattttaactatcatattcatctggcgtaaatctaactttctttccacaacattttctctggctatcccggaatgtccccta

SEQ ID NO: 5199 - DNA, 210 bp, Homo sapiens
gcagttcttccccactgatgaggacgagataggagctgccaaagccctgatgagacttcaggacacatacaggctggacccaggcacaatttccaggggggaacttccaggaaccaagtaccaggcaattcttagagttggattacttcttttgggattggcccctcggctcacaattagggggactattatcatacgggtttttgtgtg

SEQ ID NO: 5200 - DNA, 250 bp, Homo sapiens
gaaaattactcagagaggaggactttctaattgtaggtcgggccatcttctttgttaccaagaacttccttttcaaagccaattggaacaggagccgggcttccaattttggtgttggtattgttgattgcttggcccacgacaaaagtgaagaaggtttaaggctttccgagagattaaggattcaaacatttccttacatcaccattgagggttcttgctgaaaattgagaggcagttatgtggtgga

SEQ ID NO: 5201 - DNA, 150 bp, Homo sapiens
aaaacctgggcctcctggtgatgcaggattgcaggggttaacaggtgtaccttggattccttgtgcaaagggtgttgcttggtaaaagggtaggacaaggtctctccaggaaggcttggtaagttgggaaatttaaggaaaacccgggcc

SEQ ID NO: 5202 - DNA, 235 bp, Homo sapiens
ctccaaaaatagatcctgaaaggcactttctgcttagggcaagcagtcatggaataagcatgtaaacaagctggcttctctttaccacaacagccaagtcagctttcttcattgccagccgaaccagctctttcccttccttcttttaaacacgaccaggccccctgtatggctaacccaaagggttttctgtacggcacacctggccctcctctgggatgctctggacatagtg

SEQ ID NO: 5203 - DNA, 198 bp, Homo sapiens
gttccggagagctgagcagtcaagatgtgtgacttcaacgaagaccagaccgcagagttcaaggaggcctttcagctgttttgaccgaacaggtatggcaagattcttttacagccagatttggggatgttatgagggcccttgggccaggaaccctaccaaggcgaaggtctcaaaggttccggggaacccaaagag

SEQ ID NO: 5204 - DNA, 180 bp, Homo sapiens
gaatgtgggacccagcccctctccagctcgaaatcggcagactaggatggaagttccctgttgagctttgggggcccttcaaaagggccaaggaggaaaccgaggccgagggacccaccttccaaattggctttaagctctcaattaacctcccttgcgccccttggaatatgcttggaa

SEQ ID NO: 5205 - DNA, 210 bp, Homo sapiens
gcagcaagagcaaggagaagaaacacatcttggtttggagaaaccatcaatggtggcttccatttcagctatggagattacaatcttgcttccaacaattccaacgttcagagtgtaaccttctaggctctctggttcaaggaaaggtttccaggaacatataactctacacattcaaaggacagagattgtctcatatctgacgcggag

SEQ ID NO: 5206 - DNA, 215 bp, Homo sapiens
cactgtgatcaagaattcggcacgggagaaaccctgtctctactagaatacaaaattgctggtgtgctgtgcatcctgtaatctcagctacttggaggctagacaggagaatccttaacctggaggtgaggttcagttagtcgagatcatgccattgcacttcaccttggcaacaagagttaacttcctcttaaaaaatattagagataaaaaat

SEQ ID NO: 5207 - DNA, 228 bp, Homo sapiens
ctggcccaaggtgccaccccctagcaccttgtcaggctgtcccttgctggggaaagtggcttggttccccatcttctcgccagctgctgatccctacacgggcaggacagattggcagcttcaaattagtcttgagcctctaatcttccattaggctaagcttgggtctctgtcgcttcttccccaggttccccttggtccccccccaatgggccttccctatgtgcc

SEQ ID NO: 5208 - DNA, 205 bp, Homo sapiens
ctgagaggagcgtggctgtctcctctctccgccatggcgtgtgctcgccactgatatcggtgtactccgaaaagggggagtcatctggcaaaaatttcamtttgcctgctgtattcaaggtcctaatcggccagatattgtaaccttgttcacaccacttgcgcgcaaaccaaccagagagcctaatgttgtagagtgattgggc

SEQ ID NO: 5209 - DNA, 217 bp, Homo sapiens
ctgttattctagagatttcaaaatgcatcttcatcttaaagtctaatgtaaatttgtattattttccacttcttgaaccaatgcaaagatctcagaatactgaggttaccgcctcctgatacacacactattcattctttaatcccatatgtatttggagcccagattttacttatcttatacagccaatgtttatttccaattacccacaaattaa

SEQ ID NO: 5210 - DNA, 323 bp, Homo sapiens
tcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtggcagggacggagccggactggacatggtaactcagtaccgcctgcagtgtcgccatgactgatcatggctcttgcatttttggggaaatggagactcccggatcctgtaagggtgtccccatgtctggaagaggagctggtggctccaccctgggccccgaaaaggctgggctttcccttt

SEQ ID NO: 5211 - DNA, 313 bp, Homo sapiens
tggcttcgttctggcccggctcacttctggagctgtgagacccaagacaaaaggggctgagggatttctcattgacaagagttcgtgcgggaaaaccacctgatccctagggatttgtcatcttaagactcaaaagggcttaataccaggacccaccttggcaagatatttacccaccggccatctctgtttactcatgattgttaaatgttaaagcgcagcgctctaaccctgcatattatttacttgcaaatgtctgtaatctgtaattgtgatgcctctcatggaagtaaatatcttttgcagtctctct

SEQ ID NO: 5212 - DNA, 368 bp, Homo sapiens
caggtcgacactagtbgatccaaagaattcggcacgagcactggcgaaatttttgctgacattgatgccatcctcggaaaagtataaagagtatccttggactggacatctttttaaccaggagagaattttttgatgtttcctggaccagggggtttggaatgacccccaaatatgttaggtattggccacctttggcctcaacctgggaatcagcaagtaactcagatggccctctggggtatcatggctgctcccttattcatgtctaatgacctccgcaacatcagccctcaggccaaagctctccttcaggatagggcgtaattccatcaatcaggcccccttggcaagcaagggtaccacct

SEQ ID NO: 5213 - DNA, 260 bp, Homo sapiens
caagcattgggccaagactggcagacacaaagcagggaaaattcaagtgcaagacacattacatttcaagctagtacagactggtttgaaaactgtaagaggattcatcctctaacctctaaacatacaatttttgatgtgcctccaaaaattatatcatggatatttgaggtcgattgtgagagctacctcctccagcagggtttttgatatggactatctcactttatttgagagtttatatagagatgtatgatatc

SEQ ID NO: 5214 - DNA, 300 bp, Homo sapiens
gttttggagaaaccatcaatggtggcttccatttcagctatggagatgacaatctggctcccaacactgccaacgtccagatgaccttcctacgcctcctgtccacggagggctcccagaacatcacctaccactgcaagaacagcatttcctatctggacgaggcagctggcaccctcaagaaggccctcctcatccagggctccaatgacgtggagatccgcgcagagggcaatagcaggttcacgtacactcccctccaggatggctgcacgaaacataccggtaggtggggcagtc

SEQ ID NO: 5215 - DNA, 185 bp, Homo sapiens
gtcgcacccactgtgaaagttggaatatgtgggtctccctsgcctcagggctctgactctgccaggggttgggctctctaacccacaggttgttggctgcctggcccatgtgcccactgtctcttccacttgggctggggttggcagggactgctcctacttgaggggccaggatgctcccccca

SEQ ID NO: 5216 - DNA, 220 bp, Homo sapiens
cccgagaagccgacccagaatccgaggcagtgagggcagcgtagaagagagaaacccagcagatggaccccaataatccaaggggagggtggaatttgaaggaggccgagcaagttagagaagaaaatttgccacatgaaaatggaggggcaaaaccaaagtatccaaaagccggagataccagagggggaggaccatctggggatggcaggaatccagc

SEQ ID NO: 5217 - DNA, 225 bp, Homo sapiens
agaagcattaccaataggaatggatcgatagttgaataatgatttttatacatagatatataacatacagccaggaaacttaaattacttttcttttaaaatatctcacaatttatgtggtatttttaaagactgatcttagaccagtcaaattcccatttatcatttagttattttttgaggtgagagaataatttgtacatattatttagacctctgatattt

SEQ ID NO: 5218 - DNA, 185 bp, Homo sapiens
attcaagtagcacattggtataggtatcagagcagtctagagacaattcatgtcaaaaaatgtacattcatttttagggtggataaaagtaaacatagagattatgttatggctaaatacagatagtgggtaaccttagatttatattagctagcatctaatttgcacacctagaccacatccca

SEQ ID NO: 5219 - DNA, 220 bp, Homo sapiens
acaacttcacaagttgttcttgcccataattttgcccacaagaaaaattaaacttgactttgcttcttcttgcttgttctttaacttgttgataaataattattttttttttaaaccggcaattttaacaaaaaaggggggggggggaaccatttctttaaaattttttaaaacctatagggagtttatttgttatttttgcaggtgtcaatatttgtat

SEQ ID NO: 5220 - DNA, 200 bp, Homo sapiens
gtcaaggcgccaaaatcaatgagatccgtcagatgtctggggcgcagatcaaaattgcgaacccagttggaaggatctactgataggcaaggtaccatcacttggatcttcttgccagcattaggccttggcttaatatcttatcaatgtcaagcttttccctggaggacggggtgcactgggagcacgctaggacacat

SEQ ID NO: 5221 - DNA, 308 bp, Homo sapiens
gcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaagctggaagatggccctaaattcttgaggtctgg

SEQ ID NO: 5222 - DNA, 160 bp, Homo sapiens
gacatttgtctatatttttcatgtatctttggctgatatcagggtattactggcctcacagaattacctttgtaaggtcttccgttcttccttatttttccataataccttgaagggattggatttaggtctcttaaattggataaggaggatttcaggc

SEQ ID NO: 5223 - DNA, 110 bp, Homo sapiens
tcatgtactacaagtttagtggcttcacgcagaagttggcaggagcatgggcttcggaggcctatagccgcaaggatttaaaggcctgtggtttccacaagagcacacaa

SEQ ID NO: 5224 - DNA, 151 bp, Homo sapiens
taagtggctacagggcaacaagactatccctgtgccaaataccagattccaaagaaactctacccacgtcacaaacctgcacgtggatcccctgaatctaaaattaaagttgaaattatgaataaataaaggcttgcaattagggaagggg

SEQ ID NO: 5225 - DNA, 265 bp, Homo sapiens
cgccgctccggctgcaccgcgctcgctccgagtttcaggctcgtgctaagctagcgccgtcgtcgtctcccttcagtcgccatcatgattatctacccggacctcatcagccacgatgagatgttctccgacatctacaagatcccggagatcgcggacgggttgtgcctcgaggttgaagggaagatggtcagtaggacacaaggtaacactgatagactcgctcacatgttgagatatctccccttaaggcccccggacgaag

SEQ ID NO: 5226 - DNA, 327 bp, Homo sapiens
ccctcacaggcagtagattctagaaacaagtgttctgtttgttctggagtgcttttatatttggtggagtgaaatgcattccggatttctgatgatagttttttagtctgttggtttagttgcttgtgacagattaatttttttctacttcatcatcatatacagtcttagattctgagcaaggaggagagcttagagactgccttgctaatttttatcttcataaatattttcttttttctgaatctaatcctagcactgctttatgtacctccttttttcagctaccctctcttttctggtagcagaagaaacagaaaccttacc

SEQ ID NO: 5227 - DNA, 290 bp, Homo sapiens
gctcgtgccgaattcggcacgagggaaaaggggtcctggtacctggtgatgtcaaagtaggcagcttctacttctgttctagcaagagccatgttgactagttttagaacaggaacttttccaagttccctacttggtaaccagatacccaacagtgtgtctagagattctttagtgcactccaatcctctaatactatctacatatgtgctatatgtgtccctgtaaaacacgccatatatcacatcatattttttaaaaatcatatacaaattttttgcgctagggta

SEQ ID NO: 5228 - DNA, 280 bp, Homo sapiens
taaatttaaggggaagctctatgtaagggagacttagagccaaactgtttaagcctgtatccaaccaacaaaggattccttcatggaaccgggcaatcaattaggcttaggatttcttaggattaaatttagggaaaggtaagctctcttagagagcgacaaggttcacacagcacacactcttacacacatgtgtcacatttgagattgactctcacattacacatttgagcgccacacatgtgatatacaggtcttctacacatactgctgagaggat

SEQ ID NO: 5229 - DNA, 188 bp, Homo sapiens
atagcaagtgaacatgtcgtaaatataaaggttcaagtgatgtattgaaaataattttctaactgctttgtatgtatcacatactctaaattgcacagtagggcgtgtttaataaacagatgaattggctgggaaaggtttcaaaataggctcatgatttacagaatcggtccatatacctgctcrcy

SEQ ID NO: 5230 - DNA, 147 bp, Homo sapiens
gtccggcccctccatcgttccaccgcaaatgcttctaggcggactatgacttagttgcgttacaccctttcttgacaaaacctaacttgcgcagraaacaagatgagattggcatggctttaattgtttttttggtttggttttggg

SEQ ID NO: 5231 - DNA, 210 bp, Homo sapiens
agactggtcttaaactcctgggctcaagtgatcccctgccttggctcccaaactggtgagattacaggcatgagcaacacacctggcctgaaattcttaaaggatggagttccgatgcaagcacttggcatggtgtccctaaccttggagacaggaggaggcaggcaatgggaggtttttcacattggggcacaggctctatgtttttgg

SEQ ID NO: 5232 - DNA, 265 bp, Homo sapiens
aggtygacactagtggatccaaagaattcggcacgagctcacttctctggttacagtgctgggccatgggtaacttacaaggcttagcaggaacctgtctgcgcacttcccctttcctgccactaacttgtttccctccagttgcgagagaaaacattgattgagccataactatgtgccaagcttgttctaaggtccttgcatgtattcactcaaacaatccttacaacaattctatcacattcccctttcacagagaggggtc

SEQ ID NO: 5233 - DNA, 190 bp, Homo sapiens
ccccgcttcatcgccgtgggctacgtggacgacacgcagttcgtgcggttcgacaacgacgccgcgagccagaggattgagccccgggcgccgttggatagagcaggaggggccgagtattgggaccaggagacaaggaatgtgaaggcccagtcacagagcttacccagttggacctgggaaccttcgc

SEQ ID NO: 5234 - DNA, 285 bp, Homo sapiens
ctgtatttatagtaaccattttcctttggactgttcaagcaaaaaaggtaactaactgcttcatctccttttgcgcttatttgggaattttagttatagtgtttaactggcatgggataatagagttggagttttatttttaaggaaaattcacaagctaactttcactaatacattatccctaatttattgaaatgtataaattgactcaactcgagagaagggtctcctckgggrgtatgttgtcataacacattaagagatttcccttcattaaactcaata

SEQ ID NO: 5235 - DNA, 350 bp, Homo sapiens
gcctgctgggaacgggacttctaaaaggaactatgtctggaaggctgtggtccaaggccatttttgctggctataagcgggggtctccggaaccaaagggagcacacagctcttcttaaaattgaaggtgtttacgcccgagatgaaacagaattctatttgggcaagagatgcgcttatgtatataaagcaaagaccaacacagtcactcctggcggcaaaccaaacaaaaccagagtcatctcgggaaaagtaactcgggcccatggaaacagtggcatggttcgtgccaaattccgaagcaatcttcctgctaaggccattggacacagaatccgagtgatgctgta

SEQ ID NO: 5236 - DNA, 336 bp, Homo sapiens
cattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctgggcgacttaggaagattcgggcccatagagggctgcgtcacttctggggccttcgtgtccgaggccagcacaccaagaccacttggccgccgtggcgcaccgtgggtgttcacgagaatagtctttaggcctgtctgtaataaatagtg

SEQ ID NO: 5237 - DNA, 285 bp, Homo sapiens
taatacctattagtattagtagatgaccctaatggcaactaacaggaaacttcagaattcaaataattaggcttctttggagaacacagtttaaaaatatttaataagaacaaagatccttaaagagtagtattttcaatattctagtgctcattttagcatatttttatatcatcacatacaacatttaaaaggcaccatatctattaaaccacagcctacctagctttatgctccaaaatctcttgataattacagagttagtaaattattaacacatatata

SEQ ID NO: 5238 - DNA, 190 bp, Homo sapiens
gggatcccacatcctcgctgttccctgtccccccgcaacatcccccaccaatacctttctgaagttttctagtccctcctttttgtttgtgctccttaaagcccagccccatgcctgactttggttcccagtgagcattgtacatttgtggrtattaaatctttggcaaagtcatttacctcgggctgga

SEQ ID NO: 5239 - DNA, 310 bp, Homo sapiens
gacactagtggatccaaagaattcggcacgagctggcaggaaactcacaaaaaggagaactgaaaatttagacatacagttggccattgtaaaaaacatcagtttcctctcatacattccaaggtaaaccaagtaaaataagtgttggagtaacacttgcataaaagaatttaaggagtgatagctctttctgttctgccattcccaacattcctgggggaaaggagactcaatgagttaatactatttcactgagcccaagatagaaactttgggttgacctaaaacatccttattatatagggtagct

SEQ ID NO: 5240 - DNA, 195 bp, Homo sapiens
cacaagcacagggagatgcgtgggctgacatctgcaggccgaagagccgtggccttggaaagggccacaaggttccaccacactattggtgctcttgccgggcagcttggagaaggcgcaatacttttcagctccaccgttaccgctaatataaggaaaggttgtaaaatcatacttaatatacaatttagggca

SEQ ID NO: 5241 - DNA, 210 bp, Homo sapiens
ccactccctgcacgcctgccgtccctgccccgctgggcagcccttcagtgtggctggcgttggggccagtgagttgcctctttccctccttgtctggccccagtggtctggggagccccaggcaccactaagcgtcgtggaagacctgttccgcacaaacctgcatactgaacccgggaaggctgggcaagtgggaagccagagacccac

SEQ ID NO: 5242 - DNA, 260 bp, Homo sapiens
ggactggggacacagggatagctgagccccagctgggggtggaagctgagccagggacagtcacagaggaacaagatcaagatgcgctttaactgagaagcccccaaggcagaggctgagaatcagaggacatttcagcagacatctacaaatctgagggacaaaacatggttcaagcatctgggcacaggcggtccacctgtggctccaaaatggtctcccggtccctgatagcaaagataccagggaatatgtgcgcg

SEQ ID NO: 5243 - DNA, 225 bp, Homo sapiens
gtgccctgcctccaaccccatcctacacttccccagggcgtgcggggctgtgcagacttgggtgccaggcatcttcttcccacccggggtgtccccacatgcagtactgtataacccccatccctccctcggtccactgaacttagagcagttcccattcctgccccgcccatctttttgtgtctcgctgtgatagatcaataaatattttattttttgtcctgg

SEQ ID NO: 5244 - DNA, 210 bp, Homo sapiens
gacactagtggatccaaagaattcggcacgagccaaggcaaaaactaccttytgacttgggttgaggctgggttcccctctattgttcccctatcataagagctaggccaagcctatgggaccttgagtcatgcaggatgggatctttggtcaaaggacaggcgaggagctgtgggcgcagggcctgccgccactgtctacatcttctct

SEQ ID NO: 5245 - DNA, 154 bp, Homo sapiens
cgggggttcagcgtctctgctcccaagtctgtgtggtttccccctaacttcctgcgctgacccagggcctggagctaattcaagacaagctcggctacctggaaccttaggtaagggtacaggtcttgcgacaccttggggaccttggagaatt

SEQ ID NO: 5246 - DNA, 199 bp, Homo sapiens
ggccaaggtacagagagctgtgtgcatgctgagcaacaccacagccattgctgaggcctgggatcgcctggaccaaaagtttgacctgatgtatgccaaacgtgcctttgttcactggtacgttggggaggggatcgaggaaggtcagattttcaaagggccagtaaggacatggctgtcccttgagaaggattatgag

SEQ ID NO: 5247 - DNA, 209 bp, Homo sapiens
ttcaaattcagcggctttgattcagcaagccacaacagttaaaaacagggatatcaggaaatttttggatggtatctatgtctctgaaaaaggaacttttcagcaggctgatgaataagatctaagagttacctggctacagaacgacgatgccagatgacacttaagacctacttgtgaaatttaaatgatgcaataaaagacctatt

SEQ ID NO: 5248 - DNA, 181 bp, Homo sapiens
ctcgtgccgaattcggcacgagggtcaacgttacaacggtagtaaaatctgtcgaaatgcaccatgaagctttgagttaagcttttcccggggacaatgtgggcttcaatttcaagaatttttctttcaaggattttcctcgtggcaacctttcttgtcacaacaaaaattaccaaccaat

SEQ ID NO: 5249 - DNA, 150 bp, Homo sapiens
caggggccccaaggaccccaaggcgtgcccggcaccagcaaggacggccaggacggtgctcccggcgagcctgggccttccggagatcctggggcttccaggtcccagtggggcccaggggacaaccggggattttccggaaacctaaas

SEQ ID NO: 5250 - DNA, 137 bp, Homo sapiens
cgaggagtgtgggctgctgctctcctctgagggcgagtgtcagggctgctacccgctgggatgggcacatcttgtgcaagggccttcagcgccttggaaattccagggggctttaagtcaccgtcaccacttgactt

SEQ ID NO: 5251 - DNA, 296 bp, Homo sapiens
ttgatgttagtagacatttttttcttctgaaatttctaattatctttgttttatcccatttacaaaaagaagtatatagctatactctatcaaacacattattcctaaattatatcagttgctaattgaatctacttgtttctgagaatattcatttcagagcttctgactttctgctttaatactgatagacttttcccttttagagctgatataatctgtcatttacatcttatgtattacaaaggcagggagtatctgaagtaatatcaggagatagaggttatcatacatta

SEQ ID NO: 5252 - DNA, 290 bp, Homo sapiens
cgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctcaatgcccaccaaggtgactctgtggatatccc

SEQ ID NO: 5253 - DNA, 302 bp, Homo sapiens
gaacgtcatctccaaccaggagtgtaacatcaagcaccgaggacatgtgcgggagagcgagatgtgcactgagggactgttggcccctgtggcgtttgttgaggttggtggcagggcctgggcaagccctggaaggtatggggggctagaaatgaactattttatcatgaagcaggctagtcatggctgtcgccgggccctcatcagttcttctaccttccagagtgactacgggggctacttgcctctttaccacaactctgggtcctgaaggtattagatcccacttagtatttcaggcg

SEQ ID NO: 5254 - DNA, 290 bp, Homo sapiens
ggtttcaagtaaccacccagtcaaaagtactagaaactgtgtatcctttattcttattttaaagggtcaatgccttatgctttcagcactagctaaaggatagtcttttaaaaatgaaactaatgctgtcggctaggggctttttgctaaatctattgtttatttgaaggacttgattatttaatgagggcttattggagctattgtacattaattgctcttagcatggtaatccaatatttgatagggattgattatctttcatgggtacagatttttttttttttttt

SEQ ID NO: 5255 - DNA, 320 bp, Homo sapiens
cggtcccgagtcccgcatccatctgttgcggaacttgctcacagggctggtgcggcacgaacgcatcgaggcaccatgggcgcgtgtggacgaaatgaggggctacgcggagaagctcatcgactatgggaagctgggagacactaacgacgagccatgcgcatggctgacttctggctcacagagaaggatttgattccaaagctgtttcaagtactggccctcggtacaaagatcaaactggggctacacaagaatgctgcagatccaaatcggagtttggatcgggccagatggcagtgatcgagtataagggaatt

SEQ ID NO: 5256 - DNA, 321 bp, Homo sapiens
ccaacatgggccgcgttcgcaccaaaaccgtgaagaaggcggcccgggtcatcatagaaaagtactacacgcgcctgggcaacgacttccacacgaacaagcgcgtgtgcagggagatcgccattatccccagcaaaaagctccgcaacaagatagcaggttatgtcacgcatctcatgaagcgaattcagagaggcccagtaagaggtatctccatcaagctgcaggaggaggagagagaaaggagagacaattatgttcctgaaggtctcagcctgggatcaggagattattgagtagatctgacactagaatctgagc

SEQ ID NO: 5257 - DNA, 313 bp, Homo sapiens
gcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggctgtgtacagcagctacctctccaggtctctcacttgcctcccgcgtcctggttgcatggcgaactgtttttcagagtctgtgtcc

SEQ ID NO: 5258 - DNA, 214 bp, Homo sapiens
gttattctctagaaaatagtatttaaagacattttatgaaatcttcattgtcaaaacctttaataaaagtggaaatattttgaaatgcctttttcttgatacactcatccacgtgttgctgattgtccacatttcatgataaatgagagctctgcagagaatgttagcctgtctgttgtaattgtaatcttcaggtaggcacttctttgttaag

SEQ ID NO: 5259 - DNA, 197 bp, Homo sapiens
aattaccgacgctagacgcccagaaaaccctaaactacatgatggcaaagagacaaaagcagccgatccaccagctgagaattcgtccgctcccgaggctgagcaggcgggctgagtaaatgccggcttaccatctctaccatcatccggtttagtcatccaacaaggaggaatatgacattcccagcaataggaca

SEQ ID NO: 5260 - DNA, 216 bp, Homo sapiens
cgcattacttgcttcctgaagagttcccccattcatccatttgttcccattagttgctgcggattatcaagtttttgaaggactgtacatccgaacagacttaagcaggtcgtaaggtgagctggtgtatactccatgtagctggtgagcttttggaggtttggagcttgaagagaattgctaagaagatttgaattatagggagggaacagaaat

SEQ ID NO: 5261 - DNA, 186 bp, Homo sapiens
aatgtttcttttgtataaattcctgtcctgaaatattttattcatgaaaataaggtaagcaaaaaccaactccatttttgccaggatttttgttgtttcttagatttgccctattacggggtgaaacaaaaaggggttttttttagggttaaggacagatattttttacagaaaaaaagggttttt

SEQ ID NO: 5262 - DNA, 237 bp, Homo sapiens
acgtcccggagggcggggcctacctgcctgagcgcgagccctttcatcgtgccggtggagcccgagcggacagcggaatacgaggactacggcgcagagagcctgcagaggagcctcctgagccccaccggcgctggcggcggccctgccccacggacccgggcagtgaaccagagatcacgcgccggccggaggtttggggggaggtgttgaaattctcatttacaggtcagatag

SEQ ID NO: 5263 - DNA, 235 bp, Homo sapiens
cgtaggatgggtgagtcagatgattccattctccgattggccaaggccgatggcatcgtctcaaagaacttttgactggagagaatcacagatgtggaatatttgtcataaataaataatgaacgtcgtgccgaattcggcacgagcattggagaacctattgatgaaagaggtcccatcaaacccaaacgatttgctcgcattcatgctgtggctccagagttcatggatatga

SEQ ID NO: 5264 - DNA, 234 bp, Homo sapiens
caatcttttagacagattcccttttcagtaataataaagttaaactagaggaggtagagattaaatagaggtggccagtaagatttcaaattgtctatgctagtaaggcagcgattaaggcttgaatagaggcagtcacaccagtagttggaaaagtggatagttctcagagactgagagggatgtaccctgtaagagtaaagactccaaagagggataaattagggaatatat

SEQ ID NO: 5265 - DNA, 103 bp, Homo sapiens
tccaagttgcgtctttgttaactccttgacgcggaacatgttattagcctcctaggggggtactatctttttgcgcgactctcggtcctccttcttctgggct

SEQ ID NO: 5266 - DNA, 140 bp, Homo sapiens
ttagtcgcgactattctccaaagaattcggcacgagggcaagtaaggggatgggactagaggtccagtggggatgatgatcccttcatgatccacttaccagaatcgttgtggcctgaggctgtaaccttaagataaagt

SEQ ID NO: 5267 - DNA, 209 bp, Homo sapiens
gagagagagagtgagaactagtctcgagtttttttttaattatgaaatgtgaacctaaggttgtattctttgtagtcttgcagcagtttttgtggttaagaagagagctgtgattttgttgaggacacctaaagtgtattcatccctttcatgtataaaaggggaaaagttgatgagtaattggggcatctaacagtgagggaagagga

SEQ ID NO: 5268 - DNA, 229 bp, Homo sapiens
gagattatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatggccaaccccaaagtcagggcacatggcag

SEQ ID NO: 5269 - DNA, 126 bp, Homo sapiens
gaatggtactgttcaaaaggaatccccacaaggtttaccactgcaaaacctgaagagtctacacatgtacccagcattctttggcattgttgatacaacagttagggccaggattctgccaggaga

SEQ ID NO: 5270 - DNA, 231 bp, Homo sapiens
gaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtg

SEQ ID NO: 5271 - DNA, 209 bp, Homo sapiens
ccaacatgccatccagactgaggaagacccggaaacttaggggccacgtgagccacggccacggccgcataggcaagcaccggaagcaccccggcggccgcggtaattctggtggtctgcatcaccaccggatcaacttcgacaaataccacccaggctactttggggaaagtttgtatgaagcattaccactcaaagaggacccagag

SEQ ID NO: 5272 - DNA, 105 bp, Homo sapiens
gtctaccttaacatctcttgatttgagccactcccactgtcatcagctttcacctggattatcgtgacaggcctcctactgcttcctctatcatggtggccagag

SEQ ID NO: 5273 - DNA, 107 bp, Homo sapiens
aggtagtaatactatcattgaagttaatggcaaaagggttcagaggaaggcagtatccttgggggttttgcttgaaggtggaaaattggggaacaattgttaatttt

SEQ ID NO: 5274 - DNA, 170 bp, Homo sapiens
taacagactgccacttgagtgcgccttgcaggcactcccagagcagccatggaaggagctggccctcacaccatccacctccacactgcctcctggccagctgcccaccccagttccaggtgggagagggagcaggacaagccagccccttccaggtggcagtcggaagg

SEQ ID NO: 5275 - DNA, 224 bp, Homo sapiens
tttaggaatcaaaaactaaaataagtggaattatgtatcttttctaaagttaaaaaagtaaaatattttattatgagttattataaaaattggttaattgtataggragatgacagtatttttttcaagttatcataaaaagtgaattcagatgacatttgagaagtaggggaaagggaatcatgttaacagttttagttctattaacactaatttttgtgaag

SEQ ID NO: 5276 - DNA, 227 bp, Homo sapiens
tttttgtcctcattgatttattatctgatataagggacatataaggagacatatcaatctcaaaaattgttctcaaaaggttttattttttttaaccacagataatgaaacaaccaccatcggttaattttgatccaaaaatattgcatctacccgcaatttcagtgggtaagttatatatatctgaaagaccacagattgggatgccttttttgataacaagaggt

SEQ ID NO: 5277 - DNA, 116 bp, Homo sapiens
cggcacgagattccattagtctccattcaattccattaatctccattccattccatttctactccaactggattccattccatttctatttcctttccattccattccaattgcca

SEQ ID NO: 5278 - DNA, 300 bp, Homo sapiens
agcacagtgtgaatagaacagagcgggatcaagaatttcacagaagacaggtcagctgaggggcctgcacacacagggtgttgaggaaccacagatgggcgccgagaggcctgccttttgcctggcccaggctcacccccacccttgggcctaacctcctccaggaagccttccagcatcccgaagcgtaaggtggccttcttgcagggtcccgatgcaccctgagcctgtaccttgggtggaacttgttatgctatcccgtgctagccctttgtgccctgtgtcgctgtagagtgtgag

SEQ ID NO: 5279 - DNA, 280 bp, Homo sapiens
gctcccgcaaagaagggtggcgagaagaaaaagggccgttctgccatcaacgaagtggtaacccgagaatacaccatcaacattcacaagcgcatccatggagttggcttcaagaagcgtgcaccttgggcactcaaagagattcggaaatttgccatgaaggagattggaactccagatgtgcgcattgacaccaggctcaacacagctgtcttgggcacagggatatggggtgtgccataccgcgtccgcgtgcgcgtctccacagaacgtgttgtgg

SEQ ID NO: 5280 - DNA, 260 bp, Homo sapiens
ccgaagcaaggctgccatggaggaaaggtgaccctgcccatagtcaccaccttgggccgaagcatgcattgcccaacttcctgtttataggtgctgccacttaaagcaattccacttaactttcccaggagtagggcttcaatagagtttctctctgtccccaacatgagcattcagcagggtatacacagggtctctctctgtctctctatcacaagagtgtacactctcacatctctaggggctcagagcacagccac

SEQ ID NO: 5281 - DNA, 165 bp, Homo sapiens
ctagtctcgagttttttttttatttttttctggagacagagtttcgctcttgctgctcaggctggagttcaatggaacgatcttggctcaacacaattcctccctttcctgggttcaagagagattttttgaaccccggagagaaagagtttcacttagaccaga

SEQ ID NO: 5282 - DNA, 195 bp, Homo sapiens
cacgcctgtaatcccagcactttggggaggctgaggcgggtggatcacttgaggtcaggagttcgaaaccatcccagccaacatggtgaaaccccattttcttcttaaaataccaaaatttatcttgctttggtgcaagcgcctctttatttcacagtactctcgcacaggtttagagcacagagagatctcctt

SEQ ID NO: 5283 - DNA, 190 bp, Homo sapiens
gcacactcctggtttggaactttaatagcgttgcaacgaaatcctatatccagtttcctgtaatttaattgaaggaaaatacatgccaataaagactttattattaacagagccagatagcatcagagaatcatgtgtactgttattattatcagagatgtgctctaactcttttaggggcacagattaa

SEQ ID NO: 5284 - DNA, 228 bp, Homo sapiens
gttgaggtggtctgaatgttctgacattaacagttttccatgaaaacgttttattgtgtttttaatttatttattaagatgggttctcagatatttataattttattttatttttttctaccctgaggtcttttgacaagtggggagtgaatttgaatgaaaaatttaagcacatggttgcttattgttccccaggactgtcaattaagcgcattaaggttattcgcg

SEQ ID NO: 5285 - DNA, 180 bp, Homo sapiens
cttaattgtttaactcttaagattatttgtgatctggatttatgtatttgttagatacatacggattgttaaaatggaatgcaagtttttcaaaagcccaggtctaaatgtaatggttggttattgttctataaccccagcccatcaatttctgtgtgaaatcataaaccatatacagga

SEQ ID NO: 5286 - DNA, 194 bp, Homo sapiens
gcagcttcattttgaatgagggtcgctgtctgcccattgatagaggccagattgtcttggaagttccaaagttgcaacgatttctggctagtgccacgaggtttacttgactgttgtgtgaaaagctgataaggaaaccattccagaaaaaagctcttcgttttacaaacatgaaaataaaacatgtaattttg

SEQ ID NO: 5287 - DNA, 173 bp, Homo sapiens
gaaaattaggtctgaattcaagagaaagtacggcaagtccctgtactattatatccagcagaaactaagggcgactaccagaaagcgctgctgtacctttgttggtggagatgacttaagcccgacacggcctgagcgtccagaaatggtgctcaccattcttccagctatca

SEQ ID NO: 5288 - DNA, 138 bp, Homo sapiens
ccagtttttgctggatttgtacatagccattctagaaatagagttgagggaaattatccatatacatatcactaataggcttcttgggaattatttaggaaagcatttttaaacccggcaagtggtgacttaataggg

SEQ ID NO: 5289 - DNA, 111 bp, Homo sapiens
ccaatcttgaaacacctgcaggatattaaagtgaaattttctgaccctggacagcctatgtcttttgtgttagagttccacttttgaacccaacgacttactttaccaact

SEQ ID NO: 5290 - DNA, 110 bp, Homo sapiens
ctcgtgccgaattcggcacgagcttcaaccaggtggagatcaagcccgagatgatccggccactacctgggcgagttctccatcaacccaccaagcccctaaagcaatgg

SEQ ID NO: 5291 - DNA, 173 bp, Homo sapiens
aacacctctgattactcctgccatcatgacccttggccataatatgatttatctccacactagcagagaccaaccgaacccccttcgaccttgccgaaggagagtccgaactagtctcaggcttcaacatcgaatacgccgcagccccttcgccctattcttcatagccgaat

SEQ ID NO: 5292 - DNA, 300 bp, Homo sapiens
gtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttctttttaaagtgtattggcatgtaatttgcatagagagggggctctcgtaagtctctcacattgaggctgtttagggaaatcctcattcagtttggt

SEQ ID NO: 5293 - DNA, 210 bp, Homo sapiens
ctcgtgccgaattcggcacgagcattactgggggcttcagtggaggaagtaatgctgagcctgcgaggcctgacatcacttaccaggcgcctcagggaacccagccagcacagcagcagcagccttgcctctatgagatcaaacagtttctggagtgtgcccagaaccagggtgacatcaagctctgtgagggtttcaatgaggtgctga

SEQ ID NO: 5294 - DNA, 310 bp, Homo sapiens
ctcgtgccgaattcggcacgagcgacggtgtcgcccgtgttttcgttggcgggtgcctgggctggtgggaacagccgcccgaaggaagcaccatgatttcggccgcgaagttgttggatgagttaatgggccgggaccgaaacctagccccggacgagaagcgcaaaaacgtgcggtgggacacgagagcgtttgtaaatattatctctgtggtttttgtcctgcggaattgttcacaaatacacgttctgatctttgtgcgtgtgaaaaaattcataatgtaaatctcagaaacagtgtgagagagctc

SEQ ID NO: 5295 - DNA, 300 bp, Homo sapiens
accagctccgaaatcaccaccaaggacttaaaggagaagaaggaagttgtggaagaggcagaaaatggaagagacgcccctcctaacgggaatcctaatgaggaaaatggggagcaggaggctgacaatgaggtagacgaagaagaggaagaaggttgggaggaagaggaggaggaagaagaaggtgattggttaggaagaggattgagattaagattaggaagcttagtcaactacgggcaagcgggcacttaagattattaggtttacgatttctataccagaagcagaagacccccg

SEQ ID NO: 5296 - DNA, 170 bp, Homo sapiens
gtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggttattgggaagta

SEQ ID NO: 5297 - DNA, 230 bp, Homo sapiens
catatgcttgtctcaaagattaagccatgcatgtctaagtacgcacggccggtacagtggaaactgccgaatgggctcaattaaatcagttatgggttccctttggtcgctcgctcctctcctacctggatgtggccagttttggaggtgctgaacgaggttaaccgaagggcccttgaagaagctggccagccaaggccgactcccaaggggcaagggtgacgcaccat

SEQ ID NO: 5298 - DNA, 116 bp, Homo sapiens
ctcgtgccgaattcggcacgaggagtacttctagagcggccgcgggcccactcgagttttccaccccgggtgggggtaccacggtaaggtgtaccccaattcgccctatagttagt

SEQ ID NO: 5299 - DNA, 280 bp, Homo sapiens
gtcgtctattccgtagaatcacatgatctgaggaccattcatggaagctgctaaatagcctagtcttggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatcttttaagagtccagtgtccatggaaacattccacatgccgtgactcttggactatatcagtttttg

SEQ ID NO: 5300 - DNA, 105 bp, Homo sapiens
atgaaactgaagaatattttcaattattggatataccaatgtaagcacccatattttccactctatctctgcctaggggaagagtgtgtttatatgtgcccctct

SEQ ID NO: 5301 - DNA, 317 bp, Homo sapiens
cttgtaaaaacctgaacccagaaacaacacaatccgttgcaaacccaaaggacccaaggtacttttccaatcttcagtcaccttagggcctctgcactgaatggctgacctgacctgatgtccattcatcccaccctctcacagttcgggacttttctcccctctctttctaggagacctgaactgggcagactgcaaaataaaatctcggtgttctatttatttatggtctcctgtaagacctcgggtcaaggcagagcaggaactactggtgtgagtcaaatgccccctgagtgactcccccagcccaggccaga

SEQ ID NO: 5302 - DNA, 190 bp, Homo sapiens
ggaagatgaccctgatgccctgaaggatcctctctatcagattgatctgcaggcatatctcacagatttcctctgccagtttgctcagcagccctgctacaaaatgtttttcaaggcaaccttatggcaatgaggggcggggtctcaagacctcggccactaaaaaggggaggccctcttcacatgctcc

SEQ ID NO: 5303 - DNA, 219 bp, Homo sapiens
ggcagtggaattgctttcctgagaatcattctgaggctgggctattgcttctcccttgcttcaaagaatctagcagcgggggataggattttgcaacaaaaagctgacccagaggccatacagagcagggatatcccattgccccctcctccactgggttcagagggtaagagagcacccttcaataaacccaggctccacggccgtggggggctgctg

SEQ ID NO: 5304 - DNA, 190 bp, Homo sapiens
tcgtgccgaattcggcacgagggtcgcgcggaggcggagctttggtgcgttcaagattcaacttcacccgtaacccaccgccatggcccaggaaggcatttcttctggaagggtaattgaccgtaatacttctttacaagaaggttcttaagacttccctcaatcacgattgcctagcacgtggagattt

SEQ ID NO: 5305 - DNA, 190 bp, Homo sapiens
ctcgtgccgaattcggcacgagccagagcttctgcccaactgtcaaccttgacaaattgtggactttggtcagtgaacagacacggtgaattcttctaaaaacaaggatggggctgctcccatcatttatgtggggcgcatcgggctactacaaagttcttgggaaagggaaggtcccaagcagccttca

SEQ ID NO: 5306 - DNA, 105 bp, Homo sapiens
tccgcgctcgcattgccacggaaaggccaaggaaggaggtaaggcttagaacaacgatcatattaatttgaaggttgcggggcaagatgggtctgtggggcagtt

SEQ ID NO: 5307 - DNA, 135 bp, Homo sapiens
actggatcctgatacagataaatgggttagatgcaataagatgccagtaaaggacacaacatacaggtatgctcagaatccccatcaagatgttaagacagcagtatattcaaatgtttactctttagtattcct

SEQ ID NO: 5308 - DNA, 137 bp, Homo sapiens
taacggccaggtcatcaccattggcaatgagcggttccgctgccctgaggcactcttccagccttccttcctgggcatggagtccttttggcatccacgaaactaccttcaacttcatcatgaagttttacgtggac

SEQ ID NO: 5309 - DNA, 134 bp, Homo sapiens
gaagaaactagagaaacaagaacaaaccaaacccaaatccagcagaagaaagttaataaccaagattagaacagggactaaattaaagttgaaaacaaagaatacaagatgaagggaaaacaagaagggcttga

SEQ ID NO: 5310 - DNA, 276 bp, Homo sapiens
cggcacgaggcagcccgtcctgcccctccacccacccaccaggtgcccagtgttcccaagggccccgaattccaacctttattcaggcgtaagatctctgcaccccaaatgcctgttagggaggatagtgaaggctgagccctcctgggctcatcaaaagccagcagtgagagaccacccccatctctctgaggtgacctcgtagggcagtccgtgctgtctggctggcctcggtgaggtggcagggacacggctggcgcctgggcctcgctggca

SEQ ID NO: 5311 - DNA, 135 bp, Homo sapiens
caagaccgcagtgcagagtgaaggtcaagctgttgcagcgcagatttcctccctgctgaggtttgccgccggtgaaggatgggagctacggagggaagggggtgttcctcggaaaggaaggtggggtttttaaaa

SEQ ID NO: 5312 - DNA, 125 bp, Homo sapiens
cgaactcatggccaatcttgttacatgtacactctacctacccccatatccaacccttgacaaccaagacgtagaatttcacttggaaatatttcagtatgtatcttcaaaagataaggcctttt

SEQ ID NO: 5313 - DNA, 205 bp, Homo sapiens
tcccgccaaggagcttcttcgttcctgcgcatatagactgtacgttatgaagaatacccaggaaggactttgtgactgtcacttgctgctttttctgcgcttcagtaacaagtgttggcaaacgagaactttctcctggcccctgcctgctggagatcagcatgcctgtcctttcgatctgtacctacctactctctcttgcctg

SEQ ID NO: 5314 - DNA, 262 bp, Homo sapiens
ccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttattgaggcaacaaaaaaacaaagcacatgctgcccagtggcttccggaagttccttgttcacaacgtcaaggagcttgaagttcttct

SEQ ID NO: 5315 - DNA, 285 bp, Homo sapiens
cggcacgaggtcctatttcgatgaacacgacttcgagccgtcggaccctgagcaggagacgcgaaccaacatgctgctggagctcgcaaggtcacttttcaataggatggactttgaagacttgggggttggtagtagattgggaccacaacttccttcaacagactgtcaagactatggttgagaaacctccccaggacaaatcatcaaagagctctcaaggctgagctcaagtgcccccctgtgtcctttgggaattgaggagggaggagactctcatataga

SEQ ID NO: 5316 - DNA, 208 bp, Homo sapiens
cagcgatgccgcccctctgcagaggtcccagtctctcccacactcggccaccgtcacggtgggtggcacatcttaccccagcactttcagcagctcagcgctgagcgaaagagaggccttccggcttgacaaggttcaagcagcttctttccggccccaacaaggaccttggacaactacaacttttcccaaccctgggattaaatta

SEQ ID NO: 5317 - DNA, 134 bp, Homo sapiens
gcctcatcttaaaagggagatagcctgaagccctttgactgcattgatcagggacaggaccatgatattgttacaatacctagggtcaccctatggctgagctctctcttatgccctttacaacaatctgtgtg

SEQ ID NO: 5318 - DNA, 202 bp, Homo sapiens
cccagagattgtcacagccctggccattgcgggaacctcaagttcaacccagagaccgactacctgacgggcacggattgcaagaagttcaggcttgaggcttcggattcagattagctttccaaaggggagttttacccagggcaggacacctatccagcacccacccaagggcagcagcgggcagcttgtgtgacgtgtg

SEQ ID NO: 5319 - DNA, 156 bp, Homo sapiens
cacccacctcggcctcccaaagtgctgggattacaggtgtgagctaccgcgccctgccttgactcaatttttatatggtttgaacaaagtggtaatttttaaagtggttatcacctgtaacagtcttttctaaactaaggttcttacaagaaaatg

SEQ ID NO: 5320 - DNA, 167 bp, Homo sapiens
gtcaggagttcgagaccatcctggccaacatggtgaaaccccgtctccactaaaaatacaaaattagctgggcgtggtggcgggcgctgtaatccagctacttgggaggctgaggcaggagaatcgcttgactccaggaggcgcagctgcagttagcttttatggta

SEQ ID NO: 5321 - DNA, 165 bp, Homo sapiens
gtctttctgcccctccaagctgatgaagggaagcctttgccaatggcccatggaagacacttgggtttgagaaacccttcccacttccaaagaccaaagagattaggaaaaggccttgcagtattctccaactccaaacaagcttttagggggctccaggaaaag

SEQ ID NO: 5322 - DNA, 105 bp, Homo sapiens
cattttttataacctggcaaaatcttgttaatgtcattgctaaaaaataaataaaagctagatacttggaacctaacttccaatgttggattgttttacccacaa

SEQ ID NO: 5323 - DNA, 116 bp, Homo sapiens
gcggggttggggggggtcctggtctttgcgcttctcgactcggtcctcttttcgacagcgaacatgtcgcggcctgtcagaaataggaaggttgttgattactaacagtttaagga

SEQ ID NO: 5324 - DNA, 135 bp, Homo sapiens
cttcccacaacactttctcggcctatccggaatgccccgacggtactcggactaccccgatgcatacaccacatgaaacatccatcatctgtaggctcattcatttctctaccagccgtaattataataattttc

SEQ ID NO: 5325 - DNA, 113 bp, Homo sapiens
ctcgtgccgaatttcggcacgagggttttgcttaggcgcagacggggaagcggagccaaacatgccagttggcccggagcttgggtttgttcccaaaacttattttaccccgc

SEQ ID NO: 5326 - DNA, 150 bp, Homo sapiens
cggcacgaggaaatgaatatgctgcactttacaaccactgcactacctgactcaggaatcggctctcgaaggtgaagcgagaggaaccagacctcatcagcccaaccatcaaaggcaaccattcggaaccagcaggcccccgaaggaccc

SEQ ID NO: 5327 - DNA, 105 bp, Homo sapiens
cacctcttaggctgagcattctttaaatagtcttcattgccatttgttcttgtagcaaatggaccatgtgggatggctaattttttttttattaaggaggttatt

SEQ ID NO: 5328 - DNA, 113 bp, Homo sapiens
aaaaaatcagctgagattttgtcttgttaatttagaaaacactttttaagctgtctttctaaaaatctctggggttacctcacaggaatatgttttttgcaacaatacatttg

SEQ ID NO: 5329 - DNA, 110 bp, Homo sapiens
ctcctaaccgcgagtgatctgccagcctcggcccccgaggtgccgggattgcagacggagtttcgttcaatcagtgctcagtgttgcccaggctggagtgcagtggcgtg

SEQ ID NO: 5330 - DNA, 105 bp, Homo sapiens
atcgtggggccactgtgccaataaacaaaaacacctgtttgggtttacctcagttgcagtagttattttcatttagaaggttgttctaagattattgtttcagtt

SEQ ID NO: 5331 - DNA, 103 bp, Homo sapiens
ctctgtcctgttatacatatttagggcagaaaaaaagttacatgtcgattaggtacttatcaaggaatgggcaagctgagatttttggtaataggggaagctt

SEQ ID NO: 5332 - DNA, 122 bp, Homo sapiens
tgggcctggggtgggggcttatgagttggtgctagagccagggccatcttggactatgctccatcccaagggccaagggtcaaggggccgggtacatttttttccctaggctgagcaccttt

SEQ ID NO: 5333 - DNA, 136 bp, Homo sapiens
cccaattggaccaatctatcaccctatagaaggactaatgttagtataagtaacatgaaaacattctcctccgcataagcctgcgtcagatttaaaacactgaactgacaattaacagcccaatttttccaatcaa

SEQ ID NO: 5334 - DNA, 208 bp, Homo sapiens
ggggaagcggagcaacatgccagtggccgggagctgggtttttcgcaaaacttatgtgaccccgcggagacccttcgggaaatctcgtctcgaccaagagctgaagctgatcgggcgagtatgggctccggaacaaacgtagggtctgggaggtcaaatttaccctggccaagctccgaaaggccgcccggaactctagacgtttaat

SEQ ID NO: 5335 - DNA, 230 bp, Homo sapiens
aaaattttaagaattcttaagtctaagggacttgctcctgatctttctgaagatctcttaccatttaattaaggaaagcaggttgcttgttcgaaagcatcttgagagggacagaaaggataagggttcttaatttcctcttatttttatagagagcccgatttacccgtttggctgtatataggccagcgagtgcctccttccaatttgagagtgtagtctagtcatam

SEQ ID NO: 5336 - DNA, 255 bp, Homo sapiens
accggagccttcaaggtcttggaccctgaggaaaggcaccatcaagaagaagttcctggaggagctgctgaccacgcagttgaccgcttttccaaggaggagatcaggaccatgtggccggccttcccccccgacgtgggcggcaacgtcgactacaaacacatctgctacgtcatcacgcacggcgacgcaaggcccaggtgtagggcaccgcggcttctgctgcccgacgttctgttcggcccgcactacacc

SEQ ID NO: 5337 - DNA, 312 bp, Homo sapiens
ccaagtactgtggcggctctatggcttaggcacaggagtggcccagaagcagaatgaggatgtggactctgcccaggagaaggatgagcatcctggcgattatcaccaccatgcagcagttatggcgccaggttctgcagggtgggcctgatccagagtggtgctcactgtgctgactgttactatctccccaagagaaaatgcttcttttgagcacactgtacctcccatctgcattgagcagagagacttttgtttactgagacaaagatgtttaatttagacccagagagagagtttgctctgaatttg

SEQ ID NO: 5338 - DNA, 214 bp, Homo sapiens
ctgaagtcagtaaatgaactaatctacaagcgtggttatggcaaaatcaataagaagcgaattgctttgacagataacggctttgatttctcgatctcttggtaaatacggcattatctgcattgaagatttgattcatggagactattactttggaaacgcggttcaagagagcacaatatacttccgtgtggcctacaaatgtctttctcac

SEQ ID NO: 5339 - DNA, 156 bp, Homo sapiens
ggtttctgtttaatgcatcttgccttatctttttttattactgtgtacaaaggtttttttacacaaaggaacttaatgcctgtattaataaatcagtgtggaggctcaatttggataggtcccaaaggtgaggatttgttagaggattagtgtcca

SEQ ID NO: 5340 - DNA, 186 bp, Homo sapiens
ctggtgcagaccagggccaaagttcttggaagctccttttgccatctgctgaggtcgcaaaactataatttaattcctggtggctaagacctgggttacccgcaacttttaaaccaaatttcacagctgtttaaggtgagaccttgagaggttttctcttatagagatgtgagcttgcgccctttc

SEQ ID NO: 5341 - DNA, 120 bp, Homo sapiens
ccggaacctcctcagctcttccctcttcagaggttcctaccctaagagaattttaaccacttaacaagtcctggttgatcttagaagggagattgggtataggcaaagaggacacacact

SEQ ID NO: 5342 - DNA, 105 bp, Homo sapiens
taggaccgagcagtggccaaaggaagctgtacaatgcagctcatccggaagaagttcttaaccaccctcttggtggccgatttggaaggagccggaaggagtgcc

SEQ ID NO: 5343 - DNA, 245 bp, Homo sapiens
ctcgtgccgaattcggcacgaggaattttcatgtaagatcctatggccggtgcagtcgctcacggctgtaattccaagcaacttttgggggccaaggaggttggatcacttaagtcaagagagtttagagacacagtttggaaacacatgtgtgaaccccctctgtgtatctaaaatatacaaaatttgcgctgggaaatgggtgcgcggatatctgataattcctagacactggggtgcgctga

SEQ ID NO: 5344 - DNA, 160 bp, Homo sapiens
aatcatcaagtggcatcgaattaatttgttattaaaggtagatgataatctgtagaataggttcagtgtcttccctgaggaggagttaatttatgaaggagggcctttgtttaacctatgacttatttctattgacacatgagggacttaatatatagag

SEQ ID NO: 5345 - DNA, 165 bp, Homo sapiens
cagtgggctacccgggcatgaagccccagcagcactgcccaggcgagcttcagcagcagagtgacaccagcagcctgctgaggcagacccatctttggcaatggatatgacccccaaagtaaccagatcacgaggggtcccaagtctagcccggacgagggctct

SEQ ID NO: 5346 - DNA, 128 bp, Homo sapiens
aaggtgccaatgggattctccctagccctgttgagacaaacagtatgtctccagacattggaaatattcctcaggggagaaagtcagttgagaaccactgacctagatgtacctaagtagtcaagaat

SEQ ID NO: 5347 - DNA, 170 bp, Homo sapiens
ctcgtgccgaattcggcacgagttcattgctgagagttctgcgcttccaggtcttcttccagcatccacacaagtaccttctccactaactgggttccctccagaactggcttaaccgccttcagcgggcaggccgggagtttacttttttcagcttacccaagggcagc

SEQ ID NO: 5348 - DNA, 118 bp, Homo sapiens
ctaatgttgatgatcagctgtgatttctaagctaaaagaatgacaaagggattgggtttcttttgtttccatggcactattacggtgtgctggggtattggcttacattttcagagat

SEQ ID NO: 5349 - DNA, 185 bp, Homo sapiens
ctcgtgccgaattcggcacgagaattgtgaattgggagtgtgagtctttctgtagggtagaaagaagccttctacccagcaaaccagtaggcccaaaagttgaaaaaaacttatgacaggcaacaaggattaaggtggcatatattgatgtcaatttgggtcttttttccagaaggcttatacag

SEQ ID NO: 5350 - DNA, 120 bp, Homo sapiens
ggacactgaggatggcagtgcctggaagcaagatcccttccaggagagcggccttcaccttgagccccacggcggccgaggccaaggagaaggcttgagccattcgagtcaacaagcgcg

SEQ ID NO: 5351 - DNA, 185 bp, Homo sapiens
cacggctgacttcaagaccatcaaccagataggcaagaagttgcagaagaagatctgtgttgaggaagacccctgttccttccagtcccttggtgaaattccaagccaaagttggaggggcttcttcaagcccttaccaggaaacttggaagctttttaagtaagccgcttggcccatcctggga

SEQ ID NO: 5352 - DNA, 144 bp, Homo sapiens
ggcctccgggccccccttggagttccaggcatcgatggcatcgacggtgaccgaggttcctaagggccccccgggcccccccgggttcctgcaggtgaaccgggaaagccaaggagcttccaggcgaaggcttggaaaacttgg

SEQ ID NO: 5353 - DNA, 122 bp, Homo sapiens
cctagaggagagcaaacgactcagaggaacaaacagatagccatgggaaggaagaaattcaacatggatcccaaaaagggaattcagtttcttatagaaaatgaccttctacaaggttccca

SEQ ID NO: 5354 - DNA, 210 bp, Homo sapiens
ggagagcaggatttctctgcctcttccaacttttctcctgaacctgagggaaactaatctggattcactccctctggttgatacccactcaaaaaggacaattctgattaagacggttgaaactagagatggacaagttatcaacggaacttctcagcatcacggtgacctgaataaaaattgcacacactcagtgcagcgctatatttc

SEQ ID NO: 5355 - DNA, 225 bp, Homo sapiens
ctttcctttgccttgaccctttgttaaataaatgacttgcgggagccattcattgtacagttgcaggattaagagtcatttaatgatgtggtacattgggaccatgttctaaaaccttgggtttctgagtctgctttttgagaagggaattttgaggttgaaaaccaggggccttaatctgggaaatacagcattttccagaggcttctttaaagggaatccggg

SEQ ID NO: 5356 - DNA, 140 bp, Homo sapiens
gtgggctcttatattagtagtccagtagtgatgatgaaattttaattaatgttgaataaaaggataacttataatgcaggccctctggacaaactatcagaaaaaaggggaagtagggaaattgggttaaattgaggtaa

SEQ ID NO: 5357 - DNA, 286 bp, Homo sapiens
gtttcctctactgtttgaatttctgtaaataataaatcttccctttcttctctctgggcctactaatgatggtgttgcctaagggtcaatccgggttgcaattaaggcaggtctaggaggcaaattcatagccttaaatccctacatcaaaaaggtcttaaagggccaaattggacaattctagggtcaaaccccagggacctggggaaccaggaccaacccaacttacccaaggcggagaagaggaattactaggtaggacagtctaatgaattggcaaccaccc

SEQ ID NO: 5358 - DNA, 260 bp, Homo sapiens
cgtttcctataagaattggcataaatctaagahgaaggcctttaccaggtactgccaagaaatggcaggatgaggatggcaagaagcagctggagaaggacttcaacagcatgaaggaggtactgccaagtcatcccggttcaattgccacaacccagatcgccttcttcccttttcgccaaaaggaaggcccaacttatggagatccaggttaaccggaggcaattggcccaaaagcttgacttgccccgcaaagcttt

SEQ ID NO: 5359 - DNA, 250 bp, Homo sapiens
cccttcagcaccctctactgaggaaaaaagggaattggctgtctgccagtttccaaggcaccttctttcaggacctacagaaattatgttctattgatcgtacttttggtgttacaaacattaggcccgtaattaaaacccttagttaaagggcccaattctgatccttaccagttaatttgatattaggttggatccattaggcctcttgaacttggaaaaccaggggaaaggttttataagtttgatc

SEQ ID NO: 5360 - DNA, 140 bp, Homo sapiens
accatcgtgtgcacagcaaggacggcggggcttggggaccgagcagcgggaggctttcctttccctcccagcctggaaggttttgcaaggtgttcatcaccttggaccaggccaacctgaccttaaggttcccaatgggt

SEQ ID NO: 5361 - DNA, 156 bp, Homo sapiens
atttgtctgtccaaagagaattaggagagaggttaatgttacttttttccattttggaaataattttaatcaagtaacctcaaatgtgacaaaatttatttttattttttgtggttaatatcccaacaacattaaaaaatactcggggcataaatg

SEQ ID NO: 5362 - DNA, 215 bp, Homo sapiens
gagatttgcctactatacagatgacctagctagtgcaccatctagcactttcccaccccttcagtttgggtcagaggacaccaaagttccaaggaggagacaggggacacaggggccaaaaatttgtattattttctcacccaggtggtcatgcaggcatttagtttgaaacctcaggccattaacccgtctgaactcgctaccctggtgctccc

SEQ ID NO: 5363 - DNA, 215 bp, Homo sapiens
tcgtgcgaatttcggcacgagccaattatctgtattaatgcttgaatattactggataaattgtatgaagatcctcctgcagaatcagccatgatttttcccaagggaataccatatgcaggttacttattaaggggcaaaccttaggtgcccttaaggtaatgcctgtaaaatatttggagggaaataggattaaaagggttaaggtgtttcta

SEQ ID NO: 5364 - DNA, 220 bp, Homo sapiens
gtgaatttgagaagagtatgtagccaccttgggtgttgaggttcatcccctagtgttccacaccaaccagagggccctattaaggtcaatgtatgggacaaaaccggccagagaaattcggtggactgagaaatgctatatatcccagcccatgtgccacataatgtttgatgtaacctagcgagttacttacaaggatgtgcccactggcatgagatcc

SEQ ID NO: 5365 - DNA, 284 bp, Homo sapiens
ggacacgctgttcctctgcttctgtgaggactggaaaggaatgacggctctcaggagcgaccctacttcatgtcgcccgagctgagagacatcctgtttgaaggggagtgcggaggaggggaagcgggcagaagccgaggagtagagattggaggacctggagaggaatgacggctcggccaggaggctttacttaatgttcttcaccctcaagaaactcttgaacaagagcaacaagaaggcagcggagtcctgaaggcccgtgctcccacctctcaaggagt

SEQ ID NO: 5366 - DNA, 220 bp, Homo sapiens
tcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaggaagtaagttggtccaaaggcaaagttcgggccaagctcaataacttagtcttgtttgtacaaagctacctatgtataaa

SEQ ID NO: 5367 - DNA, 180 bp, Homo sapiens
cgacgccacaatagtgcgcatgaatgtactggcagatgctctcaagagtatcaacaatgccgaaaagagaggcaaacgccaggtgcttattaggccgtgctccaaagtcatcgtccggtttctcactttgatgatgaagcatggttacattggggaatttgaaatcattgatgaccacag

SEQ ID NO: 5368 - DNA, 152 bp, Homo sapiens
aaacactgacaggaaaaggggatggacatgattcccagaatccttcaggctagctcctccgcgcatccacgttcaaccgaggctggtaattttggagcggccaccagggggcgccacgattcggttgcccgttcgccttggattgttgtaat

SEQ ID NO: 5369 - DNA, 139 bp, Homo sapiens
ctcgagtttttttttttgctgcgtttactgcgagaataagactattctcagcaatcagactgtcgacattccagaaaatgtcggcaatactttgaagggacggacagttattcgtggaagggccccagagggaaccctg

SEQ ID NO: 5370 - DNA, 211 bp, Homo sapiens
agatgacaaaatgaaagcccaaggggctgaaatgagttacccatagtcatagacctaattactgacaaagcacaaatttcctgactgccatcactatacctctgcccttacctggccaacccagggctggggtgggcaatgcaggagacaaggtaggcacaaggaaccctctagggggggtaggtcctaggccaaaggtcaaaataaatgt

SEQ ID NO: 5371 - DNA, 154 bp, Homo sapiens
cagcagcgcccgcagcacccaccccgcaccggcgactccatcttcatggccaccccctgcggtggacggttgaccaccagccaccacatcatcccagagctgagctcctccagcgggatgacggcgtccccaccacctccctttttttcttttt

SEQ ID NO: 5372 - DNA, 312 bp, Homo sapiens
gtgaaaagggagtactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagagttattaaaatttgatgaattagtggtgatggttgcacaacattgtaaatataataaatgtcactgaattgtacactttaaggtgggtaaaatggcaaattttacaagtcttctgaaactactgtactcttttaatacacag

SEQ ID NO: 5373 - DNA, 222 bp, Homo sapiens
gaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagttagccccaaatccgagagggcatgaaaagggtagaaccacagactgtaggacgacctctttcccttgttact

SEQ ID NO: 5374 - DNA, 139 bp, Homo sapiens
ctcgtgccgaattcggcacgagcacaagtcttcactccttcctgcgagccctgaggaagccttctttccccagaacatggccaacaagggtccttcctatggcatgagccgcgagtgcagtccaaaatcgagaggaagt

SEQ ID NO: 5375 - DNA, 150 bp, Homo sapiens
ccaacatgggccgcgttcgcaccaaaaccgtgaaggaaggcggcccggtgcatcatgagaaaagtgactctacacgggcctggggcaacgactttccacacgaacaagcgcgtgttgcgaggagattcgccattattccccagcaaaaag

SEQ ID NO: 5376 - DNA, 196 bp, Homo sapiens
cctggactcaatcatggcttgtggtctggtcgccagcaacctgaatctcaaacctggagagtgccttcgagtgcgaggcgaggtgggctcctgacgctaagagcttcgtgctgaacctcgggcaaagacagcaacaacctcgttgcctctcactttaaccctccgttttaacgcccacggcggcgccacacaccat

SEQ ID NO: 5377 - DNA, 223 bp, Homo sapiens
agaggtggtgtctttagttgacagttcacaaacttgtgtaaaggtttgtgaaatgcatcttcttactgcatcagaccttccttaagaatgaaaccgaccacatggagggaaaaagaaaacaattcttttcttggcttggttttttgagaagtttactgacaaattactttttatcaaatctgaaatagtcacctcacagctcttcaaagagaacctttgaaag

SEQ ID NO: 5378 - DNA, 145 bp, Homo sapiens
cggcacgagttcatttttaatcctttagctattaccccattgaattaaaagagtaatgtgtggtagagtcatcaatgatgggcgagatttcagaatacggagaaaaaaaaaaaaaaaaacctcgccctcctccccaattcgcacg

SEQ ID NO: 5379 - DNA, 105 bp, Homo sapiens
gccagaagagaaattatcatgatgtttttgaggcagattaaaatttttctctatcctcatagagatgctttgctagcagtttcattttgtacaaatggcataccc

SEQ ID NO: 5380 - DNA, 140 bp, Homo sapiens
cccagactggttcttgaacagacagaaggatgtaaaggatggaaaatacagccaggtcctagccaattgtcttgacaacaagctccgtgaagacctcgagcgacttaagaagattcgggcccatagagggcttcgtcact

SEQ ID NO: 5381 - DNA, 145 bp, Homo sapiens
gtgggaaatgctttaccagtggtagaaaccttagagtacatcagagaattcatacttgtgagaaaccatatcaattgtgaaggatgttgggaaggcctttaggtcataggttcaaacctgttaaacatagttaaaattcatactt

SEQ ID NO: 5382 - DNA, 130 bp, Homo sapiens
ctccataaatttggtgattctctgctaggcctaagattttgagttaacatctcttgaagccaaacctccaccttctgtgcctttttgcttgggaataatgggagtttttctttaggaacaggtgccagga

SEQ ID NO: 5383 - DNA, 205 bp, Homo sapiens
ccaatattcagtgttataaatattactgcatcccttacccattgttaaaatattgatgtgcttccagacccattggtaaagagccccctccttggagtgaccccagctccctggatgcccctgtcccctctccaagatcccagggcctccctaagattccaccactagagagttaacagctgacaccagtgttcttccatgtcaa

SEQ ID NO: 5384 - DNA, 130 bp, Homo sapiens
cctccagtttttcatagacctgaggttccagtgtctcycagtaactgcgaaccttttcctgagggggaattcttgtgttaaaattacccttcaaaaaggaagtaggcaaaggcgttgccaaaccccaccc

SEQ ID NO: 5385 - DNA, 155 bp, Homo sapiens
ggcgcatgcaggagatgctgcagaggatgaagcagcagatgcaggaccagtgacgctcggcgcggacacaaccgttccgtcttccgggacggccttgcaccccttggacaaccagaaccggactttttcccgacccggagacgcgggggccacag

SEQ ID NO: 5386 - DNA, 190 bp, Homo sapiens
gcaaagtctctcgcgacaccctgtacgaggcggtgcgggaagtcctgcacgggaaccagcgcaaggcccgcaaggttccttgagaccggtggagtttcaggatcaacctttaaggacctattaatccccagaaggacaagcgcgttcttgggcacccgtcaggctttaagtcacatccccgcccctaagg

SEQ ID NO: 5387 - DNA, 211 bp, Homo sapiens
ctccttttatagcgcttctcaacggtagggagagctgaagggaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgtcagagatgcaatttgtgtattatg

SEQ ID NO: 5388 - DNA, 212 bp, Homo sapiens
cgttgagggttggggggcggggggcctccttccttcctctcagcccccttccccaggggctgtgcttccatgcttctaggcttccaccttcgctcaggacatgttataacttaggctaaactgtgaaaattccggtggggatggccttggccgagctctcaggcaggcggccctgccccagccctgtcatcatttaagggggagctggccct

SEQ ID NO: 5389 - DNA, 219 bp, Homo sapiens
tatagaattgggccaagataaatctatgttgttttgcatggctattgttaagctccaaaggttcactgtgtttctgccgctgtcctggagttgtcaccactgacttggcaaggcttcttgggcatggatgtaggacttttgtccttttcccacttacagttatctttgactctcttgcctgttatgcttacaaaatggggatggcttatgggaggctgt

SEQ ID NO: 5390 - DNA, 240 bp, Homo sapiens
gtcattaaacaaaattacataccacctattcagtactaagatcacaggcatgctggggaggaaaacagccagaccactctcatgctggactagaattgggtgggtggggctggacaggaagggtgtttgagggtcggggaaggctcccagaggaagttaggtctaggctgaggtctgacaactgggtgaggactaaccaggtaaggagagaggagaagagggttcttcatgatgaagaca

SEQ ID NO: 5391 - DNA, 218 bp, Homo sapiens
ggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactctagacctcagggaccgacttttgacccctctggccacaaag

SEQ ID NO: 5392 - DNA, 236 bp, Homo sapiens
taatggcacaacctgtcacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagttgccaggaataaagtaatctaatatacaagctttgattaaaacttgaaacaaggaaaaaaaaaataaaaacttcggga

SEQ ID NO: 5393 - DNA, 145 bp, Homo sapiens
tcaggatagagataatctcctgaaaaacctgaatttcagagattcttagacttgctgccaaaggatgaagctagtaaaggagaaaaagcttaaattccatcttgagctcttggattgtgataatacaatgagttcattaagcttt

SEQ ID NO: 5394 - DNA, 150 bp, Homo sapiens
gagaaagcacataccaaggccaccacacaccacctgtccaaaaagggccttcgatacggggataattcctattttatttaccctcagaaggttttttttccttccgcagggattttttccttaaccctttttaccactttccaagcctgt

SEQ ID NO: 5395 - DNA, 204 bp, Homo sapiens
ggcaatagcaggttcacgtacactgccctaaggatggctgcacggaacataccagtaagtggggcaagactgttatcgagtaccggtcacagaagacctcacggcttcccatcattgacattgcacccatcgacataggcagggcccgagcaggaattccagtgtggacatagggccggtatgcttcttgttaaaacctgaacc

SEQ ID NO: 5396 - DNA, 240 bp, Homo sapiens
ggaccctgcagccgcagagatgttgatgcctaagaagaaccggattgccatttatgacctcctttttaaggagggagtaattggtggccaggaaggatgtccacatgcctaaggcacccggagctggcagacaggaatgtccccacccttaatgtacatgaggcccatgcagtcttttaggtcccaggggctacgtataggacacagttttcctgtgagacatttcttcttggcacctta

SEQ ID NO: 5397 - DNA, 246 bp, Homo sapiens
acgaggtcctatttcgatgaacacgacttcgagccgtcggaccctgagcaggagacgcgaaccaacatgctgctggagctcgcaaggtcacttttcaataggatggactttgaagacttgggggttggtagtagattgggaccacaactcctcaacagactgtcaagactatggttgagaaaccttcccaggacaaatcatcaaagagctctcaaggctgagctcaagtgcccccctgtgtccttt

SEQ ID NO: 5398 - DNA, 240 bp, Homo sapiens
aaaatactgaattcctgggtaaggagatattttgttttaaaaataatgtgttttgatacgaatcagtgtattaactgataactaaaaagtactcttttttctatatatacatattttttgggagactcatatttcacaatcaacatattcaatcagtgagttatagtctcattcctagctaccacaaattctcgggcacttttaaacactaaacatttcatttatccccgaagctaaaat

SEQ ID NO: 5399 - DNA, 220 bp, Homo sapiens
cgtgccgaattcggcacgaggaaaaggccaaaactgtccattaataatgacattcaagcaaaggcaaaattctagagttagtaaaccaatcggtggctgctacttatgcagggttgaagcacagagggaattaaaaggataggtaaggccttttctgaaggtacccacaaggtgggatccatgactctatccatttgtaaaaccccacagatctatatag

SEQ ID NO: 5400 - DNA, 226 bp, Homo sapiens
ctcgtgccgagcttctcagactatccacctttgggtcgctttgctgttcgtgatatgagacagacagttgccggtgggtgtcatcaaagcagtggacaagaaggcttcttgagcttgcaaggtcaccaagtcttcccagaaagcttagaaggcttaaatgaatattatccctaatacctgccaacccaatctttaacctaaggtggtggaggacggctctagactc

SEQ ID NO: 5401 - DNA, 185 bp, Homo sapiens
gtactccagaggcagcagcccaggtggtgcagtgggtgagctttgctgattccgatatagtgccccccagccagtacctgggggtttccccaccttggggatcaagcaacaaaaccaaacaggcacttaggaattcaaaggagggaagttagggcgatttttggggcttcttggttcttacattt

SEQ ID NO: 5402 - DNA, 140 bp, Homo sapiens
cgggtatgaagatcgggcggattgaggatgtcacccccatcccctctgacagcactcgcaggaaggggggtcgccgttgtcgccgtcttttaacaagattctctaaaatattttctgttaataaatttgccttcaatgtt

SEQ ID NO: 5403 - DNA, 158 bp, Homo sapiens
cctgaggtccaggcttcctggcagaagatggtgactggagtcgccagtcccctgtcctccagataccaattagcttaatccccatgatggagagctttcaaggataggctttattttcaagcaatgcaaattattaatctattcttctaagagatcac

SEQ ID NO: 5404 - DNA, 248 bp, Homo sapiens
aagatgggcctccagaacttctgtttattcatggaggacacactgctaagatttcagattttagctggaaccccaatgagccttgggtcatttgctcagtgtctgaggataacatcatgcaggtatggcaaatggctgaaaatatttacaatgatggaagggtcagatgtcacggcatccgaactggagggacaaggtctcaaacccaagttcgggaaatgttccgttgaatgtaatagtacactgat

SEQ ID NO: 5405 - DNA, 120 bp, Homo sapiens
tggagcggtttgcattacggctgtaaatgtattcatcttaattatgtagggtttttttggtcgggaatctggatctttgaggggatgccaccaattttggtttctcctgttatgtgggac

SEQ ID NO: 5406 - DNA, 255 bp, Homo sapiens
aaactactgaacctgttacctaggttaacaaccctgttgagtatttgctgtttgtccagttaaggaatttttgttttgttttgtctatatgtgcggcttttcagaggaaatttaatcagtgtgacagaaaaaaaaattgttttatggtagcttttacttgcattgaaaaaaaatttatttgccttttaaattcttttccccaatccccctccaaagtgtttgtagcagcgttaatttggggttaaaccggggaaa

SEQ ID NO: 5407 - DNA, 220 bp, Homo sapiens
cacctctgtacagagaatacacctgcccctgtatatccttttttcccctcccctccctcccagtggtacttctactaaattgttgtcttgttttttattttttaaataaactgacaaatgacaaaatggtagcttatgatgtttacataaaagttctataagctgtgtatacagttttttatgtaaattattaaaaggcctatgatgatgccatttataa

SEQ ID NO: 5408 - DNA, 248 bp, Homo sapiens
aaagattggttaaaagctttggtttctagtaaaggttagtgtgtgtggtttttttaagaagctgttttgctaaattatttttacttgggatgtttcaaacagatttcaggctgcaaacttgttttataatcgtttgcttctccaagtgaagctcagaaatacctaaaaatagctgttacgttcgcgttaggaaagatgggtttattccagttgcattttatggggattaaatcctttccatgtgacct

SEQ ID NO: 5409 - DNA, 305 bp, Homo sapiens
tggcggaggtgcaggtcctggtgcttgatggtcgaggccatctcctgggccgcctggcgccaattcgtggctaaacaggtactgctgggccggaaggtggtggtcgtacgctgtgaaggcatcaacatttctggcaatttctacagaaacaagttgaagtacctcggctttccctccgcaagcggatgaacaccaacccttcccgagggccctatcactttccgggccccagacgcatattttggcggaccccgcgaggtatttctcccacaaaaacaagcgaggcacagcgctctggaaccctc

SEQ ID NO: 5410 - DNA, 215 bp, Homo sapiens
gtattgttatttttattatttttaatttaaacctgatgacttgcacagcatctttcccaccgggaagagcgggccttctgccttccctcctgcggggttggggttgggacagaccccagtgggggcccagggccacaattgagcgcagtttgggctggaccccctctttgctccaagggcttgcccgttttcgggggccgccggtttcaccactt

SEQ ID NO: 5411 - DNA, 285 bp, Homo sapiens
ctcgtgccgaattcggcacgagcgggcgcaaccttactcctgctgagctgcctgccaagcagcgagaacagcttcttgggatctgtgatgcagccctctgccggcaggtgcagctgctggggggtgcggctggtggtgggagttgggcgacttgcagagcagcgggcacgacgggctctggcaggccttatgccagaggtccacgttgaagggctcctgcatatctcttcccgtaacccacaaggccaacaagggctctggaggcagttgcacaggaaagattta

SEQ ID NO: 5412 - DNA, 271 bp, Homo sapiens
gccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagaccttacccgctttgtgaaattgccccgctatatcaggttgcagcggcagagagccatcctctatatgcggcttaaggtctcctgcgatttaccagttcacacagggctctgacgccaaacagct

SEQ ID NO: 5413 - DNA, 306 bp, Homo sapiens
gctggcaacaacttcatcatcactcccgctgcccactgcaagggcagcctccaagccatgggcccccgtccctgccatctcaggcctctgcctaccttctactggccttgtcaacatcaacaggggcttggcgatgactgtacctgggtgacaggatttaccctaggggcctccgggcgagcccggatgaatgcaaccttggggatggcaaagccaaggtttgtgaaattttgggataaggtaagggggaccccttgagaacacatatcaaggagaaggggtttttttcgggccctcggtggcacc

SEQ ID NO: 5414 - DNA, 128 bp, Homo sapiens
aaattcttctatattggctggtaaattgccatggccctgagccactgagtatgttcattgccacccctgtccctcccctgggaacccctaactttccctgatcctgaattaaaggggtaatgtgtggg

SEQ ID NO: 5415 - DNA, 168 bp, Homo sapiens
gccagagcttctcccaggcacaggtgttgcaccagggacttctgcttcaagttttggggtaaagacacctggatcagactccaagggctgccctgagtctggggacttctgcctccatggctggtcatgagagcaaccctagtccccttcgagacagcgccttccaga

SEQ ID NO: 5416 - DNA, 130 bp, Homo sapiens
atccctgagctgaacgggaagctcactggcatggccttccgtgtccccactgccaacgtgtcagtggtggacctgacctgccgtctggaaaaacctgccaaatatgatgacatcaggagggtgggaaggc

SEQ ID NO: 5417 - DNA, 132 bp, Homo sapiens
ggaagtttgccgttttcgtccatgccaagatggctgagctgcaggtgcgggacctgagcctgaagctgcagggcatccccggccacgggttcctcctccagttcctccaggggcagcacatgaaggaccagt

SEQ ID NO: 5418 - DNA, 167 bp, Homo sapiens
ctcgtgccgaattcggcacgaggacctacgcacacgagaacatgcctctcgcaaaggatctccttcatccctttccagaagaggggaagggggaaacacaagaaaggaacccgcctggttccagggccccaattccttctttatggtttttaaattcccccggtttb

SEQ ID NO: 5419 - DNA, 304 bp, Homo sapiens
gggaattttgtagattttgaaaaaacagatattttttatgagtcttcctattcataaaaatagtatgtctccatttactaatgtctttaagtgttatttcagtaaagctttctttcttttccacattggtcagctcctcttttttattggatttatcccctagcatttcatattttctgtcgctgttgtaaagggtaattttcacatttttatctatcactgatatagagagttgtaatatattccacatatagatctagtttaaggcagcatgctgagtactcaattctatatgcctataaac

SEQ ID NO: 5420 - DNA, 431 bp, Homo sapiens
gcgccccacaaccctgctcccccgacgtccaccgtgatccacatccgcagcgagacctccgtgcccgaccattgtcgtcttggtcccttgttaaccaccctcttaatgacccccttgcttgccttgggcttaatgggcatttggccttctccgttgaggttttggggacaggaagatgggttggcgacggtaccgggggcccaggcctattccctcaccgccaggacccataacactgtggccccatattttttgggcatcataaaaacactcttcataatgaaaatccagtccttaatcttccaggccctatggagtagtatcaggaggcatcactaaggccaggagctctcccatgacctatatccacgtactccaactccatcctggcctgccccggagccgagtctgtataagcctttatctaaagg

SEQ ID NO: 5421 - DNA, 162 bp, Homo sapiens
gctgtcttcgccttagtactcgtgtgaagttggcagggacggttcctgtcatcttcttgggcttatttggtgtgctgttgaaggggggagactagagaaatggcagggaaccccttatcccgggcaagtaggccccttttggacttggggcctcttgcgtgc

SEQ ID NO: 5422 - DNA, 168 bp, Homo sapiens
tcaagtaaaatgtctggttgtgccagacatttcacaagtgtgaaaggagataggagaagctcaacttgagggcgtgtagtaagttgtagaaggctcgaggggacgtggacttatttgccttgggtttcaatacccccaaataatgagtttgaaaagaacaaattaaat

SEQ ID NO: 5423 - DNA, 131 bp, Homo sapiens
ggcagaatatttaaactttatttttgtttgcccaatttattgttttaccgagttataaatgtttgctattttaggcaaatgttgctttggtttttaaaggaaattcttcctttggggaaaaaaaggattcc

SEQ ID NO: 5424 - DNA, 124 bp, Homo sapiens
cttcaaattttgggcccatgaagggaggaaattttggaggcagaagctcttggcccctattggcggttggaggccaattacttttcaaaaaccaggaaaccaaggggggttatgcgggttccca

SEQ ID NO: 5425 - DNA, 119 bp, Homo sapiens
tcgtgccaaaaaacccttacaatgttttcttgttaaaggccgtctgacagtcctgagaataattaatggtagggattaaaaaattttcacagatgctctcggtgaggaactctaggggt

SEQ ID NO: 5426 - DNA, 114 bp, Homo sapiens
aacaactagaggtctgaataggtagttgaatctagttatgatcatcagtgttggatggcagagatgcctgggatttctctttatgttaaattttagattaaggaaagtttccct

SEQ ID NO: 5427 - DNA, 108 bp, Homo sapiens
ctcgtgccgaattcggcacgagcttaaagttaaggcagtttttatggcgttttgtagtaaattctgtaaaatactttggtttaatttttgactttttttgtaagaaat

SEQ ID NO: 5428 - DNA, 356 bp, Homo sapiens
tggcacaaatcttgttcattatcagagccagtgcatactagcgtcttgtttgttgcccattgcctatacttttcacctgagatgtgtgagttggggccttttaaaaactactgaattgtctgagccttgaggacatttccagggagaggagataatctctcatttcacccacaggctggtctaatcataacctagttaaagatgtcctcgtttaagaaccccattatttatttttagttttaatataaattaacacgtgggcattatatttctcctcaaatgaggaattttaaatttattgacctacctctgagctttaaaaaggagaagagggtaggggtgggaactggcatact

SEQ ID NO: 5429 - DNA, 263 bp, Homo sapiens
cgatgactgctacacctcagcccggggctgcactgccaccctgggcaacttcgccaaggccacctttgatgccatttctaagacctacagctacctgacccccgacccttggaaggagcctttattcaccaaggctccctatcaggagttcactgaccacctcgtcaaggccccaccagagtttcccggcagcgggctcagggtccaactgtggctacaacataggggttttatacaagagaaataaagtgagttaacgtgta

SEQ ID NO: 5430 - DNA, 157 bp, Homo sapiens
gggacccgctattgggccttccttccggaaaattggtaaaggaaaatttaaatcagccagcacgccaagtacaattgctttttctttggggcaaaaccaaggttaaggaacggcctttggggatcctggcactttggttcccgcattaaggcaatgg

SEQ ID NO: 5431 - DNA, 163 bp, Homo sapiens
cctcaatatgagtttcgattggtaacgtgtttttgtttgggaagtaattttgtttgaaaatgctctaacaaacaggaattagggcctagattgtaagctcttgcagcagtcaaatttgttcccgggctttggggttatttctaaatttttgagggccttccta

SEQ ID NO: 5432 - DNA, 248 bp, Homo sapiens
gagagttgagacccctagactaatacttgaatcttatttagaatcttagaatgggggagccagaaagagccttctaagtctaatctgggatttctcatgttctgaagattattgtttcaggggatattattagggtattctcagaaaagggttccttagccaaatgtgtctggaaactttagcatgtgcctatatccggctctttggaaattcactgtgctttttagaactttaaggctctcagaagg

SEQ ID NO: 5433 - DNA, 272 bp, Homo sapiens
aacgccagatgcgtgaaatggaagagaactttgccgttgaagctgctaactaccaagacactattggccgcctgcaggatgagattcagaatatgaaggaggaaatggctcgtcaccttcgtgaataccaaggcctgcctcaatgttaagatggcccttgacattgagagttgccacctacaggaagctccctgggaaggcgaggagagcaaggtttctctccccctttccaacttttccccccgtaaccctaggggaactcaactcgggty

SEQ ID NO: 5434 - DNA, 263 bp, Homo sapiens
aggagaaaagaggggcctgggaagggaagaaaacagcagggaagaggagggctgaagacagagcaggaggaaggctgagtggctttagctctttggcctaacccagaccagtcagagttcactctgggcacctcccagtggcagccacttgatttgcaggcaaagagcttggagaacccgctctccaaattcagccttatccatgtccacataggggataggccccggaaagcactcaacaaatatgcactataatgggtggs

SEQ ID NO: 5435 - DNA, 167 bp, Homo sapiens
gcctagcccactggctccctggaagagatcaagccatcggagctgctagagttctgtctggactttccagagaccagtattcccttttgctgcctctaaaaggcctttcccttcagccatgagagacagcaggtctcatgggggttacaagctttttttttttttyt

SEQ ID NO: 5436 - DNA, 316 bp, Homo sapiens
aagccgtacccaaagtctcgcttctgccgaggtgtccctgatgccaagattcgcatttttgacctggggcggaaaaaggcaaaagtggatgagtttccgttttgtggccacatggtgtcagatgattatgagcagctgtcctcttgaagccctggaggttgcccgatttgtgccaataagtacatggtaaaaagttgtggcaaagatggtttccatatccgggtgcggttccaccctttccacgtcatccggatcaacaagatgttgttcccgtgcttgggctgacaggtccaacaggaatgcgaggtgcctttgr

SEQ ID NO: 5437 - DNA, 332 bp, Homo sapiens
cgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctcctggtggggctgtagccgtctctgctgccccaggctctacagaccctgctgctggttctgccctcttgcagcagaggagaagagagatg

SEQ ID NO: 5438 - DNA, 329 bp, Homo sapiens
gaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccctgagtgac

SEQ ID NO: 5439 - DNA, 331 bp, Homo sapiens
tttggctgtccggacggtgcagcggcgaggccggccgcgaagatgccagtggcggtgatggcggaaagcgcctttagtttcaaaaagttgcttgatcagtgcgagaaccaggagctcgaggcccctggaggaattgctacacccccagtgtatggtcagcttctagctttatatttgctccataatgacatgaataatgcaagatatctttggaaagaataccacctgctataaaatctgcaaattctgaacttgggggaatttggtcagtaggacaaagaatctggcagagagatttccctgggatctatacaaccatcaacgctcacca

SEQ ID NO: 5440 - DNA, 332 bp, Homo sapiens
cagcagcaaggtcagcggcgtcctgaagaagctggcacagagccgcagaaccgcgcttgccacctcccccatcaccgtcggggacctgggcatcgtgcggcggaggtttcgggacgtcccggagagcccccagcatgcggccgacacccccaagtctggggaaccgcgggtaccagaggaggctgcccaggaccggcccatgtcccccggagactttccttcggaaacaactgagacccccaagtgcagcagcccgaggggcaggaagggagccgtcaggacaagccctttcgccagcaggcttctcccaggaggcagtgacacccccgaca

SEQ ID NO: 5441 - DNA, 141 bp, Homo sapiens
ctcgtgccgaattcggcacgaggttcagcaggctgatgaataagatctaagagttacctggctacagaaagaagatgccagatgacacttaagacctacttgtgatatttaaatgatgcaataaaagacctattgatttgg

SEQ ID NO: 5442 - DNA, 331 bp, Homo sapiens
taagctcttctcttgactgattcattctgagtttccagatgatatcagccctaatatcacctcctgtcatgagagctcttccccagtcactctgttacactcccctgttcatttccttcacagcagttaccacggtccgcagttgtggtatttctgtgttatttgactatcattcccatcagaattaattcctactttgtttcctctcaaattgccagcacctaaatttgttaatcaactgaattttaaagggagagttttcggggtctgagacaggagggacacttaggcccgagttcgagagcacgtgttggcaacacatggagaccca

SEQ ID NO: 5443 - DNA, 270 bp, Homo sapiens
aataccatgaacattaatgcttccatttatgatgagattcagcaggaaatgaagcgtgctaaagtgtctcaagcactgtttgcaaaggttgcagcaaccaaaagccagggatggttgtgcgagctgttacgttggaaagaagatccttctccagaaacagaaccctgtgggagaacctcttccatgatccgaaggttcctcagtctttctcagccagaacgtgatgccatttatgaacaggagagcaacgcggtgcattcaccattgcga

SEQ ID NO: 5444 - DNA, 310 bp, Homo sapiens
tcgccatacttgcggacggttcgctggggccccagctgtacggagtcttcccagagggccggctggaacagtacatcccaagtcggccattgaaaactcaagagcttcgagagccagttttgtcagcagccattgccacgaagatggcgcaatttcatggcatggagatgcctttcaccaaggagccccactggcctgtttgggaccattgagccgtacctaaacaggtccgggcctgccccaacttggcttcctagagttgaaccctctgagattatcagcttaaggatgagatatggaacctagagga

SEQ ID NO: 5445 - DNA, 165 bp, Homo sapiens
catcagcagcatggagctgaagaccgagccctttgatgacttcctgttcccagcatcatccaggcccagtggctctgagacagcccgctccgtgccagacatggacctatctgggtccttctatgcagcagactggggagcctctgcacagtaggctcccttggg

SEQ ID NO: 5446 - DNA, 220 bp, Homo sapiens
ggagcagctctgtgcttggacatcagtgggccaaggttcttgtccctggttcactgtgatttggctttccggttctttcctgggatgcctttttggggttccttgggtttgggttggaagaggccatttccctaatttaacctctaggttttccgaggcccttgggcctggttttttttagctttggacagtgtgcccctttttccttctggtttgcctc

SEQ ID NO: 5447 - DNA, 101 bp, Homo sapiens
aatatgctgacagttggagataggaaaaggcaatttacttatgctggcccaaaaagggttaattttcatttgtggctttaaaagggttttgtttttctcaa

SEQ ID NO: 5448 - DNA, 100 bp, Homo sapiens
caatgtaatagcaatgcaaattaaactttaatgggtattctggccacctggtgggtggctaaggtaaggttcttaacactttaaagtgctgtcatcgggg

SEQ ID NO: 5449 - DNA, 101 bp, Homo sapiens
tccgaatttcggcacgaggaaaagtcccaatgtacggccccgggtttaaggaaggaaaattaataggctagtccctttcatttaaatttggaaaagttgga

SEQ ID NO: 5450 - DNA, 110 bp, Homo sapiens
tcgtgccgaattcggcacgagctacgccgagtgacagagacgctcaggctgtgttctcaggatgaccgagttgggagaacagcagcaccagcggtggcagagaccccaga

SEQ ID NO: 5451 - DNA, 222 bp, Homo sapiens
agctgcaatctcatcactggaatgttccagcgactggacaagctgaggaggatttgccttcgccagtgtacatcctttttggaaccaacaatttggcagctccatttcctggacgtttgggttttccaaggccaggagcttgccttttccggttaagttcagattggcaggtggactacgagtaataaaaatggcggaaattggatcctggcagcgaggaga

SEQ ID NO: 5452 - DNA, 146 bp, Homo sapiens
acaattcggggtttcggcttgtcgggagtcaataagtacgaacagtgctctgctacattgtagagtttctgtagagatcaaatttgactccactttaggggttccaaagcaaattgtccatgtttaagatgattatttaacttgcw

SEQ ID NO: 5453 - DNA, 178 bp, Homo sapiens
tgatgttacagaagtctcgctccagacatggtcctcggcttctcctcggagcgcaagccaggcatcgtgggaggtgagagcttcctaggatgaccgtccagccgctccacctacagccttcctggatacaggctggcatgactacatcgtccggaagtcgacagccgggatccaaggt

SEQ ID NO: 5454 - DNA, 108 bp, Homo sapiens
ggacatgatttcattctttttatggctgtgtagtatttcataggttcataggtgtatatggtgccacatttttcctcatccctgacaaccattatggcatctaggtta

SEQ ID NO: 5455 - DNA, 142 bp, Homo sapiens
gtttactttgttccaggccctattctaagcactttacatgtgttaattcatggaatcctctcaatatactataattaaccccacctgaaaaatgagaaaactaaagaacagagaaggtaaataattatgtgtccgaggtcct

SEQ ID NO: 5456 - DNA, 160 bp, Homo sapiens
caacccatctgaggctgcggcgtacacaatataggcaagggactgctggcaacggtacgggtgttggccatgaattctttggagatcttttgaggtggcaccacagcacatcggcagcctcaccatcgcagagatgccctgctggcgcaagtgggtctca

SEQ ID NO: 5457 - DNA, 168 bp, Homo sapiens
cagaagcggcgcacggcaccctcggaggagccgccccagcacagcccactgagaggagcttccaggacggacccaggccgctgagcccaggagcctgccaggctgacgtgcatcccacccagacggtgtcctcttcttgtcgctttttgtcatataaggatcccatta

SEQ ID NO: 5458 - DNA, 101 bp, Homo sapiens
ataggagccttccatctccaggatattctctatggggctgcccgttccaaaccgtacgaacatcctagagagcagatcggaagcagcaatgtagaggctga

SEQ ID NO: 5459 - DNA, 316 bp, Homo sapiens
atttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattccttactttccacgactggggcgctacaatctcaattttc

SEQ ID NO: 5460 - DNA, 269 bp, Homo sapiens
caggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgactgggcagactgcaaaataaaatctcgggtttctatttatttattgtcttcctgtag

SEQ ID NO: 5461 - DNA, 285 bp, Homo sapiens
aggaataagcaagtgtgaaggccataaagtatgaaagagttcagtggattcaaactatagaaagaaggccagagaagatggaatgtgactagcccagggcaagatggtggatgacatgagctaatattggagagctaggaaggggtaagctcacaactggctttaaagatggtagtaggaatatggaattctatgatatagactccactgataggttacaagcaggatagcgatgtgatgtatacagtcatacagtcacatgctgccaattatgttttagttgat

SEQ ID NO: 5462 - DNA, 284 bp, Homo sapiens
cctctatggacagtgagtttgttttaatagatgtgctgtatccactgtgtgtgtgtctgggttttcaaaggcatattcacttgttgtaataggtttaattacctgtccaagggtggccaaattcaattataccttggtatatcttgtaaggcaaattacaattgtatcttgctgcaaccatatacaccatgtcacttgctgctctagcagtctgacctctcatcacataatcatgccacctttatcttcccactaataattccctctgactcttttaaattaaa

SEQ ID NO: 5463 - DNA, 225 bp, Homo sapiens
tctgccacagacctttgggctgccttatattgtgtgtgtgtgtgggtgtgtgtgttttttgacaacaaaacaatgcaagcattgtttcaacccatatttcctctgccatctctctgggggtgaagggaggctacctggggggggatcgccccactgacagacctaatctaattactgcctgtggctagagagtttgaggattgctttttaaaagagacagcacac

SEQ ID NO: 5464 - DNA, 180 bp, Homo sapiens
gttctctcctttccagtcggagacctctgccgcaaacatgctccgccagatcatcggtcaggccaagaagcatcccgagcttgatccccctctttggtatttaatgggaacttggagctactgggggccacatgtatcctctggcgtcttggcatggtcaattccaaagttttgttgggg

SEQ ID NO: 5465 - DNA, 280 bp, Homo sapiens
aaaacctggatgaggaagggtttgaaagtggagactgcggtgatgatgaagatgagtgcattggaggctctggtgatggaattataaaaggtaaggaatcagcttccgctttccttgcaggaccttggcctatgatcctggatgtggatgatgcgcctggaaacagtcagcaggcacctccgagggcaccgggataggcacctttcacaccctcgggaacgttcattcccgctgaggcttctcaccagcatgccatctcggtgtgtgctctcttcctggt

SEQ ID NO: 5466 - DNA, 195 bp, Homo sapiens
gacaagttggataccttagttgattttcctatcactgacttggatatgtcggaattcttaattaatccaaatgcaggtcccttgccgctattatctgatgcttgttccaacccactatggagggatgggagggaggcaattatacttttttgccaaaaattaaggtgagggaaaatggacctattttgaggacag

SEQ ID NO: 5467 - DNA, 140 bp, Homo sapiens
cggaaatccatatgagcttggaggtagaggagttggtggtgttggatttggttgttggttggttctgattgttcaacctagtaggtctcttaagtaagaggtgctgttggttggttaccttaagaagtttggagaacttg

SEQ ID NO: 5468 - DNA, 105 bp, Homo sapiens
ggcggttgaaatagtcccacatgtggtcatcagaaaataagccatttcctcataccaatataggatcagcttccttgaccctctagggtcaggagttcttcccat

SEQ ID NO: 5469 - DNA, 290 bp, Homo sapiens
cggcacgagttggatcgacatgacaatacagttataactgcagttaataacatgactctgaaaggttgggattcttacaattggcaactaattcatgttcctgatgggtcatgaggttaaggtattgttctttgacccaaccgttcgattctagagagttctctttcgtctcgggcaataaggaaaacggtagagtgtgggtatctgcgcaagaggatacaatatcggatcttaatctcatataggggtatgtacactctctcattatatacatctagaggatgagggcg

SEQ ID NO: 5470 - DNA, 160 bp, Homo sapiens
gaactatctcgcgttttttttttatttattgtcttcctgtaagaccttcgggtamaaggcagaggcaggaaactaacttggtgtgaggtcaaatggccccttaagttacttcccccagcccaaggccaagaggccttcctttaagggtcccggcaaagaa

SEQ ID NO: 5471 - DNA, 160 bp, Homo sapiens
tgttagggttctttgtttttggggtttggcagagatgtgtttaagtgctgtggccagaagcggggggagggggggttttggtgaaatttttttgttattatgtctgtgtgaagcggcttttcagacattcaattgttattattatgtcctacaagcattt

SEQ ID NO: 5472 - DNA, 165 bp, Homo sapiens
gaaagaacctgagctcttcctaagtagatccacgcctgtcgcaggcaaggccaagcaggcccatctcacaacccttaaggacatacaagcaaccctgtgtggaggagtttggagagaggattctgagatatagagattatattttcccaaaggtatagacttagt

SEQ ID NO: 5473 - DNA, 132 bp, Homo sapiens
acagtcaactcaggattttggtactcagaaaaaatattctcaggatgacaggagatcatgacaatcttaagttaagggaggattaggggatttttccaagaaggcttacccagaagggattgatctaaggga

SEQ ID NO: 5474 - DNA, 267 bp, Homo sapiens
  misc_feature 251: n = A,T,C or G
cttttttttagcttcaccgatgacaacagaggaggagggactgggatttggtaagtctcctcactgtttaccaaatcctaagtaataaatatgtgtccagaccctagaggagaccggctgactccttttaaggtgtggcacataggatctcagattttccctgagacagagagaggatcttgtgtatttttccccatatccactgatatatgacctaattgtattgtatatatgtcaccacacatatgatngccatccaccatttgt

SEQ ID NO: 5475 - DNA, 150 bp, Homo sapiens
agtaggaacctgttaaacgttaattttccctgccttcctcaggtttccctaatgttgggaaagtcctcgttgatctaattggcttggttgggccggaaaagtctgttaggttctctcaagacccccgggcccaacccccgatacttttaa

SEQ ID NO: 5476 - DNA, 250 bp, Homo sapiens
gcggcgcacagttccagtccgttgctttactttttgctcacgacatagtcattattccgaaggggaaggtttccaggggattacaaggggccaaaggtgggttccaaagtaactaaccgggagcccacaaggcgtgttcccaaatttttcaaccgaaccttttyccaccaaaaccctgacccmaamccrgggaraahatyttytaagaragacctgggagcaaagtttagcagaagcttctaaagggaag

SEQ ID NO: 5477 - DNA, 285 bp, Homo sapiens
aatattttttgtcattattacattaaggaaatttattatccaggtgacagtacatactagagtttttggaggaggtaggagccttgacctaaaaaggttgttttttcctgccaagaggcaaatttaaccaaggtgtgtcccagttaggtaaacccgagtatattgagagagggagagatctttgaacacgagatgatgcacttgcaaatgtgtgcaaggctttttcctgtaatgcaaatagggtgtcttctgtagaaatgtaaaggcactgagcctaagcatgag

SEQ ID NO: 5478 - DNA, 170 bp, Homo sapiens
aagcagcttcacctctctaccttagccatcagttaacaggctgagaaccacactaataggtcatggcaataacaatacaatgtcccattaattaggtatggaaatacacacacacacatttccctaatctattcccttttcaggatacaccatttacacatattctcact

SEQ ID NO: 5479 - DNA, 358 bp, Homo sapiens
gggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttgggaaaggtgcggggcagtcctggtcagacactcatgccctggcaatgtggctgccagagaatgttgttgctacccaccagtttcttgttgatttggagaggtcaggccaggccccactcgcttg

SEQ ID NO: 5480 - DNA, 359 bp, Homo sapiens
ctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatccagccaagaactggtataggagctccaaggacaagaaacacgtctggctaggagaaactatcaatgctggcagccagtttgatatattgtagaggagtacttccagg

SEQ ID NO: 5481 - DNA, 352 bp, Homo sapiens
aaacagtaagaagggataatcattaagatagtaaaacaggcaaagcagaatcacatgtgcacacacacatacacatgtaaacattggaatgcataagttttaatattttagcgctatcagtttctaaatgcattattactactgccctctccaagattcatttagttcaaacagtatccgtaaactaggatatgccacatgcattcatgggatcttttaagtactcttcagtttgttccaggaaatgtgcctactgaaatcaaattaatttgtattcaatgtgtacttcaaggctctaattgtttcatctgaagcctacaatgaatcattgttcaccttgaaaataaatttg

SEQ ID NO: 5482 - DNA, 348 bp, Homo sapiens; identical to SEQ ID NO: 3634

SEQ ID NO: 5483 - DNA, 310 bp, Homo sapiens
aggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcagggtttctgtgcccctgtggtggaagagggcacgacacagcccgcaggttcttgggctcctcaggtcgcagggttggatgtgagtcaatgcggattatccactcgccacagttatcagctgccattgctccctgctgtttcccactctctaatttg

SEQ ID NO: 5484 - DNA, 299 bp, Homo sapiens
cattgacattgcacccatggacataggagggcccgagcaggaattcggtgtggacatagggccggtctgcttcttgtaaaaacctgaacccagaaaacaacacaatccgttgcaaacccaaaggacccaagtactttccaatctcagtcactctaggactctgcactgaatggctgacctgacctgatgtccattcatcccaccctctcacagttcggacttttctcccctctcttcctaagagacctgaactgggcaagcttgcaaaattaaatctcggtgtcttattaattaattgg

SEQ ID NO: 5485 - DNA, 209 bp, Homo sapiens
gtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctagggcttttccactccaacccaggccacctttgtctctgccccagagttggagaaaaaatctt

SEQ ID NO: 5486 - DNA, 202 bp, Homo sapiens
ctgttcttaagtgcttgaaagacgtaaaccaaagtgcactttatctcatttatcttatggtggagacacaggaacaaattctctaagagactgtgtttctttagttgagaagaacttcattgagtagctgtgatatgttcgatactaaggaaaactaaacagatcacctttgacatgcgttgtagagtgggatagagagggc

SEQ ID NO: 5487 - DNA, 215 bp, Homo sapiens
tttacattaaagttaaaatcgatcttgtgtttcttcaaccttcaaaactatctcatctgtcagatttttaaaactccaccacaggttttggcatctttgtgctgtatcttttaagtgcatgtgaaatttgtaaaatagagataagtacagtatgtatattttgtaaatctcccatttttgtaagagaatatatattgtatttatacatttttact

SEQ ID NO: 5488 - DNA, 336 bp, Homo sapiens
ttaactgatgactctgctgtcttccctccaagggaaaggaaagagaacttactgaatagcaccgctcttctatatgtgattgtcaagtaggacttctgtaatcatactgaaggtaatacattgtaatcatgctgaaggtaatcatctttgccccagctctcggatggtgtttctcacccaggctccttcaccaggcgtggttcatgcagacagccatgcagcagtaggctttcaagggtcaggcctttgttaaatgctcgctgacagcctgcatggtgcaggaggctggctcacagaaaccgggaagccaggaggtccgggggtcaggcactcagg

SEQ ID NO: 5489 - DNA, 207 bp, Homo sapiens
cttgaatgtaggtaatttaaatttccaaatgaaagatagatactggctaaatgaattaaaaaaataaacccaattacatgctgcctataagagactgacttcacctgtaaagccacccatagactgtaagggaatggatagagagagatatttcacacaaacagacaccaaaagcatgcaggagtagacagacacaaatactgagtc

SEQ ID NO: 5490 - DNA, 265 bp, Homo sapiens
gaaccatccaggccaaataagcgccggctatgccctgtattggattgccacacggctcacattgcatgcaagtttgctgagctgaaggaaaggattgatcgccgttctggtaaaaagctggaagatggccctaaattcttgaagtcttgtgatgctgccattgttgatatggttctggcagcccatgtgtgttgagagctctcagactatccacctttgggtcgctttgctgttcgtgatatgagacagacagttgcggtgggtg

SEQ ID NO: 5491 - DNA, 331 bp, Homo sapiens
cagagatggggtggaagccctgcctgggaataggacctcgttcttccctgcccggtgggtgggagtagtggcaggaccttgtcaccaggctctgatgaaggcagggaccagcttcttgggatctttcaatcccaaactcttgcccttcactcatcgcagttctccccacggctactccaggtcctcttgaaatccgtcctctccatggactcccacatcctctctgctctaggtttgattaacagaggttgtaaatgaaaccagcatctccgggggcagccatgtctactgacagatggcaggttactttgtacctgctaattttgttttt

SEQ ID NO: 5492 - DNA, 303 bp, Homo sapiens
aaaaaaacgagaagacatactgaaggcatgcaagcagatgcagatgataatattcttgattactcggatggaatggaagaaatatttggttcctcaattccctgaaacaagacattgagatatgaaatttccatgggtactcagacaatccagcccgaacttgtaagactgcactcagccatctgactcccagatggtgatattggattgatctaaccaggttgctcaggagattccttcaaagttactgtatttcacatctggggggggctgcattatcagcaaaatctgagggggagattc

SEQ ID NO: 5493 - DNA, 374 bp, Homo sapiens
gagagagaactagtcttgagttttttttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaggctgctaaatacgtgtctggcaggtaaagctggaaattacttaaacaggaaagtgtcattaaaaaacttgagcacacaacatattttttcttaaatgtcacgta

SEQ ID NO: 5494 - DNA, 407 bp, Homo sapiens
gccaagaatgttttcattaatcaagaacgaaagtcggaggttcgaagacgatcagataccgtcgtagttccgaccataaacgatgccgaccggcgatgcggcggcgttattccatgacccgccggcagcttccgggaaaccaaagtctttgggttccggggggagtatggttgcaaagctgaaacttaaaggaattgacggaagggcaccaccaggagtggatgtttttcagtggcctttaggagtagcaacatacaggaattttctgtggtggaggcaagttggtcaatgctgcatgatgagaggccatatttatgtaatttcttaggacgtttatgaaattcatccagacaggcactaatgacattttgaaaaggatggacgttagcttgttgggtttcagcagg

SEQ ID NO: 5495 - DNA, 396 bp, Homo sapiens
gctgcaggttgctcagaggcgccgcggccagcgcttttcttgaatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagttccttcgctattctgagagccttttaggtgtcctattgcatatgataacatcaaagttgtggagagcttggagatatttatgatgatcaggacacattcatcttaacattgagcgattttgttatttctgcctgaccaggcagagctatgggttagttataagt

SEQ ID NO: 5496 - DNA, 218 bp, Homo sapiens
gaggccgcacgttttggcccgggagtggagggccagtcctacccctggcagtagggggcgttttgaagcttcggctctgtgagcttgtggctactgctactggggtctagtttgacggcagatttttgccagacgaggagacgtagcttatcacgagtacgtgaacctcacattgagctgcggggcgacgtcattcccgaggtcttacttgcgttcat

SEQ ID NO: 5497 - DNA, 302 bp, Homo sapiens
tccagactgaggaagacccggaaacttaggggccacgtgagccacggccacggcccaataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagcacgggtgattgctgctaaaacaagactggggctgtccctatcattgatgtgt

SEQ ID NO: 5498 - DNA, 245 bp, Homo sapiens
ctttagctgtttctctgtggtcattctggagtcaaattcaatatgaatgccttgtgagaaatgcttttattgactataaaatcagcagtctgaagagaaggtcatttctgatacagtattatagtcatttctgcacaccaatgccaattagagactatagatatgtacagcagtaagtaaggtcctcagtgatcatgctgatcactgaatcatatccaaaaatcgagcccagtatttccaggcct

SEQ ID NO: 5499 - DNA, 205 bp, Homo sapiens
ggagcaaccagctgttctcttgcacagatcgagagtgagggtatttgtgacattacacagcatcaggagcctggtgcctcatcaggtgtaagttcttataaccactcttggcaatttattaaggcagggtacaagtcatctgtaactcatggtggctctacggttacttggattccacaatccctaacccatctgtcctggcaga

SEQ ID NO: 5500 - DNA, 279 bp, Homo sapiens
gtgaaaaaaaaggtcttggtgaggtgccgcatttatctgtcatattctctgcgcctttcgagagcttccagcagcggtatgtgggcagagcatccgagttcacacctctgtggtcgtagagccactatgaggaggcccctgggagatttgccatttcagtggaaacagtggtcgttactagctaagatgtgtttgtactttggatctgcatttgctacacccttcctagtagtagacaccactgcttaaacataggatgtttcagttctacattacagt

SEQ ID NO: 5501 - DNA, 123 bp, Homo sapiens
ctcgtgccgaattcggcacgagggtcgatggagtcgaagcgctgaagggaatagggcggctttccttccagcggagcatcattcggctgtttacccaaaacaaacatcttaatttccaccttt

SEQ ID NO: 5502 - DNA, 170 bp, Homo sapiens
gtttttttttggtggggcggggggcggtaatagggtctcgctctttcaccaggctggagtacagtaatgacttctaactgcagcctccacctcctgggctaaaagtgatcctccaacgtaaagcctctcgagtagctaggactacaggcacatgccaccaccaaagccca

SEQ ID NO: 5503 - DNA, 170 bp, Homo sapiens
ttttgctttctaaagaagaatatatacaaattatggtttaaaaggagcagttggagccgggtgcggtggctcttggactgtaatcccaacactttggggggccgaggctgggtgggatcaccttcatgtcaggagtttcgggaccagcctgggcccaacatggccaaaac

SEQ ID NO: 5504 - DNA, 215 bp, Homo sapiens
cgccgcgccgccatcatggacacagccgtgtgcagcctatcaagctggccagggtcaccaaggtcctgggcaggaccggttctcagggacagtgcacgcaggtcgcgtggaattcatggacgacacgagccgatccatcatccgcaatgtaaaaggccccgtgcgcgagggcgacgtgctcacccttttggagtcaagagcgagaagcccggagg

SEQ ID NO: 5505 - DNA, 130 bp, Homo sapiens
gggagagatccctgcagaacccaccaaccagaacgtggtttgcctgaggctgtaactgagagaaagattctggggctgtgttatgaaaatataggcaatctcacataaggccaggtcatcaccatttcct

SEQ ID NO: 5506 - DNA, 141 bp, Homo sapiens
agggtattgcctcccacccctgcctctgcctcgcagagacagccaccttacactcctaaaccagctgctgcagggtttgcggcaggacctcaggcaaagccaggaagcaagcaacacagcttccacaaagcttaaaccaac

SEQ ID NO: 5507 - DNA, 135 bp, Homo sapiens
  misc_feature 97: n = A,T,C or G
cggcacgagctcgtgccaaattcggcacgagaagatactaaaaactataaaaattagatagcagtgcttgcttctttatagatacattagaaatacngttccaaataacatacttgaatatcatctttgaagtaa

SEQ ID NO: 5508 - DNA, 188 bp, Homo sapiens
cagcagtctcctggaggagcagttccagcagggcaagcttcttgcgtgcatcgcttcaaggccgggacagttttggcccagcagattgctattttctagagggcaaagagttggagttctatcttagggaaatcaaggcccccaaggcaaataaattcctgttttgtcttcaaccatgtaataaaggg

SEQ ID NO: 5509 - DNA, 133 bp, Homo sapiens
aaaaaacacacaaacctgttagtttcaaaaatgacattgcttgcttaaaggtctgaagtaaaggcttgttaaggttctcttaggtttgatttgagggcatcccgtaaaggtggtaggttgccaggattcccaa

SEQ ID NO: 5510 - DNA, 116 bp, Homo sapiens
cactgatttgatctgtgaacccagaaaatctgagacacagtctcagtttatatagagagtttattttggccaagggttggaggccgttgcctgttacaacagcctcaaggaggtcc

SEQ ID NO: 5511 - DNA, 125 bp, Homo sapiens
gtcacctttgctccagtcaacgttacaacggaagtcaaatctctcgaatacacatgaagcttttagtgaactcttccctgggcaccattttggcttcaatttcaaaaattttttctttcaaagat

SEQ ID NO: 5512 - DNA, 137 bp, Homo sapiens
cgagcttttaagctaacccgggatgctattgagttaaatgcagccaattatacagtgtggcatttccggagagttcttttgaagtcacttcagaaggatctacatgaggaaatgaactacatacactgcaataattg

SEQ ID NO: 5513 - DNA, 131 bp, Homo sapiens
tgtcaagtgaagacatttcattttttagcataggctagtgggcaggtccgcacagtcgaagccacacctggtctgttttctgtgcactgtagccttagtgtcacctttcttcttgtgtctcctaatggtac

SEQ ID NO: 5514 - DNA, 164 bp, Homo sapiens
ggctgcagataatcagagggaagaggctgcagataatcagagggcaggggccccagctgaggagggggcagaggctgcagataaccagcgggaagaaggctgcagataatcagagggcagaggccccaactgaccagagggtcacaggggcacagactatctac

SEQ ID NO: 5515 - DNA, 251 bp, Homo sapiens
tttaggtgaagtgttctctctcatgcaacagtaaaattaatataatattttccccacaaaagggacacttaacagaggcaaggtgcaatttataaatttatatctaaagggggatcatgattataagtcctccagcccttggactctaaattggaggggattaaaaggaatttaaaataattttgaccgaatttattttccccccagtttttgagggcattaaaaagggcattatatcaggcatatcatgt

SEQ ID NO: 5516 - DNA, 265 bp, Homo sapiens
tcgtgccgaaattcggcacgaggagattattaccaaaagcagcagggctatgctgcttgccaaacaaccaagaaggtgttcccgattagagtgcagaggtgggtgtgcaggagggcagtgctgtggaccgctgaggagcaagcggcggaaatattctttcgaatgcactgacggctcctactttgtggacgaggttgagaaagtggtgaagtgcggctgtacgaggtgtgtgtcctaaacacactcccggcagctctgtctttgg

SEQ ID NO: 5517 - DNA, 195 bp, Homo sapiens
gtttggtagaagagctggaggctgacgagtggcggtttaagcccatcgagcagcttctgggattcaccccctcttcaggttgatacttccctgatggtaacctcttgtgcgcagaagtgcaaagccagttggggactttctcacaacttacatagccatcccgaggtccacaactacgtcacttaatttttaatg

SEQ ID NO: 5518 - DNA, 240 bp, Homo sapiens
ggctattctacttactgcttagggtgtttgaaacaggatatatttactggatgaaaaaatgggctatattgagctgtctggcgttatgtaacgtgctttgggtatctgtgggactgctcccatgaggttattttcattggggttaatcagagaaccactctgggaaatgtgttggacccaccaagatcataaaatgagcttaatgattactcacacagcttcaagcgcgagtggagagag

SEQ ID NO: 5519 - DNA, 205 bp, Homo sapiens
ggacactaggaaaaaaccttgtagagagagtaaaaaatttaacaccatagtaggcctaaaagcagccaccaattaagaaagcgttcaagctcaacaccactacctaaaaaattccaaacatataacttaactctctcacaaccaattgggccaatctatcaccctatagaagaactaatattagtatatagtaacatagaaacat

SEQ ID NO: 5520 - DNA, 170 bp, Homo sapiens
cggcacgaggtaacaacttggagggcctctaatadgtggcaataccttcccaccacccaaagaattgcgagaaataattcagattaggtaatgaccaacttccaagggggtggacccttcttgccaacaaagaaacatattgtcccaaagtcaccaaagtcccccctctt

SEQ ID NO: 5521 - DNA, 180 bp, Homo sapiens
gagaggattcgtatggaaacattcttagcggaaaccctctcttaatctcactggcccatcccagcctcaggccaacttcaaagttaaaaggagggtgggatgatgacgttgtcttcaaggacctttccaaaaggtgtagatgacccagaggagagarcaaaaggatttgtaaatgacaca

SEQ ID NO: 5522 - DNA, 295 bp, Homo sapiens
caaacccactccaccttactaccagacaaccttagccaaaccatttacccaaataaagtataggcgatagaaattgaaaccttgcgcaatagatatagtaccgcaaggaaagatgaaaaattataaccagcataatatagcaaggactaacccctataccttctgcataatgagttaactagagataactttgcaaggagagccaaagctaagacccccgaaaccagacgagctacctcagagcagctaaaagagcacacccctctatgtagcagaatagtggggagcattatag

SEQ ID NO: 5523 - DNA, 285 bp, Homo sapiens
ctcgtgccgaattcggcacgagcctttttggcctggcttgtttgcaaaggccctggccaacgtcaacattgggagcctcatctgcaatgtaggggctggtgggacctgcttccagcagctggtgctgcaccagcaggaggtcctgccccctccactgttgctgctccagctgaggagaagaagtggaagcaaagaaagaagattcgaggagtcttatgatgacataggctttggtctttttgactaaacctcttttataacatgttcaataaaaagctgaacttt

SEQ ID NO: 5524 - DNA, 280 bp, Homo sapiens
gcttcctggtgagagaggaagcaactctccttctggttgtctgcctcccctcagattcyctgataggctgatggcatgtggctgtgactttgactttaatcattgctgaacaacatctctttgaatcaaagggttgattttcccagagggttctgggtcaggcatttctattagggggttgggagcaaaattgggtcactggcactctatgaagggtgtcccttcgtgctctgcgtgtgccctcagagtttttatcccgggcacatagtggaagtgtctc

SEQ ID NO: 5525 - DNA, 140 bp, Homo sapiens
gtgaatcggttgttctttcctcacatttggatgattgtcataaggtgtttagcatgttcctccttttccttcaaccctcccctttttttctcttattaatcaaggggaaccttcaaaggttaatgggaatggtcggtatc

SEQ ID NO: 5526 - DNA, 295 bp, Homo sapiens
gccacaattccatacattgatgaggatgctgcttttctgactaggagaatttttgttcatctaagaacatctcccctgggagagttagagcccaagtcggctcttgccttaaattcatgatccgattttatgaggggtcaccccggacccctcttgcccttaacatcgaggcctaggggaggcctggttccttcaggggggagagagtgggctcgcccccccctgggtgggtgtagacctcagagctcgcgggttgtttgtgagacccgcgagactctcgtgagttgggtcgttc

SEQ ID NO: 5527 - DNA, 250 bp, Homo sapiens
ggcaggttggagccgctgccgtcgccatgaaccgcggtaaccagcgtgagtcgcccgccagaaggaatatgaaaaagcagagcgactcggttaagggaaagcgccgagatgacgggctttcttctgccgcccgcaagcagagggacttggagatcatgcagcagaagcagaaaaaggcaaacgagaagaaggaggaacccagtagctttttgggcttgtgtccaaccctctttcccttcgcctctgtttc

SEQ ID NO: 5528 - DNA, 185 bp, Homo sapiens
ctgtgtccaagtgttcttattgttcaattcccacccatgagttagaacatgtggtgtttgggtttctgtccttgtgatagtttgctgagaatgatggttgccagcttcatccatgtccgtgcaaaggacatgaactcatcgtttttttatggctgcatagtactccatggtgtatctgtgccaca

SEQ ID NO: 5529 - DNA, 295 bp, Homo sapiens
ggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttcctcttatcagtaggggcccagaataagttattgcagtttatcattcaagtgtaaaatattttgaatcactaatatattattctgtgttctcttggtgaagactcggctttaattaatggcactctctattcctctgt

SEQ ID NO: 5530 - DNA, 188 bp, Homo sapiens
cgatgggcatctctcgggacaactggcacaagcgccgcaaaaccgggggcaagagaaagccctaccacaagaagcggaagctattagtttgggcgcccagctttccaacaaccaagaatttgccccccgccgcaattcacacagatccgtgttgcggggaagggtacaagaaaattccgttcccctag

SEQ ID NO: 5531 - DNA, 210 bp, Homo sapiens
cggtggatcacaaggtcaggagttcgagactagcctggccaacatggtaaaactccatctcttgctaaaatacaaaaattagccaggcgttggttgtattttcctttaatcccagcaacttagggaagcttaggcagaagattcgtttagcccttgaggcggaggtttcaggtagccaaggtttgtccattgcacttcagccttgggatt

SEQ ID NO: 5532 - DNA, 260 bp, Homo sapiens
gatgatggtatgtgtgagcttgggtttataactaaatttgaaagttgttcactttctgagggaaatcaattgtggttcctttaaataatgctctttcccaagggtgtctaattgtcgggcctattaccaaaacctggtccattgattggttaataaccattgatgtgaccagattttgggtttaaaccaaaattctcttaacctgagcgcacatgagaggtatcatgacataggtacctcattcacacttaataaattcg

SEQ ID NO: 5533 - DNA, 200 bp, Homo sapiens
cgacgacgcgcgtgttccgggagcttggagctggagctggaccggctgcgcgccgaggaacctccagcttccttacccaggaccggacttcaccggcagccaggagccagccccggtttccaaggtttgggggcttggcttgaactttttttgggggaagggggccaaggggactttttacaagttatggaatttaacat

SEQ ID NO: 5534 - DNA, 205 bp, Homo sapiens
actaccatcagagtgaacaggcaacctacagaataggagaaaatttttgcaatctactcatctgacaaagggctaatatccaggattctacaaaggacctaagccaaatttacaaggaaaaaacaaccccaccaaaaaggtgggcaaaaggatttgaccagacatttctaaaaggaggacaatttatgcagcccacgagacacat

SEQ ID NO: 5535 - DNA, 205 bp, Homo sapiens
atcaaattctttcagctcctttgtttcatacggactcagatcctgagtaatccttttagagcccgaagaggtcaaaacccttaatgttccctcctgcttttcctgccccatgtcaacaatttccaggctaagggttgccccaggcccagggctttaaccttggtatcgggcaggcccaggaggcaggacagcagttttctccctc

SEQ ID NO: 5536 - DNA, 160 bp, Homo sapiens
tctggagctctattaggagaaaagtaatcattttaggtcttaaagacttcaagaaaatacaggttatcaatttaattttaaatctcattgttttccagtttagccaatatcatacctatttaaagctgtttaatttaacaaaattcaaatcaaaaagggc

SEQ ID NO: 5537 - DNA, 175 bp, Homo sapiens
cctaccacaagaagcggaagtatgagttcgggcgccagctgccaacaacaagattggcccccgccgaattcacaaagtccctgttccgggaggtaacaaggaatatcccgtcccttagggttggacggtgggaattttttctggggcttagagtgttttgaactcgtaaaccagg

SEQ ID NO: 5538 - DNA, 200 bp, Homo sapiens
caccaaagaagcaagagggctttcttttgtttctggggacaataactaactttaatttgctcttcaaggaaggaggaagcttggtatatagggggaaattgcaggaggtcttgaggttaacccttaggggcaatggctttaaggacaatcttgaaggagcaacacacattcattcatggggaagggcctctaattaggca

SEQ ID NO: 5539 - DNA, 165 bp, Homo sapiens
cgccgccgcttgtgctgcagccatgtctctagtgatccctgaaaagttccagcatattttgcgagtactcaacaaccaacatcgatgggcggcggaaaatagcctttgccatcactgccattaagggtgtgggccgaaggattgctcaagtgggtcttgaggaag

SEQ ID NO: 5540 - DNA, 215 bp, Homo sapiens
gaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactcgacgccacaagggcaagagggtggttttcctcaagcagctcgctagtggct

SEQ ID NO: 5541 - DNA, 205 bp, Homo sapiens
ggaagcaggggtctggcttagggaatcagttagaaggattccttcttctccacttcttttgtgacaagggagaattaaaaaatcacctcttcaccttttcactattaccatgtacgtcagatatttttagttcttcaggtgaatttttaaggtgatttagaattaggtcctttttttcctgttttgagcagcactagagcacaat

SEQ ID NO: 5542 - DNA, 195 bp, Homo sapiens
ggaaaatggtagcgatggcggctgggcgagtgggtgtctggtgccggcgtttgggctacggttgttgttggcgactgtccttaaagcggtgtctgcttttggggcagagttttcatcggaggcatgcagagagttaggcttttctagcaacttctttcaagactcttgtgatctttctcggacagattcaacctc

SEQ ID NO: 5543 - DNA, 214 bp, Homo sapiens
gattatttactttgcagactgtaaagctgccctatcttttccagcagaatttacttttccattcttaattcttttttgaaatatcttaaataatttaacattcctttataactttttaacagtgtcaaaactggggtaggagggattttattttttcccaaaagggttccatctttgctatctgttgatcagccttagagaatctaagtgatga

SEQ ID NO: 5544 - DNA, 186 bp, Homo sapiens
aaaaaacaatcctacaatgtagacagaaccacaaaagaatcagaatagcgaaagccatttttaagaaaaataaacttgaggaatcatagtatttgactttaaatgatactacagagctacagtaattaaaacagcatgagactgatcagttaacagtagagaggattcagagcatatcacatattt

SEQ ID NO: 5545 - DNA, 174 bp, Homo sapiens
ccaattcggcagagcaagccttgcgcctcctctcaggatgtctacaaattggtggtattggtactgttcctgttgggccaagtggagactggtgttctcaaacccagtatggtagtcacctttgctccagtcaacgttacaacggaagtaaaatactgtcgaatagaaccatga

SEQ ID NO: 5546 - DNA, 150 bp, Homo sapiens
ctcgtgccgaattcggcacgagccaaacttccaaaggattaaactacctcaaaacactttcccatgaggtgtgatccacattgttagggctgacctagacagaggatgaactcaggtgccttgttttcgttttcgttcataataacaaag

SEQ ID NO: 5547 - DNA, 265 bp, Homo sapiens
cttatggcttcttttccagtatcattttgtctcataggaaaagttgactgagagcctcatttgaatgaattcgccacctctcgtacttgttactagaaccgaaatcgattgaggtagaagaaaacaaacttggattttttaaaagggccatatcgattagaaccaagaagcatttttttttaagattcctaatcagaagagatgagcccattacaatcagttcttcatgaataagataccttcattattctatgacccctcttga

SEQ ID NO: 5548 - DNA, 100 bp, Homo sapiens
atcccttccctcgcagttcccctatcctgaggggagccccgccacgggcaagcgcggcggcggccgcaggagggaagaagttgaagcggttagctcgcgc

SEQ ID NO: 5549 - DNA, 170 bp, Homo sapiens
cggcactctgtggctccccacccccaggtctgtggtggtttctttgttttttcctggttctttttgctgtgctgatgaaacaatgaccctcaatacccatgtgtatacccacccctctgcccactgggtattgaggaagggtggctgatcctccctcctctcctactctg

SEQ ID NO: 5550 - DNA, 320 bp, Homo sapiens
ggtcaccagagcctgaccatactgacgctccagggggaagacgcagaggccgggaagagacaccccctcccaaacacataaaacttgccccttcctagcctcggctcccctcactggggccttgggcaggaccgacccgcatccaactaggcctaaggggtaggctctgagcctctcacccctaagaggcggagatgcgcccaaggcgggcgcccggcctgttcccagccctgcctggagccccgcagccactgcattttgtttaaacacagatagcacgcgcctctctcttattgctacagtgttttgtacacggttaa

SEQ ID NO: 5551 - DNA, 336 bp, Homo sapiens
aaaaaacctggtcaccaaaaatatcttctctgctaattcagcaattcttgggctccagttaggggagctggggcctcactttctcccagaattgttgggcttcactggaagttaagggttcaggaattacttggactttccaccccagccctgcctgccttttggttttggccagggaggcaagccattagggtccctggcacatgcacaaattgatcctttgcgtgacagtcttgtatggaacagatgctgacagatttgtagactaccatgccacacacaaggctaaatatctctccaatgggttccagtcagtttgagtcatcaaattttgta

SEQ ID NO: 5552 - DNA, 255 bp, Homo sapiens
ctcgtgccgctttttttcttcatctgttggtacgcatgcaatcttcttgggtttgtttttttgtttttttttttgaagaattaagggagctaaggatttacaaaaggcttttagtctttttatggaatcaatggcttcaatgtggcttacttattttaaaaatttctatggaaccttaaatggggaccgtaagttgcactcaattccaaatttacccggggtttaatgggaccctcaatttttacggcactaatt

SEQ ID NO: 5553 - DNA, 356 bp, Homo sapiens
gacactagtggatccaaagaattcggcacgaggcagcccaccaggctcaggtcggccagcatgcgcacctggctgttgttggccaggttgtacggacagtccatgaacttcctgtagcgtgcagcccgaccagtccgtgcccttgtagcagggcggcagttcctaaggcgttggcgttcgccatcacacatgtccacgacgtcctccacgtgcacccttttgcacatccgccactcgttaggtagcggacacgggtctcgtggcagggtgatgtagtagacttcctggcgtcgcagaggcggagtcgcgcgctcagcacgcgggcacgagttggtgagctcgctcagtcgcgtgca

SEQ ID NO: 5554 - DNA, 315 bp, Homo sapiens
taggtgaaagtacgtagttgtctttcgtaagttaaaatgataattgggccgaaacttactgccttacctaaaaggcagcgcagtcaggatattggtaggtcgggggccgcctttggaaacccttaagtttacaaggcatgccgcggactttaagtgctcattaggtcgccgggcgtccacgtcagccctggaccttgaaccccggcgtgcgttggcccttggccctcggggaaagttccgtgcactcggggactccggtgaggctgtcagccgtctgttaatgtggccatcttgagtctactctgcgctctgtgc

SEQ ID NO: 5555 - DNA, 338 bp, Homo sapiens
ggagtggggaggtgagaaagaggaagtaagtaaataaagctgctactctgtgctccaaaactactgagtagctgacatctgccatttgcattgaaaactgagaaagaggagtttggtttggtttttgattccacaagatgatgtggaagggcaaattgtttgggttctatgtgataaactttgagtacctcctgtgtgcctgcatactatgatggatacatatgcctagggtaaagggatgagagacacagatcatgtctttgagacgtttagcttgagtcacatttgctgagactgaggtggggcttgcatttgaaagctagcattttgggatgcac

SEQ ID NO: 5556 - DNA, 319 bp, Homo sapiens
ctgacttagtgtaacctaggagattttatagttttattttaatgaaaccctgattgacgcacagcagtggggagaacagcgtcttttacccttcaccgaagccaggaagcccggttttgtaaggcgtgttttgtgggtgccttattgtacatcctccagtggcgttctttttactctaatgttcctttgggtttcccccttcagaggattcatgaatttgcacagcacctaatttttggttactcttgtcttatgatggattgaaatgaagatttataggcaagcagatctgtgtcctcattatattgcaattggattg

SEQ ID NO: 5557 - DNA, 342 bp, Homo sapiens
atggtgagaaggaaaaaacggaacgagacaagaatcagagcagtagcaagagaaaggcttgttgtccctggacccggcagagcatccccttgcagttacaacttacacttttttgggtactccaggagaaccccccggccgttccaaggagcttcacagagctaatgaccagattatcaaacagattggcacctttccctctgtggagcagttctggaggttttatagccacatggtacgctctggggacctacaggccacagtgacttccatctcttcagagaaggagttaacccatgtggggggatgatgcaataaaatggtggcaagtggattattcgg

SEQ ID NO: 5558 - DNA, 160 bp, Homo sapiens
gcagttcagagaatgatttcttatgatgataaaaatcgaatgggatcagacgatgtttgcaattttttaatacttgaataggacaacctaaggtttgaggattcaatttctttttaggacacacatcacacaggtttaatccggtgattccctttgtcac

SEQ ID NO: 5559 - DNA, 319 bp, Homo sapiens
cagggacggggacaagttctggcggatgcccgagtgctacatccgcggcagcaccatcaagtaccttcgcattcccgacgggatcatcgacattgtcaaggaggaggttgttgccaaggtccgcgccgcggaggccttcagcagcagaagcagcagagagggcgcggcatatggcggcgctcgcccggtgtgtgtttgtgtgcccgggccccgatgtggtcatccggcacacacagagacacacagagaggaggactctcagcacagaggcgcaacagcagtgcgccaccacgaccactgttgtgcccctctgcaacat

SEQ ID NO: 5560 - DNA, 160 bp, Homo sapiens
cggcacgagattccattagtctccattcaattccattaatctcattccattccattctwcttcaacttgattccaatacattctatttccttccattacatttcattccatatcataggcatatcatatcattacataccaatccatataggtgcacatc

SEQ ID NO: 5561 - DNA, 180 bp, Homo sapiens
aactgacccaggtaatgaaatggagcccttccctggaactaaccagtccttgatgttgtgtgactaagtaaaggtgataaaccccatcttcttgggggtgtcaattcacaattggcaatcaatgtgaaagctttcactatcccttggccaattcctctttccctctcttccaaacccata

SEQ ID NO: 5562 - DNA, 211 bp, Homo sapiens
ctcgtgcgaattcggcacgagaacacaacacgcccagctggcggcagcagctgatatcgatgaagaaccagtcagttaagcaaaaccaagtccgagttaaaaggaggcacggaaggctctattccaaacctggggtttcggcaaggttacacagggtttctctgagtctacactatccgagatctctagagtataccctctgtcatatcac

SEQ ID NO: 5563 - DNA, 320 bp, Homo sapiens
cgcggacggggttgtgcctggaggttgaggggaagattgtcagtaggacagaaggtaacatttatgacttgcttattggttggaaattccttcccttgagggcccccagggcgcaaggtaccccaaagagacagtaatcactctgtgttcgcgtatatttcatatgacccttacctctcacggaacacatttcacacaagagagctctacgggtgcatcatcagagttcatcatgatctctctcaggggagacttcttggagcagcagaccaccagcgaagtagtaacctcctatgatgatcaggctgctgcagcagcag

SEQ ID NO: 5564 - DNA, 260 bp, Homo sapiens
gcaaagcgaaatttggtcattctcgctaacatctgcccagctttgagtggcataatattgaacttggcacagcatgcggaaaatactacagaggtgtgtcacacatggctatcatttgattccggttactctcgacatacaattagaagcatagccacacacacacttgtgaaagagtaaacctctttcacatcacacaatatcacctctcacacctctaaaccccccacaatttttctcttatataatttgcttctttt

SEQ ID NO: 5565 - DNA, 104 bp, Homo sapiens
ttcaccttcaaaatgttctatttaacaactgggtcatgtgcatctggtgtaggaagttttttctaccattagtgacaaccaataaatgtttgttatttacactg

SEQ ID NO: 5566 - DNA, 310 bp, Homo sapiens
cccaggcctaccaggtaaactgggttctctgggtagccctggcctccctggcttgcctgggccccctggacttcctggaatgaaaggtgacaagggtgtagtcggtgaaccgggtccaaagggtgaacaaggtgcctcttgtgaagaaggtgaagcaagagaaaggggggaactttgagatataggattacctcggcccaagggatctccagataatactcgggaacctctctttagagacctcaggaagttgcgggcttcctcgagtagaagaaccacgaggaccacactacacccggtgtgcagcaag

SEQ ID NO: 5567 - DNA, 322 bp, Homo sapiens
aggcgctctgctggcagtgctgaggacgggtactccagctccaaggcctggagaggcttcccagcaacacctgcaagtccagcccccctcttctaggatgagccactgtagatcattaaagttcctccttgagaggctgagccgtagccaaggattggggagagcccttgtctctggtcaaccctcggagcattgggatcgtgggaaagaggagggggcccaggcccaggcaggggtcagaggcccaggccctgacttcggcttcccagagatctctccgccttagttaagagcatgtgtcgggaaatcctcagagtctcag

SEQ ID NO: 5568 - DNA, 200 bp, Homo sapiens
gaaaatgtgggttctgtgtgtggcactgatttatcaagacaagagggacatgcttcccctttgtccacctttgcagccttttttctgtcatgtaggttcaacatgtgctacctttgagtgttaaactaagggtagactactttggggattgagaacaatgcaaaatcaggaaaggctgttggaaggagatatccgtctac

SEQ ID NO: 5569 - DNA, 131 bp, Homo sapiens
taaaagagcatccggttttggtatggggatgatccaggattatgttgtgactgatacataattagttacttgtgcttttattttttttttatgggggtttttgaaaggggtaawatctmaarkgtgavggg

SEQ ID NO: 5570 - DNA, 100 bp, Homo sapiens
gcacatgccgtgacttgagactcagccacccagagttgagcagtggttactactggatttaccctaacccaggattcactattggaggtttataaaaggg

SEQ ID NO: 5571 - DNA, 140 bp, Homo sapiens
agcaggagctttttgcttagcactgaaaattctggataatggtgaatggacaacaactctacaacattaactgtcatatactgaaggatttcttcttccagttatgaaagaaccttggcttaggaatgtcaggaatggga

SEQ ID NO: 5572 - DNA, 310 bp, Homo sapiens
ctggagcccagcaagattacaaagtttgagaatgctttcttgtctcatgtcgtcagccaagcaccaagccttgttggggcactatcaagggctgatggaaggttctcaagaacaatcaagatgcaaagctgaaagaggatttttaaccaaatttcttggctgggatttgaagcttaaactcctttggtgttcaaaacaaataccaattcagttttgtcattgttctagtaaaattagatacccttgtgaaaaggggtactctcatactccctatgtacagaaatcacaagaaaaataaaggtttcctatg

SEQ ID NO: 5573 - DNA, 140 bp, Homo sapiens
caagggacttgcaggaactgcagaagaagctgtctcttctgatagacttcttccagaataacttcaaaggtcagttttccaattcactatgttataatgggaaaatccccaatataacactaggcataaacacaggtaga

SEQ ID NO: 5574 - DNA, 315 bp, Homo sapiens
gtcgaagcgaggacgtggtgggtcctctggtgcgaaattccggatttccttgggtcttccggtaggaggctgtaatcaattgtgctgacaacacaggagccaaaaacctgtatatcatctccgtgaaggggatcaaggggacggctgaacagacttcccgctgctggtgttgggtgacattggtgatggggcacagtcaagagaggcaacccagagctcagagaaaaggtacatacagcagtggtaattcgacagcgaagtaataccgatagagaagattgcgtgtttctctatttttgatgataaattcaggag

SEQ ID NO: 5575 - DNA, 141 bp, Homo sapiens
ggagatcaaggaagagcttctgcattctgagaagcttaagacatactttgaagacaaccctaagggaccttcaagctgctgcggcaatgaacctaccttttgcaaccccgcagtaggtgaaggccccaccttgggccaatg

SEQ ID NO: 5576 - DNA, 140 bp, Homo sapiens
ggaggctctcagcccctcttacccagcgcctgccccagctgatggcacccaccccacccggcctcaggaacttctttgaacagagcaagtttcccaaaggccgacctttgtagcccccaaggatcacaagctgttaccca

SEQ ID NO: 5577 - DNA, 205 bp, Homo sapiens
ataaaatctcggtgttctatttatttattgtcttcctgtaagaccttcgggtcaaggcagaggcaggaaactaacttgtgtgagtcaaatgccccctgagtgactgcccccagcccaggccagaagaccttccttcaggtgccgggcgcaggaactgtgtgtgttctacacaattgtgctattctgtgtcaaacaacctctgtat

SEQ ID NO: 5578 - DNA, 196 bp, Homo sapiens
aaaaatgtaaaacttggttgcattatttgtggaggctcaaacttgtgaaggttaataccataatttttccatttgttctgcattttgattctgaaaagaaagctggctttgcccatttcttattaaaaaaccttgttgtaaatccagttgtctaatgggatctatatggagttagccatgtctgtatgccctctcc

SEQ ID NO: 5579 - DNA, 166 bp, Homo sapiens
cacccatgtctcattttgctaaagttatgtgactttataatacttaactaaatattgagtgagtgaaatccacggaggcactgttcatggctgtaggaaatcatatgtaataaccgctacatgcaaggtacctagggcaatggttattgggatgaccaatcattgt

SEQ ID NO: 5580 - DNA, 210 bp, Homo sapiens
ttggaatggtgacaacatgctggagccaagtgctaacatgccttggttcaagggatggaaagtcacccgtaaggatggcaatgccagtggaaccacgctgcttgaggctctggactgcatcctaccaccaacttggtccaacctgacaaggcccttgcggcctgcctctccaaggatgtctacaaaattgggtggtatttggtactgttc

SEQ ID NO: 5581 - DNA, 212 bp, Homo sapiens
ctcgtgccgaattcggcacgagaagaaatactcctgtattgagttgtatcgtgtggtgtattttttaaaaaatttgatttagcattcatattttgcatcttattcccaattaaaagtatgcagattatttgcccaaatcttcttcagattcagcatttgttctttgccagtctcattttcatcgtcttccattggttcccagaagctttgtt

SEQ ID NO: 5582 - DNA, 226 bp, Homo sapiens
gagccacggccacggccgcataggcaagcaccggaagcaccccggcggccgcggtaatgcttgtggtcttcatcaccacccgatcaacttcgacaaataccacccaggctacttttgggaagtttgtattaagcattaccacttaaagaggaaccagagcttctgtccaactgtcaaccttgacaaattgttgacttttgtcagtgtacagacacagggtaatgct

SEQ ID NO: 5583 - DNA, 153 bp, Homo sapiens
gcactttgggaggccaaggcaggtggatcacctgaggtcaggagttcaagaccaaccttgccaacatggtaaaaccccatctctgcttaaaataaaaaaattatcttggcgttgtggttggtgcctgtaattccagctactcgggaggcttag

SEQ ID NO: 5584 - DNA, 170 bp, Homo sapiens
aggaaaccatctcccccaggaccttctgtctgggactcaggagtcctaaggaaaaggaattctaaaacaatggggaaggggaggtagagcacttatgggtgaaaaagttgaggccaacacacagggcaagttgggtcgatggagtcgaagcgcttaaggaataaggccgc

SEQ ID NO: 5585 - DNA, 192 bp, Homo sapiens
gcaggttggagccgctgccgtcgccatgacccgcggtaaccagcgtgagtcgcccgccagaagaatatgaaaaagcagagcgactcggttaagggaaagcgccgagatgacgggctttctgctgccgcccgcaagcagagggactcggagatcatgcagcagaagcagaaaaaggcaaacgaggaaggaggg

SEQ ID NO: 5586 - DNA, 290 bp, Homo sapiens
gtagtggggtgttgcaggggcctgagtgcagggccacagccatccctgccctgctctggccaacctgcacctttccttaactttgagtccactggaagctgtgagtaagcggctggccatcctggagaacacagttgtctaaggctgcctgtcaccactgtggcctctccaagcgygctgcacgtgtccgccgtagctttaccattttagtgagggaagccagcccggggtgggagggggtgtgtctgggggtgcctattgagagcgtgtaatggcgtttgggagctcgt

SEQ ID NO: 5587 - DNA, 122 bp, Homo sapiens
agcaacttagtgccttgtaatctaactttgtcactgtgactacattacctcttcagcgccagagggcacccgtgggcctcccggagcctttgcccatggcaggggttgagacccggaaccag

SEQ ID NO: 5588 - DNA, 250 bp, Homo sapiens
gttgaagggcctaaccagcctttgggagtattgactggtccttacctcttatggctaagtctttgactgtgttcatttaccaagttgacccagtttgtcttttaggttaagtaagactcgagagtaaaggcaagaaggggggccagccctcttaatgcggccacggatgccttcctgctgcaacccattccccagtcttccactgaacgtgaagtcctcttttagaatccaaacccaccattaactggtc

SEQ ID NO: 5589 - DNA, 180 bp, Homo sapiens
ctggtgctgatttatttcacacggactgtgcctgctttgcccagagtagagcaagaccaatttttcctttacaaatacatgatttaaactttcatcaaaaatttaactggtgctaaaaggcaggccaaaggcaaattcagcattttctacttactacatgtcagtaaggttcaaggattt

SEQ ID NO: 5590 - DNA, 290 bp, Homo sapiens
gctcccactgcgttcctccaatgacacgtgggaattgtgagaattacaattcaagatgagatttgggtgggggacacagccaagcaatatcaggtttttattgccagatacagttttctgagctgaatatgttttagggaagtgtattaacttttaaaactgaatcataggattagatgtttagatcctcgccttgaaaaactcaccaggtcatattacagagttccagaggacacatttctgactctaagcattattgaactatttggtaaatagagatacagatgatc

SEQ ID NO: 5591 - DNA, 300 bp, Homo sapiens
aaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaactttcgcaagatgggagcgcccgaatctggcttggcggaatatctctttgacaagcacaccctgggagacagtgataatgaaagctaagcctcgggctaatttccccatagccgtggggtgacttccctggtcaccagggcagtgcatgcatgtttgg

SEQ ID NO: 5592 - DNA, 142 bp, Homo sapiens
acagaccccacggccagtgcaaaggctcagaggtgggaacagctgggagtgttcaaggaggagcagaaggtgaaacggagggagggcttggtaagccattgcgtttggagagaagggttggttcacttccttggagaggctt

SEQ ID NO: 5593 - DNA, 190 bp, Homo sapiens
cgtgccgaattcggcacgaggtcatctctgctgagaaagcctaccatgaacagctttctgtagcagagatcaccaatgcttgctttgagccagccaaccagatgggtgaaatgtgaccctggccatggtaaatacaaggcttgctgcctgttgtaccctggtgacggggttcccaaaggtgtcaatgtgc

SEQ ID NO: 5594 - DNA, 150 bp, Homo sapiens
caatttaatgtaaagtatttggctttcaaatggtttctctgtgctattttttggaattctttcagattccagagatatcttacggtctttgattcaatttaaaatttgtacttattttcttttagaaataatgtattgtgtccgtgcaga

SEQ ID NO: 5595 - DNA, 309 bp, Homo sapiens
  misc_feature 278: n = A,T,C or G
ctacactctgtagaaatcctcttctctttctaggtcttttctgatccaggagaaattaactatggcatctttttagttatgattggagatgttaaccatctattctctctgtagtctgctacctaagaggctttttcctgcataataaggaccctggcctcaccattccttatctaaaccaggcatatttcctttgatccaagccttgggctaataacaacactctccaacaattcgccatcaaaaaaattctttgatctactgtgactggagccccnactttgtgtgtcgtgcattctggatcgacca

SEQ ID NO: 5596 - DNA, 312 bp, Homo sapiens
ctcaaagctcttcggaagaaggctcttgaaaaaaatccagatgaattctactacaaaatgactcggggttaaactccaggatggagtacatattattaaggagactaaggaagaaggtaaccccagaccacctaaagctgatgagacctcaggccgtcaaatatatagagatgaagagggttgcagaggctaagaaatcgaagactaaattcagagctccatctgctggatttccaggggaggcacacacaagcatgtgtctttttgacacaaaaggaagtgcacagttgatgtcgcactcactgcaaacag

SEQ ID NO: 5597 - DNA, 280 bp, Homo sapiens
ggcaaatgacaagcgataggctattgcaacctgagaaagagaactgctccttcatcgtaaatttagaagaccaagtagataatggaaccaaagttgttacttttttctagtagttatttttcccttttcctttttgtgtacctctacagagaccaaaactcattcttctaaagggatttaatggggctacttcagattaaaattaggcacattataagggagctcagagtaagggagtccatctcaaaaaaattgattgtatccactgcattgagagtat

SEQ ID NO: 5598 - DNA, 320 bp, Homo sapiens
cagataaccctaaagatgatactagaatgtttataaaattattgagaagattatttgtgttataaagcttaatttgtaccatagtaaaggatgttttttggttcctctcaatcctgggctaatccggtcaatacctgaggtccagtctttcccccttttcttaaccactctaacccttaattcccgtgtaccccatctcttctcggactctcctgagagtacagagtacccagacatgtgtccctgggatagccctctagagtctgtcaccaccgagattcccaactcgggataatgtgtcctaattctatcagctggta

SEQ ID NO: 5599 - DNA, 240 bp, Homo sapiens
ggctgactgcgtgccagagtggccacggcctttcaatctgtcccgcttctcctccgcctgcgacataggaggcttgcaccgattgcactggccgagagctggcccgtgagtaccctggtatgcagggtgactttgtttgacctcccagacatattggagctggccgcccatttccaaaccccgggaccgcggagagtcaggatcctttgcgagcgggtgtctttttcaggcccctctccc

SEQ ID NO: 5600 - DNA, 327 bp, Homo sapiens
ccgaagcgggagcggccaaaatgaagtttaatccctttgtgacttccgaccgaggaaggaatcgcaaaagggcatttcaattgaaccttccaacattcgagggaggattatgtcttcccctctttccaaggagctgagacagaggacaaccgtgcgtccatgcccatccgaaggttgttgaggtacaggttgagcgtggacactatagaggtaagcaaattgggcacagtagtccaggtttacagggagatatatgatatctacatagcacgggtagcagcgggaaaagttaatggcacactctccacgtaggcattcaccccagca

SEQ ID NO: 5601 - DNA, 290 bp, Homo sapiens
tgatgggtgactcagagtgcaggactgcctggccgtggggcagaggggtttgccttctcggagggtacctcctgttccctgtctgaggcatcctgcatggaggtaaagggaattccctttcttggtgacgactaaattttgggttccttcagccattgggttgcacccacacatatattaaatggcttcttcttaaggcccagagagagagtttttttaagagtctctcgccatatagctgagccaaaggtctgttcagattccacttttgggtattgtggcagttaaac

SEQ ID NO: 5602 - DNA, 155 bp, Homo sapiens
gacaagacgcatggagacccgcctgcctggtctttttgggctctttaaatatgcggcggccgcggagggagcccggggcaggggctacggggagcctggttccccgcaagacggggttaacttgcccagtaagggcgcgcttgaaaggagtgtcc

SEQ ID NO: 5603 - DNA, 101 bp, Homo sapiens
agtgccggctggtcgctgagactgcggatggagctgcggagaggcctgatggggcccaccatcccggacccaagtttttttcctttgcggggcttttggtt

SEQ ID NO: 5604 - DNA, 135 bp, Homo sapiens
gttggctgtatctttgcagagatgtttcgtcgaaagcctctcttctgttgaaactcttaagccgaccagtttgggcaaaatcttttgaccttatttgggcttcctccagagggatgtacttggcctttcggatgt

SEQ ID NO: 5605 - DNA, 141 bp, Homo sapiens
gccagaaatgttcggtgatcccgggactcactgctgcaggatggggaatttagcattggatcttcgtaccaaggggcaaccggttggggcccccaacttcaattttaattttacccaggcttacaaaagcggttagccctc

SEQ ID NO: 5606 - DNA, 131 bp, Homo sapiens
cccagacctcggcttgcagtagtgttagactgaagataaagtaagttcctgttttggcttaacaaggatcctcctttttgcagtcttccagcccaagggccgcttgatttccaacaacgcctttacccggc

SEQ ID NO: 5607 - DNA, 127 bp, Homo sapiens
caagaacagcattgcatacatggatgaggagacttgcaacctgaaaaaggctttcattcttaagggctttaatgatgttgaacttgttgctgagggcaacagcaggttcacttacactgttctttgt

SEQ ID NO: 5608 - DNA, 125 bp, Homo sapiens
cttggctagcctcccagcaagggcgcttggatgcagaggagcttggcagacaacttcgggaggccggccatgaaggccaagccgggtcttttcttcttgccgtgagggggacttaccaagccttc

SEQ ID NO: 5609 - DNA, 125 bp, Homo sapiens
agatcgccatcatgaacgacaccttaactatccccactagaaagttcatgaccaacccacttctttaggggaaacaaatggtcattatgtccctcaaccccgggaaggcgaacaattccttagac

SEQ ID NO: 5610 - DNA, 111 bp, Homo sapiens
cagccagagaggggtagggaacacagcaggtcagagagggggagataaaggacttggagagagttgtattccaaacaaggaccaactagttacctcttaagggtgttgtga

SEQ ID NO: 5611 - DNA, 116 bp, Homo sapiens
ctcgtgccgctgttctccagatggagaaacaggctctgagatttcacaggttttgcccaaactcattgattttgatgattaaaaaggataaacacagggtttcccgagtaggaggt

SEQ ID NO: 5612 - DNA, 110 bp, Homo sapiens
ctcctctctttcggttttggaagggatccatctccaggcagccaccctggtggggcttgtttcctgaaaccatgatgtactttttcatacaagagtctttcccgaggtgc

SEQ ID NO: 5613 - DNA, 129 bp, Homo sapiens
ccttgaccacatgctgaccggtgccttgggatttgactagagttgctggctcgaggcccagcacgaggacttaccctggggttttgttaggtttggaagcagctttccctagggggtaaagtccccccc

SEQ ID NO: 5614 - DNA, 173 bp, Homo sapiens
gcaaagaatatttctccaagcagaagtgagccctgggctgttttagtgccaggctgcggtgggcagccatgaagaaccaaaacctcttctgtaattttttttttccattggtgaaaaaaaaagactttaagatttaagccgcattttgggkgtttttaaaaggcaggccttty

SEQ ID NO: 5615 - DNA, 151 bp, Homo sapiens
gaccaggactgctgcctactgcaggtcaccaccctcaatttcatctttattccgattgtcatgggaatgatatttactctgtttactatcaatgtgagcacggccatccgggcatcatcgggtaagactggtttccaagattcccctttcc

SEQ ID NO: 5616 - DNA, 132 bp, Homo sapiens
ggtatctctccagtgggtcttaaaggagacccaggagccaccgagaaaggggccttccaggcctcccaggccagcccggcccccctggacaccctggccccccagggtatacctggtacggatggtgtcaga

SEQ ID NO: 5617 - DNA, 209 bp, Homo sapiens
cctctccccacttcagaggccacccactcagcaccaccggcctgccttgcctgcagactataaactataaccactagctcgcacacagttctgcagtccaggcgtttggggccgcctcccggctcggggaggccccggggcttggaacgccctttccttcctgcgccgaagccaacgcccccttttttccttccctgggcctttttccg

SEQ ID NO: 5618 - DNA, 187 bp, Homo sapiens
ccagccggcaaaggaaggaggtggaaaaaaaccgccaccgggctgactttcacctcccagtggtgagcagtgggggcccaaacccagttttccttctaatttttgttaggttctccctttcggcctccctatttttttagggaaggggaggtggggtccaagtaaaaacttggatgggagaagccat

SEQ ID NO: 5619 - DNA, 107 bp, Homo sapiens
tctgtccccagatgctctgcctcccgttccaaaacccactcatactcagcttgcacaaactggttgaacggcagggattgaaaaataaagagagattggcttttgtg

SEQ ID NO: 5620 - DNA, 123 bp, Homo sapiens
ggtaaaaatagctttcctattttcaggaagagccgtggtatatttaggaaaaatgtttctacttaattacggttacttctttcgtcgattggttaataattggaacgtttataaggttgcctt

SEQ ID NO: 5621 - DNA, 210 bp, Homo sapiens
attagtgttacccttgtgactttctgttgtacataatcctttttctaaatacatcattaatataattatttttttatcagcataagcttactgaagaggaaaaaaaatcttactgtgcccttactattttacagagcgtcacatgatatcacgttagtcagctgctgtcggctggtggtgccagacatcaaagggagattgggaaacttt

SEQ ID NO: 5622 - DNA, 171 bp, Homo sapiens
ctcgtgccgaattcggcacgagttgggaacacaaagtcttggatgaaagcacatctgtttgcagtatgtgcttacggagatattttttagcacacctgtttagaccctgtcttctttagaaaaaaagagttacttttcaaaaatatttactgcttatttgacaatgcacct

SEQ ID NO: 5623 - DNA, 212 bp, Homo sapiens
cgcacaggccggaaaaggcgcatctaacgcgtatctaggcttttgtaacttcggacaagttgcttttacccttatttgatgatacatttcattaaggttacagttatatatattttgttaatatttattaagtgactatagagatgcaactccatttaccagtaacttattttaaatatgcctagtaacacatatgtagtataatttctaga

SEQ ID NO: 5624 - DNA, 113 bp, Homo sapiens
cactcacaacaaaactaactaatactaacatctcagacggtcagggatatgggcaccgtctgaactattctgcccggcatcatcctagtcctctatacgcgcctcccatccct

SEQ ID NO: 5625 - DNA, 305 bp, Homo sapiens
gccatgagtatgctcaggcttcagaagaggctcgcctctagtgttctccgctgtcgcaagaagaaggtctttgttagaccccaatgagaccaatgaaatcggcaatgccaacttccgtcagcagatccggaagctcatcaaagatgggctgatcatccgcaagcctgtgacggtccattcccgggctcgatgccggaaaaacacttggccgccggaaggcaggcacatgggcatagggaagccggaagggtacagaccaattccccaatgtccaaagagggtcacatatgattaggagagtgagg

SEQ ID NO: 5626 - DNA, 175 bp, Homo sapiens
cgggggttgaggggggcgggcctggacctgggggagtgaaagcgaagccgggcgacttagccgggagaccagagatctagccgacttaagcagcatgtgccaagccgtgttgggtgcgcctgtagctgggaagcccgcaaacaggtgtgagtgtcttcagacagatatctttttc

SEQ ID NO: 5627 - DNA, 136 bp, Homo sapiens
gccatccagactgaggaagaccggaaacttaggggccacgtgagccacggccacggccgcataggcaagcacccgaagcaccccggcgggcgcggtaattcttgttgtctgcatcaccaccggatcaacttcgaca

SEQ ID NO: 5628 - DNA, 287 bp, Homo sapiens
cggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtacatcaggaagacagcgggttaagctgataaagggaggaaaagtccacccc

SEQ ID NO: 5629 - DNA, 290 bp, Homo sapiens
caagaaccctgctcgcacctgcagagacctgaaactctgccacctgagtggagagtggagactacttggattgaccccaaccaaggctgcaccttggacgcatgaaggttttcttcaacattgagacttgcgagacttgcggctatcccaattcagcaaacggttccaagaggaccttggtggaccagcaaggaccaaggaggaggaaccaactttgttttggggaaccactaattggtgccttccattcagctattggatacatctggcctccaccacttccaacgacc

SEQ ID NO: 5630 - DNA, 200 bp, Homo sapiens
gctccccacagctttgcaccccttttcctccccatacacacacacaccattttatttttttgggccattaccccattaccccttattgctgccaaaaccacaatgggcttgggggccaagggcttggttggacaagcaacttcccctaccccattatcccttcccgtgttgtggttgggaaaacttttggtttttgtggg

SEQ ID NO: 5631 - DNA, 300 bp, Homo sapiens
agtactcaacaccaacatcgatgggcggcggaaaatagcctttgccatcactgccattaagggtgttggccgaaggtattgcttaatgtgggttttgaggaaagcagccatttgaccctaccaaggaggccgggagaaccttacttgaggattgaggttggaccggtttgatcaccattattgcaggatccacgcagttccaagatccaagcttggtctttgacaagcaagaggattttaaagatggaaattcaaccaaggccctagccaattgtcttggcacaagtccgtaaggcctgg

SEQ ID NO: 5632 - DNA, 300 bp, Homo sapiens
tgaatgacggcgtggaggacctccgctgcaaatacgtctccctcatctacaccaactatgaggcgggcaaggatgactaatgtaaggcacttgcccgggcaactgaaggcttttgagaccctcctgtccaagaccaagggaggcaagacctcaattgtgggagaccagatcttcttcggctgactacaacctgctggacttgctgctgatccatgaggtctaggccctggctgcctggatgcgtccccttgctctaagatatgtgggcgctaagtcccggccaagtaaggcttctggctc

SEQ ID NO: 5633 - DNA, 222 bp, Homo sapiens
gtttattctgggaaatgttttaatgccagggcctgctgagttgcttcttcttgtgggaggatttttttttaatctccctgaggttggtataaaaggttggtactgccatcctaggtttactgggataaaatttaaaaccaagtattgtggaaggcttaatccaaaactattcctaagccttcaaatggtatggtaaatgggaaatttccagtaaattctgtg

SEQ ID NO: 5634 - DNA, 145 bp, Homo sapiens
cccaaccccactgaacacaagcggggtgcaggtgatctgcatgaaggggaaggccaagtacaaggcccagcgagaattgccattggtgtgggaggattcaaggcgcattggcaaggcattgagggaattgcagattcaggcccag

SEQ ID NO: 5635 - DNA, 290 bp, Homo sapiens
gcaggaggcgccatcatgggagtggacatccgccataacaaggacgaaaggttcggcgcaaggagcccaagagccaggatatctacctgaggcttgttggtcaagttatacaggtttctggccagaggaaccaacttccacattcaaccaggttggttttgaaggagttgtttatgagtcgaccaaccggccgcctctgtccctttcccggatgatccggaagatgaaggcttcctggccgggaaaacaagacggccgtgttttggaacatactcatgatgtcggctcag

SEQ ID NO: 5636 - DNA, 127 bp, Homo sapiens
tgtgcgaattcggcacgagatatcttggcatgagcagaaatggtgaatggtagaaatgtgttcttttcttactctaggcacaagggagtttggaaaggcacatttttttccccacatttaaaattgc

SEQ ID NO: 5637 - DNA, 175 bp, Homo sapiens
cgaattcgcacggctcacttcccatcacgtgttatcaggagatgggtctcttgttgaaatccgaatttcttcggtgaaaaatacatcccgagggttcggatagaaccggtgttgctgttcagatccaaggccaggaggtggattaatcccgaagggaatgagacatagggttgtt

SEQ ID NO: 5638 - DNA, 266 bp, Homo sapiens
cttctgttacctcagggccttggtacctggatactgccacagaattggggcgggtgggggaggggcctatttttaaataaaataacttttcaaagttgggggttttttaaaaaattaagaaaaaggaagctattctgtattgcaccttttcacaatttaatacattttctctacattttcctgtgattttcgagactaaaccattgtgtgtcctgtagtgtcctcggttgagctgccgctcagcagctttctcggggggatttgga

SEQ ID NO: 5639 - DNA, 225 bp, Homo sapiens
gaaatctgtctcccttacaatgacttacctagctagcatcaagtaacttgtatcacctgctttaaatgtaagggatagaaaatactattttgtctacactgaaaaccattattattcattgataggtggtaataattataaaggtaccattctttaaggcaaccacattgagtaatattattccaggcagagccctggatttttaatgtatattccctgctgcag

SEQ ID NO: 5640 - DNA, 99 bp, Homo sapiens
ctcgtgccgaattcggcacgagattagagtccatcctactgacctcatcttaacttgtttatatctgcaaagtcctattttccaaataagtaacatcca

SEQ ID NO: 5641 - DNA, 214 bp, Homo sapiens
gctgtttgggctaacaggatctcctcttgcagtctgcagcccaggacgctgattccagcagcgccttaccgggcagcccgaagattcactatggtgaaaatcgccttcaatacccctaccgccgtgcaaaaggagggaggcgcggcaagacgtggaggccctcctgagccgcacggtcagatctcagatactgaaccgcaaggagctcctagtt

SEQ ID NO: 5642 - DNA, 301 bp, Homo sapiens
gtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggaccacggcgtctgttcgaaggcaacgccctgctgcggcggctggtccgcattggggtgctggatgaa

SEQ ID NO: 5643 - DNA, 240 bp, Homo sapiens
gacgcaccctgtctgactacaacatccagaaagagtccaccctgcacctggtgctccgtctcagaggtgggattgcaaatctttcgtgaagaccctgactgggtaagaccattcacccctcgaaggtgggagcccagtgacaccatcgagaatgttcaaggcaaagatccaagataagggaaggcatccctcctgatcagcagaggttgatctttgctgggaaacagctggaggatggac

SEQ ID NO: 5644 - DNA, 112 bp, Homo sapiens
agagcctgggcgctgcggtagcctcgaacttccgatgttgggatgagagtcggagccgaataccaagctcggatccctgaattttatccaggttctacaaaggtacaaagtt

SEQ ID NO: 5645 - DNA, 103 bp, Homo sapiens
gatgagatgttctccgacatctacaagatcccggagatcgcggacgggttgtgccttgaggttgggaggggaagattggtcaataggacaaaaggttacaatt

SEQ ID NO: 5646 - DNA, 185 bp, Homo sapiens
gacgtttttcagcagctcaacatgaacctttactcctacattcatgcattttcctccaaaaggcaggccctaagagaccttaatacttttttgaccccccaaaggaatttggattttccagctgagcaactagcaaaggtggattccttgaaagaccggattgttcaaaattcggggttttcaga

SEQ ID NO: 5647 - DNA, 113 bp, Homo sapiens
gaaatcataactgacagggttacagtaataatgaaatgctactatcacttattttaatatacaatataaaaggaggcaaatacccttttgctttttgggggggcctttttaac

SEQ ID NO: 5648 - DNA, 145 bp, Homo sapiens
ccgccatcatggacaccagccgtgtgcagcctatcaagctggacagggtcacaaggtccttggcaggacccggttcttaagggacagttcacggaggttccggcgttggaatttattggcggcaaggggccgttccttattccga

SEQ ID NO: 5649 - DNA, 138 bp, Homo sapiens
tgcatactgtgattagcataataattgtttctttgaggtcatctaaatattttttcctaaaggaataaagggtgagggaaggaaaatattaaaaaagctaatatttgatactgtgcttgctgtcaggatgccttacaa

SEQ ID NO: 5650 - DNA, 102 bp, Homo sapiens
cagggtgcccaggtgaagctggccttttttctaaaggaaatgattgccacaaggcaagaggatgcatctttcctcctgggtacaagcctttaaagaccttct

SEQ ID NO: 5651 - DNA, 138 bp, Homo sapiens
ctgggctcgaggcgtcccccggggagtcgcctcttagcggatgcagcaccgaggcttcctcctcctaaccctcctcgccctgctggcgctcacctccgcggtcgccaaaagaaagataaggtgaagaagggcggcccg

SEQ ID NO: 5652 - DNA, 156 bp, Homo sapiens
cccctgaccttcaaaaaatgttccaaggtaagcctcgtaaaggtcatcccaccatcaccaaagccttccgttttttaacaaccttccaacacgattccattttagagggccaaattgtccattttttcagggggccttccccattggggttaaagg

SEQ ID NO: 5653 - DNA, 116 bp, Homo sapiens
acccgaggactcaaaatatcttattcagcacagactatgaaaaactcatgaggttcattttccaaggtggggtgaaaaggtttgatttgtcaaaagggattttcttgaaagggttt

SEQ ID NO: 5654 - DNA, 420 bp, Homo sapiens
tgggaattcgtggccttccgggcattaaggggccccctggtgctctttggtttgagggggacctaaaggtgactttgggaaaaaaggggggagcgtggccctccaggaggaggtcccaacgttttccctggagctataggtctcccaggtgacccaggccctcccagctatggcagaaatggccgagacggtgagcgaggccccccaggggtgggcaggaattccctggagtgccttgacccccgggacctcctgggctcccggtttctgtgagcaagctcctccacatgcagactggtcagcgagcatttaacacgggtctcaccttgaaaggctaactgctgcatggctgtctgcatgaaaccacgcctggttaaggagcttgggtaagaacaccatccaagcttgggcaaagatatt

SEQ ID NO: 5655 - DNA, 122 bp, Homo sapiens
gttggcttacagaagtcatggtgttcataccagatgtgggtagccatcctgaatggtggcaattatatcacattgagacagaatttcagaaagggagccagccacccttgggcagttaaggt

SEQ ID NO: 5656 - DNA, 137 bp, Homo sapiens
cccaaacccactccaccttactaccagacaaccttagccaaaccatttacccaaataaagtataggcgatagaaattgaaacctggcgcaatagatattgtaccccaagggaaaggttgaaaaattattaccaagga

SEQ ID NO: 5657 - DNA, 103 bp, Homo sapiens
cggcacgagctgctcccctaggacgcggctaaactcttggccaaaaggcggtactcacgtggcggaagggaaacttcattaaaaaaagaacgaaagctccccg

SEQ ID NO: 5658 - DNA, 116 bp, Homo sapiens
ccttctggttggggcagacccgagaaattcatcgtgcaccgagacggatggcaggttccactggccttccttggggtttgggctcggggcccccagcccgttggcttacctttgtg

SEQ ID NO: 5659 - DNA, 113 bp, Homo sapiens
cctgccgaccaaagagaccattgagcaggagaagcggagtgaaatttcctaagattccttgaggattttcctaccccccgattccttttttggaggaacccaagttggttaat

SEQ ID NO: 5660 - DNA, 126 bp, Homo sapiens
gcctcacttccactttactagatgcccacctggaaggaacaggggcaggcatcactcaccccatttcacggacaaaggcactgaggcacacagaggctcagctttccttggcacggtggccgtggc

SEQ ID NO: 5661 - DNA, 287 bp, Homo sapiens
cggcacgaggaagatggcggtggccagggccggggtcttgggagtccagtggctgcaaagggcatcccggaacgtgatgccgctgggcgcacggacagcctcccacatgaccaaggacatgttcccggggccctattcctaggaccccagaagaacgggccgccgccgccaaggaagtattatattcggtttggaggactacgaaccttacccggatgatggcattgggtatgggccctatccgaaggttccttacccgtacaggattgagagatccatgggatatc

SEQ ID NO: 5662 - DNA, 155 bp, Homo sapiens
ctcgtgccgaattcggcacgagctggtccccagtgccctgctggagcaagcctatgctgtgcagatggacttcaacctgctagttggatgctgtcagccagaacggtgccttctggagcaaacttttttccagcaccatcaaacaggatgacttt

SEQ ID NO: 5663 - DNA, 285 bp, Homo sapiens
ttttgatttaattcttcagctaaaacagcggaagaggtgatttattatatggttgttacactcggccacaaataaacacaggaatagtccaggaatttcacaggtccagggccaagaggcccacatgggcattttggtttattagccaaggttgggtttaaggttatccgccgttcagaggccgttgaggttttagatccatagagacacgctctagacattcgcatacagtcccacatcttgtcccagcatccagagcgtctcgcatcacatgtctctgctcct

SEQ ID NO: 5664 - DNA, 115 bp, Homo sapiens
agctacttccaacctagtccgtccggtcagtttataaccaggtttctcagctagaccagggtttcccagtgttgatatggttttttccagattcagccgcatggaacctaggtgg

SEQ ID NO: 5665 - DNA, 292 bp, Homo sapiens
  misc_feature 232: n = A,T,C or G
ctgaaggtgaagggggaatgtgttcaaaaacaagcggattctcatggaacacatccacaagctgaaggcagacaaggccctcaagaagctcctggctgaccaggctgaggcccgcaggtcttaagaccaagggaggcacgcaagccccgtgaggagcgcctccaggccaggagggaggagatcatcaggactttatccaaggaggaagagaccaagatataaacctcccacntttgtctgtacatactggcctctgtgattacatagatcagccattaatataacacacgcc

SEQ ID NO: 5666 - DNA, 300 bp, Homo sapiens
cggcacgaggaggcagcagatcccctagcatctaaacttaacaaggtcacccaattgacaggtttctcagatcctgtatatgcaggagcttacggttcatggtcaacccatatgatattggtccgggatggaacttggtggtgaaccaaaccagtattactttgacagattgcacacatagagacctagtctcacactagggggtatctgaacacttgtggagaaagccgtctccttgtgcactctcgctcctcatgactgcgcatatattagagctagcgtcagaggtagcatcaacag

SEQ ID NO: 5667 - DNA, 291 bp, Homo sapiens
cgacaagcccctcgctgccttcaccatgttctccgcttcccgaacaagcagccatactgatgaccacagcaaccagctccacgggctgatgcagcccttccaggcctttcccgtaggggagtcctttctaagcaaagtgcccctcaaggccgggtctctcccgccaggcctgccccctttcccagagccctgtcacatccagagattgggccccagggtctccctatgagagagcctggggcacaggttgagcactatattcccgcagcagtccctgatggtgtcgcctcg

SEQ ID NO: 5668 - DNA, 299 bp, Homo sapiens
ccggccctctggggggaggtgcgcagttatgctgttactagtgattttagggctttgttatttaacttatttcaagggtgctgtgctcagccctgcccatggctggtgcagcttcctccgtgccttagatcttctgtaagcagttcaggacttactgttgtgttcctggcaaccccggcattggcttccaaggtggcttgtgagttccatattggaggattttctctccaaggactctctctctcccaaggtctccctgggaagagtgttatacgcacagaaaacagggctctgagctg

SEQ ID NO: 5669 - DNA, 190 bp, Homo sapiens
atctccaaacatgacctgggccatttcatgctgcgctgcctcaccaccgatgagtacgacggacacagcacctaccccttccaccagtaccagtagcactctgttcccatcttggagggttgcattcttggacaagaggagccaaggaagggggcaataaatgttgaagcaagaacttcaaattactctc

SEQ ID NO: 5670 - DNA, 249 bp, Homo sapiens
accgccgaggaaaaccgtgtactattagccatggtcaaccccaccgtgttcttcgacattgccgtcgacggcgagcccttgggccgcgttttctttgagctttttgcagacaaggtcccaaagacagcagaaatttttcggtgctcttagcacttgagagaaaggattttgttataagggtttcccctttcacagaattattccagggttattttttaagggggggaactcacacgcatattggcactg

SEQ ID NO: 5671 - DNA, 133 bp, Homo sapiens
ccccagcccccaccgtcgcgccaggacccgtggtgctggcgctcgtggtcgtcgcgctgagaaagttttctgcctcctgaagcgaataaaaggggccgcgcccggccggggcggggactttggcttcactcca

SEQ ID NO: 5672 - DNA, 228 bp, Homo sapiens
ccgccgcgccgccatcatggacaccagccgtgtgcagcctatcaagctggccagggtcaccaagggtccttgggcagggacccggtttcttaagggacaagttcacggagggttcgcgttggaatttattggacgacacgggccggatttcattattcccaaattttaaaagggccccctttcgaaaagggcaacgttcttaaaccctttttagggtaaaaacccaaa

SEQ ID NO: 5673 - DNA, 166 bp, Homo sapiens
ctcgtgccgaattcggcacgaggatctgccccaggagttgctgggaaaggaaggatttgatgccctggatccctttatttcccattccacggtttccaactataaacccaaagggattttkaaaggttgtatttcagtaattatttgggaaacaaatgggttcaaa

SEQ ID NO: 5674 - DNA, 152 bp, Homo sapiens
gtagaatctattgaatctatttcttaatttttacctcaattttcatcaccctagattagaccctaattgccaccatgatgaccaactgcaataaatttaccaatgaggtttattaaaaatttgaaggcttgcaatttttttggaaagttaaa

SEQ ID NO: 5675 - DNA, 176 bp, Homo sapiens
tgttggccaggatggtctcgatctacggacctcgtgatctgcccaactcagcctcccaaagtgctgggattacaggcgtgagccacccatgccgcgcctaaaatttttctttttttaatgtttgtttcaatatgggcaatcccccttagagggggccaaggcaaaaattggggttt

SEQ ID NO: 5676 - DNA, 210 bp, Homo sapiens
ctggcgcaatcccatcccccttccccgggccacggggcctttggtccctgcccttccacccaggttttggttccttccggggcccccactttggagataagaaggggatggaattggggaagaggaggagcaggaggcccttaatccttttcttccctgggggttggggcctaaaaccttttgagggccccaggaaggaggttgaaaacc

SEQ ID NO: 5677 - DNA, 94 bp, Homo sapiens
caggctactctcctcggcccctccatcgggctgaggaagcacagcagcatcttcaaacatgtacaaaatcgattggctttaaacacccttcaca

SEQ ID NO: 5678 - DNA, 355 bp, Homo sapiens
ggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacacccttatccccatactagttattatcgaaaccatcagcctactcattcaccaatagccctggccgtacgctaaccgctaacattactgcaggcactactcatgcacctaattggaagcgcacctagcatatcacatactctt

SEQ ID NO: 5679 - DNA, 374 bp, Homo sapiens
ctggcacgcagcgccctcccagaggcctaccttcaagcagctggtggaggcgctggacaaggtcctgctggccgtctctgaggagtacctcgacctccgcctgaccttcggaccctattccccctctggtggggacgcagcagcacctgctcctccagcgattctgtcttcagccacgaccccctgccattgggatccagctccttccccttccggtctggggtcagcatgagcaaggctcaaggctgtcaggcacataggctggtgcttggctttggggctcagcacagcctgacacagtgctcgacctgatagcatggggccctgccagagttgctgtccgtgtccaaggcgtcttgcccttgagctcgtct

SEQ ID NO: 5680 - DNA, 181 bp, Homo sapiens
gtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacct

SEQ ID NO: 5681 - DNA, 279 bp, Homo sapiens
acagaatgagaaaacagagtagatataaggaatattgcagtacaattgagagaacttgatcgatttccaagactcataacatactctatgtgtgggcattcttcgttacaacaggacatatttcagtaaatgttttgccatggggggcctctttgaaatgactgcttaggccatgcccaaaatgcctataatttccagcaatttgggagtccaggcgggaggattgctggagaccagcagttcagaccagaccggacacacagcgagaccctatctcca

SEQ ID NO: 5682 - DNA, 109 bp, Homo sapiens
ggctcgtgcgtcgatgaagaacgcagctagctgcaggaattaatgtgaattgcaggacacattgatcatcgacacttcgaacgcactaaacggccccggggttcctccc

SEQ ID NO: 5683 - DNA, 250 bp, Homo sapiens
ggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagt

SEQ ID NO: 5684 - DNA, 230 bp, Homo sapiens
gtgaaggcaaagaagaatgctgctccattcagaagtgaagtctgctttgggaaagagggcctttggaaacttcttggaggttttcaggaaacttgcagcaaagcattcgggttggagtaattggtttccaaatgtggggaaaagcagcattatcaatagcttaaaacaagaacagatgtgtaatgttggtgtatccatggggcttacaaggagcatgcaagttgtccctt

SEQ ID NO: 5685 - DNA, 319 bp, Homo sapiens
gccgccgccgcctcccagaacctcttcgtgccctcgcgtgccaggcccgcggcggccgaaatccgcggttcacagcatgtccgcttcggcccctgctgcggagggggagggaaccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacattgcaca

SEQ ID NO: 5686 - DNA, 300 bp, Homo sapiens
gctggagccggggaatccagggtcctcaaggccccagaggtgacaaaggagaggctggagagcctggcgaggagaggcctgaagggacaccgtggcttcactggtctgcagggtctccccggccctccttggtccttctggagaccaaggtgcttctggtcctgctggtccttctggccctagaggtcctcctggccccgtcggtccctctggcaaagatggtgctaatggaatcctggcccattgctcctggtcccgtggacgatcaggcgaaacggcctgctggtcctctggaatctg

SEQ ID NO: 5687 - DNA, 226 bp, Homo sapiens
gtcaaagggtacaaagcctcagttaggaggaataagtgtgattttttttaaagatcacttggcacagcatgctaaatataggaataattgaatgtatattgcaatattgctaagagagtaaatttctaatgttctcataaaaaagttaaatatttgagatcatatgttaattagtgtaatcattccaccttatattcaaaattcataaaaccgtattgtacctata

SEQ ID NO: 5688 - DNA, 188 bp, Homo sapiens
gaaatcattagataggagccacctcagcctcctctgctaaaactactagccttggcacttaagcttctcctgccttctcatcacaatagaggagactggcaggacctgccatctggtcctagaacattgcaacaaatacccatctcagaacttacacatagcatatgtgtaatacttctaacctcact

SEQ ID NO: 5689 - DNA, 182 bp, Homo sapiens
ctgaggtgggcaggaaagaaatttgaggagatcccaattgcacacattaaagcatcccacaacaaagggatttcggaatgccaagaagggcacaggcatcgcagcacagacagcaggcatagcgcagcggcgaggagctaaacaaaagggcgtgatccacatccgagttgtggtgaaaggct

SEQ ID NO: 5690 - DNA, 189 bp, Homo sapiens
gggaatatcgagacaaagataaaaattatcagaaaattggccccataacacccttggagttttacagggaacatgtcaagccactcttcaatatggaagataagatttgtttagtgaatgaccctaggccccagcacaagtacaacaactttacacagtggaatacttaagcatatggttggagggaga

SEQ ID NO: 5691 - DNA, 222 bp, Homo sapiens
ctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggt

SEQ ID NO: 5692 - DNA, 294 bp, Homo sapiens
ctcatacctaatcgtctttgccagtccattcaaactcacggatttgcaaaattatgttaaagtcttttaaaaaatacatttgagtaggctttgtagtcatttagattttgattattaattttctcttgctatgctgcttagccataaaaaggaaaagagatagatgtgggttcttttagtggtgttaatttaaatactagatttatttattattaatgtttaacaaggcaattcttatatttctgttcacctcatatccacacagaatataggagcttcacccccagtacagta

SEQ ID NO: 5693 - DNA, 321 bp, Homo sapiens
gaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaacttatgaaggacagatac

SEQ ID NO: 5694 - DNA, 309 bp, Homo sapiens
  misc_feature 275: n = A,T,C or G
ggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgttgaggattacctcgcaagatcacccaggaggacagagtacaagcctgaaggccacgcgagagagctgcagctggcaacgagagatncgtccagatccgagcaaggccaggcggacgtttt

SEQ ID NO: 5695 - DNA, 317 bp, Homo sapiens
ctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctctcagcatagacttaactcccttaagcccagacatctgttgagacctgacccctagtcattggttaccagtgtgtcaggcaatctggactttccagtgatgccactgagatggcacctgtcaaaagagcagtggttccatttctagatt

SEQ ID NO: 5696 - DNA, 307 bp, Homo sapiens
ggaagctaaggctgcgttggggtgaggccctcacttcatccggcgactagcaccgcgtccggcagcgcagccctacactcgcccgcgccatggcctctgtctccgagctcgcctgcatctactcggccctcattctgcacgacgatgaggtgacagtcacggaggataagatcaatgccctcattaaagcagccggtgtaaatattgagcctttttggcctcgcttgtttgcaaaggccctggcaacgtcaacattgggagcctcatctgcaatgtaggggccggtggacctcctccagcagctggt

SEQ ID NO: 5697 - DNA, 316 bp, Homo sapiens
actgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctggggcccttgggtgagtggcctgctaagctccctccttgcccagactacagggcttaggacttggtttgttatatcagggaaaaggagtagggagttcatctggagggtct

SEQ ID NO: 5698 - DNA, 311 bp, Homo sapiens
gtgacttccgcaagctgatggttgccctggcaaagggtagaagagcagaggatggctctgtcattgattatgaactgattgaccaagatgctcgggatctctatgacgctggagtgaagaggaaaggaactgatgttccaagtggatcagcatcatgaccgagcggggggccccccacctccagaaagtatttgataggtacaagagttacagcccttatgacatgttggaagcatcaggaaggaggtaaaggagactggaaatgctttctgaacctggttcagtgcattcgagacaggccctgtatttgc

SEQ ID NO: 5699 - DNA, 183 bp, Homo sapiens
cacacattgtgtaaattagccaggcgtgttggcgcatgctgttaatcccagctactcgggaagccgaggcaggagaatcacgtgaacccgggagcagaggttgcggtgagccaaggttgcaccattgcactccagcctgggcaagaagaatgaaactcgatctaaaaaaaaaaaaaaaaaaaa

SEQ ID NO: 5700 - DNA, 321 bp, Homo sapiens
tgctctaccagcagaggttgatctttgctgggaaacagctggaagatggacgcaccctgtctgactacaacatccagaagagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggacacagctggaagatggacgcaccctgtctgactacaacatacagaaagagtccactctg

SEQ ID NO: 5701 - DNA, 317 bp, Homo sapiens
gactaaaaaatcaaagttgaacaaattttccactcaatgggtgccaaaactgttgtgctaagattagctgcacacaagagctttcagtgaaaaattcaaacaattggcattgagatcctaaagcatttctcgaaagaattgtaacagcagatgaaacatggttttgccagtacagtcctgaagacaaagcacaatcaaagcaatggctaccaagaggggcacatggtgaagagcaaaagtcatggcaatagttttatgagatattcaaggcattttgcttgttaactttctggagggtcaaaagaaaataacatctg

SEQ ID NO: 5702 - DNA, 286 bp, Homo sapiens
gaaaagaataaaaggaatgaacaaagcctccaagaaatatgggactatgtgaaaagaccaaatctacgtctgattggtgtacctcaaagtgatggggagaatgcaaccaagttggaaaacactctgcaggatattatccaggagaactttcccaatctagtaaggcaggccaacattcagattcaggaaatacagagaccgcacaaagatactcctcgagagtacttctagagcggcccgagccatcgattttccacccggtgggtacaggtaagtgtaccaattc

SEQ ID NO: 5703 - DNA, 238 bp, Homo sapiens
cggagagggactcagtggagcggcgcatgggcacagcggtgggcaggagcgaggtctggttccgcttcaacgagggtgtctccaacgccgtgcgcgcaagctgttacatcagggacttgctctagttctctgagccgcggacatgccctcgcattgcttcccgcagagtgcagagacaggaagctggagatgtctttataaagtcacacctttacagactgtaaaaaaaaaaaaaaaa

SEQ ID NO: 5704 - DNA, 284 bp, Homo sapiens
gccaagtggctaacatgatgatcaacccaaattgtctggtaaatgcaccactttctgaatgcacatttcagggtaggtgaaggaatacatgtacctgacatggcccagtctgacacgtgtcacctcttctgtcttctccccaggctgctctgcgtagattcgctggggtctgccctgaaggcctccaggcctctgactgtcagcagttggtcagcctcggctgtgggactcttctactctgcagcacatggaggagagtttgtgtagtgagtgtgggcgagaga

SEQ ID NO: 5705 - DNA, 288 bp, Homo sapiens
cttgcccacaaagctgtgggtggtttctggtacttaaagcactaatattatgttgctgctctgcgaacagcccagtagtgccatttccttccacaccaaaaagtgttaaatcaagtatgcaaatgagagtccttacaactggagtttatgttgtcttgccctcttttttagcacacaaaaaattgtacttttttatgtcgaattgtttaaagactcattctttacttgttcttacgagaggatatagggagagagtgcagtaattgctgtacgtgtatcatcattcca

SEQ ID NO: 5706 - DNA, 288 bp, Homo sapiens
ctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccgctttacagggatatttttaatccgttatggactctgtctccaggagagggtctatccaccctgctca

SEQ ID NO: 5707 - DNA, 289 bp, Homo sapiens
tggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctcctcctctagtacagaaggtgcagtacatctatgggcctggtgattccccttgcccatccagagaggaagcatttcaatctgctttcctgccttacatcaaggtgggcaggggatataattattgcaggctcaag

SEQ ID NO: 5708 - DNA, 283 bp, Homo sapiens
gttccttacaaggcaggaagaccggcagctcatcaacgctttgcatgacctatcagtatggtgctaatgtgtctgtggaccctcgctctctgtctccaggcagttctctcgaatactttgatatgtttgtgcttacagttagccactcctggtgtttatgtgacattcctatcaatccaaattccctctgtgagtgtcatgttatgcctgttgcaggcaaatgtaagtctagaaataatgcaatgtcacggcttactctatatactttgctggtcattttttg

SEQ ID NO: 5709 - DNA, 304 bp, Homo sapiens
cggcacgagggttcaggcagccatgactcttctaagtgatgcttctcatctgcctaaggcgggcggggtcttcacacctggagcagctttttccaaacacagttgattgacagactcaacaaacacggtattgagtttagtgttattagcagctctgaagtctaaacactgggagagttaactcaagtcatacgtgcgtgaattaacagctctctatttgatatttgaaattcttctgtaagcctgtctgagtgtatgtggagacgacttgtcaatctaaaatatctatatattaaaaagtagg

SEQ ID NO: 5710 - DNA, 196 bp, Homo sapiens
gttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 5711 - DNA, 163 bp, Homo sapiens
ccacggtttaaccggagattttgaggctagggtgtgtttctttcgaacttttcggaatgtctggaacatttcatttcctgttttgttactatgcctctgtaaatctactttgcaatttaagtaataatttatgaataaaatgggaaatgcttctaattcacat

SEQ ID NO: 5712 - DNA, 205 bp, Homo sapiens
cggaggcttgggtgcgttcaagattcagcttcacccgttaacccaccgccatgggccgagggaagggcaatttgctgcctgggaggtgtaatatgacggttaatactgtctttacacgaggttctgaaggactgcctcatccacggtggcctagcacagtaggattcgcgacgtgccaaagccttaacacgcagcaaagccatct

SEQ ID NO: 5713 - DNA, 304 bp, Homo sapiens
gcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccacgatgaagagacgacgctgctggggatctcgcactctggttcctgcatgaagacagtggctggcggtgctggacgtacaatacacttcgctgtcacggtaaagtccgccatcagagactgaggagttgaaagaccagtagacgctctctactctttgagc

SEQ ID NO: 5714 - DNA, 171 bp, Homo sapiens
attcatccatcggtccgtccatccatgtccccagttgaccgcccggcaccactagctggctgggtgcaccaccatcaacctggttgacctgtaatggccgcctgtgccctgcctcagtccaatcctacagtccccagggcgtgcggggctgtgagactggggtgcaggaat

SEQ ID NO: 5715 - DNA, 298 bp, Homo sapiens
cctgccaccaggcctcaccaaagcccactgccatggggccatctgggccattcagagactggagtgagatttgggtgtggaggggaggcgccaaggtggaggagcttccactccaggactgttgatgaaagggacagattgaggaggaagtgggctctcaggctgcagggctggaagtccttgcccacttcccactctcctccccaatctatctagtactcccaggcaaataggccctttgaggctcctgagtgcctcagatggtcaaacccagttttcctctggagcctaaacaggc

SEQ ID NO: 5716 - DNA, 293 bp, Homo sapiens
ttgatctttttccccttcatctttcagcagggtcaaggacaagcaaattgcattgatttcttctgtgacatgaatttacttcctatttacctttaccctgttggattaccctttggtgtgtgagctttgtggtgggatgtcattgttattatatactcttgtgagctcggtctaatatcctaggctggagacccatagagtcactcccatacatactacagggttttgtagagcattgtgtgagagcagctttcaatgcttgctctacaatgttcctgctttagtttgttctg

SEQ ID NO: 5717 - DNA, 299 bp, Homo sapiens
cccaggccagctcaatgctgacctgcggaagtggctgtgaacatggtcccgttttccccggctgcacttcttcatgcccggctttgcccactgaccagccggggcagccagcagtaccgggcgctgaccgtgcccgagctcacccagcagatgtttgatgcaaggacatgaatggctgcctgcgacccccgccatggctgctacctgacggttgccgcgtgttcaggggcgcatgtccatgaaggaggtggatgagcaaatgcttatgtccaaacaaaacagcagctatttgtgagtga

SEQ ID NO: 5718 - DNA, 219 bp, Homo sapiens
aggagcaaagagcaccatgattccaatcttgtgtgtgtttactaacccttccctgaggtttgtgtatgttggatattgtggtgttttagatcactgagtgtacagaagagagagattcacacacaatattgctgttcttcagttttgtttgtggagtgtgaaatcactcaaatttaaaataaattactggactgtggagataaaaaaaaaaaaaaaaaa

SEQ ID NO: 5719 - DNA, 213 bp, Homo sapiens
attacatagtagtatgcttaggctttactatgtattagcctcttgttggactgtgtatgtattttaccatatgggttttaatgataatggtgtatgactgctatacatgagtgcttatgcatccagatgttataataaagtagaatggtctctttaaaaaaaaaaaggaaagaaaagagaaagcaatgccaaaaaaaaaaaaaaaaaaaaaam

SEQ ID NO: 5720 - DNA, 315 bp, Homo sapiens
caatggccgggagggctcctgcgcttcagttcctggccattttctatccaagatgtggtacaacctcttaacctgcaagttcaggagagccctcgtctctgtgggtgagtgtgtgttgaacaagggaatctctgggcttgaaggggaaatttccaatccctggccctggcttaggcctcatctcatgccctcccctcagacggtgtcagatgcctctcggtctcagactctgtgtcactttcgtcctttcacggtgtatcagtaagtattactctctcacatttggtcgctgggagagctactcaggtcaaggat

SEQ ID NO: 5721 - DNA, 328 bp, Homo sapiens
ccgggaccgtcctgcgcgctctgggcgaaccatggcccgcgggctggcgctggcgtgctgctcttcggcctcctgggtgttctggtcgccgcccggatggtggtttcgattatccgatgccttcctgacatgaaacaagaacccactgccaatcccaagaacccagtcctggggatgactttgacttaagagatgctgatgttgatggagaaatgacgaccacgaccaccgacctcacccaaacgattgccaaatccaaccccaacgaccgtggtctcggtagctttcagatgctggacttgcggctgggtttcagagggaaggaaag

SEQ ID NO: 5722 - DNA, 313 bp, Homo sapiens
ctaccctacatgaaagctatttcctactgcttgtgaaagaaaaaaatatgaaataaacacttactattctgttacaaggtaacaatagagtgctaattgctgagtaaagtcatgtagccccaggattatgttgagggactccactataaatttgaagacaccataatccatgtaatcaggcagaaaatgatttgctgtgctgcacttctcctttaacagtttctattgaactaatttaattaaatggagtagagatagttattccctgagtccagatgtggagcacgtgtcgtgttttacgtgtcctgtgtag

SEQ ID NO: 5723 - DNA, 322 bp, Homo sapiens
cggggaggtaacaagacataccgtgccctgaggttggacgtgggggaatttctcctcggggctcagagtgttggtactcgtaaaacaaggatcatcgatgttgtctacaatgcatctaataacgagctggttcgtaccaagacctcgtgaagaattgcatcgtgctcatcgacagcacaccgtaccgacagtggtacgagtgccactatgcgctgcccctggccgcaagaagggagccaagctgactcctgaggaaggagagattttaacaaaaacgtctaaaaacttcagaggaatattgattgaaggaaaagattccaaa

SEQ ID NO: 5724 - DNA, 334 bp, Homo sapiens
tgttgaggaggcaagtgggtcaacagcaggtgggctgtcgagacgtctaatgaccattctccatatacctttcaacctaataagtaactgtgagatgtacagaaaggtgttcttacatgaagagggtgtgaaggctgaacaatcatggatttttctgatcaattgtgctttaggagattattgacagttttgcacaggttcttgaaaacgttatttatatgaatcacctaaactattttgctatagttcataggtgcataagacctaattcactagtagcgtgcccgacagcttatttgtaaaaaaaacacaccaaacaaggtttttcaagttt

SEQ ID NO: 5725 - DNA, 223 bp, Homo sapiens
gttggctggaagtaccaggcagtgacagccaccctggaggagaggaggaaagagaaagccaagatccactaccggaggaggagacagctcatgaggctacggaaacagaccgagaggacgtggagaggaaattgacaaatcaaagaggtcctcaagacccacggactcctggtcttgagcccaattaaagactgttaattcctaaaaaaaaaaaaaaaaaaaa

SEQ ID NO: 5726 - DNA, 300 bp, Homo sapiens
ctcacattgcatgcaagtttgctgagctgaaggaaaagattgatcgccgttctggtaaaaagctggaagatggccctaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaaggtcttcccagaagctagaggctaaatggatatatccta

SEQ ID NO: 5727 - DNA, 251 bp, Homo sapiens
caaaacatacaacagaccttggttttcctcgaagtgcccttccaccctcctgcccgtatactatggtgccattggaggactccaggccaccaggcagttggacagccctacctcagtggcatcagtggacgggcctgtgctaatgggatccacatgaataggggctgccctcgctgcagtggctaccgggcatgaggcccagcagcactgccaggcgagcttcagcagcagagtgacaccagcagcctgct

SEQ ID NO: 5728 - DNA, 150 bp, Homo sapiens
ccacgattcaaataattcccctcctaaaacaaaaaggagggaacgtcaactacattgcaattaattatatacatcttctatactctgaatatacgaccgcgcatacgatgactcgtagtacatctctttaacaaccacaaaccttaacgc

SEQ ID NO: 5729 - DNA, 304 bp, Homo sapiens
gaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggcccctcgtgctcttggtttgaggggactaaaggtgacttgggagaaagggggagcgtggccctccaggaagaggtcccaacgctttccttgagctatagtctccaggtgaccaggcctccagctatgcagaaattgccgagacgtaag

SEQ ID NO: 5730 - DNA, 265 bp, Homo sapiens
ctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgcttggggttggtgcgtgcttggcatggcctgtgccatcagttatcttaattgaaggacttggcagatgaacttcgctcttagttggatgctcatcgaaggcgc

SEQ ID NO: 5731 - DNA, 275 bp, Homo sapiens
ccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgactggctgcatctcctctcctgatgtgctccatc

SEQ ID NO: 5732 - DNA, 132 bp, Homo sapiens
cccatttagattaaagattgctttatccagcagtcaattaactctccagttatcagtactcccacaattggccagggcaacaataattggagttcatactgatgccctgaggcactggaaaaaaaaaaaaaa

SEQ ID NO: 5733 - DNA, 280 bp, Homo sapiens
ctcgtcccttcgtgccgaattcggcagttaaactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctggaaaccagtcccccatggatactgaggggctgatctgtgatagtcctatcctcagcggaacttgtcattcttatgtggggggaaggctgactataaacaaaa

SEQ ID NO: 5734 - DNA, 229 bp, Homo sapiens
cggaggtgcaggtcctggtgcttgatggtcgaggccatctcctgggccgcctggcatttcggtggctaaacaggtactgctgggccggaagtggtggtcgtacgctgtgaaggcatcaacatttctggcaatttctacagacacaagttgaggtaccttgctttcctcccaagcggatgaacaccacccttccggaggcccctaccacttccggcccccagccgaatct

SEQ ID NO: 5735 - DNA, 164 bp, Homo sapiens
gtttacaacagattttgtgaactcagccaagcacagttgttggcagggacttaggcttgcttacaaaggaggcatgtttttaggcaattattaattgttttatgggccaaaaaattcgagggacttttattttgtggtctctattgtttaaacaagtgtttttt

SEQ ID NO: 5736 - DNA, 237 bp, Homo sapiens
agagggcttgctctatctctgactctcccacacacaaggtggaggccattgttagcctattgagagagcatggccatcttcaagccagagaagaaagccctgactagagaaccaaaccctgtcaaaaccttatattctggacttccgaaccttcagaaactgtgagaaaactttatttcttttgttttagacacccagttctatgtgtattttgttgctgggcaacccagcagaact

SEQ ID NO: 5737 - DNA, 319 bp, Homo sapiens
ggcagtgcaaatatccaagaagaggaagtttgtcgctgatggcatcttcaaagctgaactgaatgagtttcttactcgggagctggctgaagatggctactcttgagttgaggtgcgagttacaccaaccaggacagaaatcattatcttagacaccagaacacagaatgttcttctgtgagaagggccggcggattcgggaactgacttctgtagttcagaagaggtttgctttccagaggcagtatagagctttatgctgaaaggtggcactagaggtctgtgtgccattgccaggcagagtctctcgatacaactc

SEQ ID NO: 5738 - DNA, 319 bp, Homo sapiens
aataaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaatttcataaacacatctcgtgtcatcacagccaaggttttaggtgctataccatggcttattaaatgaaatggcactaaaggttcttgagattctttatactctctgccttcagcaatcaattccattcatacatcagcactctgctggttctgttggaatatgttctgta

SEQ ID NO: 5739 - DNA, 218 bp, Homo sapiens
ctggactcagctcaacatgttccagaccttgaagtacctggccatcttggggcagtggtggacgtttctgggctggccaatcggatgctggccctagcaggcagtcaagagaacagcacattagttccagaagaagatggaaattctgaaaactgaatgtcaagaaaggagtcaaggacaattcacagtatgaggagaaaatggaaaaaaaaacttat

SEQ ID NO: 5740 - DNA, 320 bp, Homo sapiens
ctggtaatagaattgtttacctttataccaagaaggttgggaaagcaccaaaatctgcatgtggtgtgtgcccaggcagacttcgagggggttcgtgctgtaagacctaaagttcttatgagattgtccaaaacaaagaacatgtcagcagggcctatggtggttccatgtgtgctaaatgtgttcgtgacaggatcaggcgtgctttccttatcgaggagcagaaaatcgttgtgaaagtgttgagggcacacgcacagagtcagagagctatataaaaaaatgacactcttttgagtataaaaatgaaagacgctgta

SEQ ID NO: 5741 - DNA, 230 bp, Homo sapiens
cctgtttggaaaccccatgtacaattcccagttttttgtaagtgtcagtgcgagagacatttgactcttgtgtttgtatctcctttttatgattgctgtacctacccatgtctttttggggaggggtgaaaggagatttgaaataaaattgtttagagattaaaaaaaaaaaaaaaaacctcgggggtacttttggggcgcccggggcccattcgttttccacccggggg

SEQ ID NO: 5742 - DNA, 225 bp, Homo sapiens
aattaatgtcacaggcgcaagcccttgaacttagttgagatgcagaaaacaaacaaatgcaatgacatatctgagaagcatttatgtaactccggttaagtggtgaggagggtgtgtgaagacagtgtgcatgcatgagtgtgtattcatatatatgtgtatacatatgaatttcactgttattttccagggtctatggacactgtggcagtaagagtctatgat

SEQ ID NO: 5743 - DNA, 231 bp, Homo sapiens
gtcctctgacctgagagcgaagggggaaagcggcgagatgactgaccgctacaccatccatagccagctggagcacctgcagtccaagtacatcggcacgggccacggcgacaccaccaagtggggagtggctggtgaacccaccaccgcgactcgtactgctcctacatgggcccacttcgacctcctcacctacttcgccattgcggagagtgagagcaaagcgcgagt

SEQ ID NO: 5744 - DNA, 217 bp, Homo sapiens
cggcacgaggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgcgaccaacttgcccctaagggtgaggccaaccgcttattgcagtgcggccccctgtcctctacc

SEQ ID NO: 5745 - DNA, 211 bp, Homo sapiens
aggtcgacactagtggatccaaagaattcggcacgagacattggcgaatttgaaatcattgatgaccacagagctgggaaaattgttgtgaacctcacaggcaggctaaacaagtgtggggtgatcagccccagatttgacgtgcaactcaaagaccttgaaaaattgcagaataatctctttccatccggcagtttggtttcattgtact

SEQ ID NO: 5746 - DNA, 288 bp, Homo sapiens
ctgcaacctaccctctctctgcctcagccttacacccaagcagtaggtctgtgctctccctgtctctaggtcgctgagagaggtgctttttcttcataaaacctttgggggtttggatttccccaggaagatggagaatggaatactcactcttgggtctaatctttccccttgaccagaactctctccccacaaaaatgcctttaaaaaccttctgagacttaagcattctgcccacttactaactggccagttctccagcactggaggtggggcagataacgcggc

SEQ ID NO: 5747 - DNA, 108 bp, Homo sapiens
ccaaaacacaggtagaaaatgacacagtagcccaatcgtctacttttgtgattgctaagaatttgtgtaattataccttcagaagtttgtttagaatttacatgattt

SEQ ID NO: 5748 - DNA, 280 bp, Homo sapiens
aaaagactgataagtacctttgttttgtttctgattttaaagacattatacctaatatttcattattaagtgtaatgtttctttattcttttggtatatctggttcagaactttctattcctagattcctagagtttttaatcataagtaagcagtgaattttaagaaagcctttttctgttactgagatacactttcccctctctatctattagttttgtggatatataatatatttgtcatgataaacattctgatttctgctactgcatgcatttga

SEQ ID NO: 5749 - DNA, 135 bp, Homo sapiens
gaaatccatatcttaaagaaacagctttcaagtgcctttctgcagtttttcaggagcgcaagatagatttggaataggaataagctttagtttttaacaacccacactcctacaagggtttagaaaaaagggttt

SEQ ID NO: 5750 - DNA, 137 bp, Homo sapiens
gtgaggttgtctagtccacgctcggagccatgccgtccaagggcccgctgcagtctgtgcagggtttcgggcggaaggaggcagccacaactttgggccgaactgcaaacggggcaattggtttaatcaagggtaac

SEQ ID NO: 5751 - DNA, 106 bp, Homo sapiens
ttctgagctttcctgtctttcctttttttctgagagatccaaagcctccacgactctgtttcccccgtcccttcctgaatttaattttgcaaataaggtcaatttg

SEQ ID NO: 5752 - DNA, 108 bp, Homo sapiens
ctctcccaagccccaggggacagtggggaggcaggggagggggtggctgtggtccagggacccaggccctgattcctgtccctgggggtttttccttgccccgcctgt

SEQ ID NO: 5753 - DNA, 115 bp, Homo sapiens
tccaggcggttctgaatgtgaagcactacacccagcagagtccccgtgccctctgttccccacttcccggcccagtgttctctctttccgagggcaccccagggattcgacaagg

SEQ ID NO: 5754 - DNA, 108 bp, Homo sapiens
gacaacattggctagagaaaaagatgttgttgggagagccaggggatttgttccttatattgggattgtgacggtcccatgaatgactatcctaaatttaagggatgc

SEQ ID NO: 5755 - DNA, 260 bp, Homo sapiens
aatggaggtaatatttacttcagaggctttctgagaggatgaattagggtatattgtgagataacataaaatttaccacttttaccatttttaagtatacagttctgtggctttaagtacattcatgttgctgttgtataaccattactaaagctatattttttaagtgctcaagactgtgcatgcagtaactgctcagagaatggcagctagaattattctcattaatgctatcttattccattttaaatttgtgtaaa

SEQ ID NO: 5756 - DNA, 322 bp, Homo sapiens
cttcgagatcatacacctgctcacaggcgagaaccctctgcaggtcctggtgaacgccatcatcaacagtggtccccgggaggactccacacggattgggcgcgccgggactttaagacgacaggctgtggatgtgtccccctgcgccgtgtgaaccaggccatctggctgctgtgcacaggcgctcgtgaggctgccttccggaacattaagaccattgctgagtgcctcgcagatgagctcatcaatgctgccaagggctcctcgaactcctatgccattaagaagaaggacgagctggagcgtgtggccaagtccaacc

SEQ ID NO: 5757 - DNA, 245 bp, Homo sapiens
  misc_feature 37: n = A,T,C or G
ctcgtgcgaattcggcacgaggaagggccaagcacgncaaagcaggaacatcggatttggggaacgcgtgtcaatcccttgttgccgaagggcttgggcgggagagacttttctgttccttgtgtaactgtgttgctgaaagactacctcgttcttgtcttgatgtgtcaccggggcaactgtctgggggcggggatgggggcagggtggaagcggctccccattttataccaaaggtgctacat

SEQ ID NO: 5758 - DNA, 216 bp, Homo sapiens
  misc_feature 64: n = A,T,C or G
ctcgtgccgaattcggcacgagtacaatcgtgtgctgactggaggagaagccttgagaccgtgngcaagcttgcccgggcatcaaggaactatgccaccgttatctcccacaaccctgagaccaagaagacccgtgtgaagctgccctccggctccaagaagggtatctcctcagaccaacagagactgttgtttgtgttgtggcttgaggtggcc

SEQ ID NO: 5759 - DNA, 186 bp, Homo sapiens
gggaccatcggcatttctgtggatccgaggaggcggaacaagtcacggagtccctgcaggccaacgtgcagcggctgaaggagtaccgctccaaacttatccatcttccccaggaagccctcggcccccaagaagggagacagttcttctgaagaacatgaaacttgccacccagctgaccaggac

SEQ ID NO: 5760 - DNA, 140 bp, Homo sapiens
cgcgcgcatcatggacaccagccgtgtgcagctatcaagctggcaggtcaccaaggttcttgggcaggaccgttctgcaagggacagttgcacggaggttcgcgttggaattcatgtggcggacacgggcccgattccat

SEQ ID NO: 5761 - DNA, 280 bp, Homo sapiens
cgagtttttcataattgctctttatattgtgtgttatctgacaagatagttatttaagaaacatgggaattgcagaaatgacttcagtgcagcagtaattatggtgcactttttcgctatttaagttggatatttctctacattcctgaaacaatttttaggttttttttgtactagaaaatgcaggcagtgttttcacaaaagtaaatgtacagtgatttggaaatacacataaatgaaggcaatgcatggccttcccataaaaaatatttgatggctg

SEQ ID NO: 5762 - DNA, 306 bp, Homo sapiens
atttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccacaggccatccgggatggtgtcattgaggccagcatcaaccacgagaagggctatgtcccatccaag

SEQ ID NO: 5763 - DNA, 230 bp, Homo sapiens
gttacccgttagagagctgagaccctcatttaaaactcacctcccaatcaccccaaacaaatggaagagaagagaaaggacatggcgtattttgtatttaaaagtaattgtattaattatttaaagtgttggaaagcaaaataacaaaaaagagaaacgccaacaaaaatcagcagatgttgaaggcaggggtctctgggggtgggctccggcaccacatcctggagtga

SEQ ID NO: 5764 - DNA, 167 bp, Homo sapiens
aagtgacatcgtctttaaaccctgcgtggcaatccctgacgcaccgccgtgatgcccagggaagacagggcgacctggaagtccaactacttcttaagatcatccaactattggatgattatccgaaatgtttcattggtgggggcagacaattgtgggcttccaag

SEQ ID NO: 5765 - DNA, 112 bp, Homo sapiens
ggctcggctgccggccacagactggattttctgacatcaagtccacgcgttctttccgcagcatagactgggacttcctggagaagagcagccgttccctccattccagcca

SEQ ID NO: 5766 - DNA, 268 bp, Homo sapiens
ggaactgactgctgtagttcagaagaggtttgcgctctacagagggcagtgtagagctttatgctgaaaaggtggccactagaggtctgtgtgccattgccaggcaagagtctctgcgttacaacctcctaggagggcttgctgtgcggagggcctcctatggtgtgctgcggttcatcatggagagtggggccacaggctgcgaggttgtggtgtctggcacactccgaggacagaggtctatatccatgaggtgtgtggagggcct

SEQ ID NO: 5767 - DNA, 160 bp, Homo sapiens
ctcgtgcgaaattcggcacggggcagcacccaccccgcaccggcgactccatcttcacgggccacccccttgcggcggacgggttgaccaccaggccaccacattcattcccaggagcttgaggctcctccagccgggattgacggccttccccaccaac

SEQ ID NO: 5768 - DNA, 145 bp, Homo sapiens
ggattgcttgagcccaggagtttgacaccagactcggcagtatagggagacttcttctctacaaaaaatttaaaccacctaggccaggaggcccaggtagggttgaatcaacttgagcctcagaggtttaggaccagcctggcca

SEQ ID NO: 5769 - DNA, 111 bp, Homo sapiens
cttcctggacctatgaatcctggctatgggagaaacagtaccatatattagatgctgattcagaacaaacacagccttcttggagaacctttgcttccagccctgcaaagg

SEQ ID NO: 5770 - DNA, 135 bp, Homo sapiens
cgtgcctgtagtctcagcctcccaaagtgctgggattacagggtgtgagccaccatggccggctttgccctggttgttttaatggtatttccagcttttatttgtggtttatggtgaccataggtccattagcct

SEQ ID NO: 5771 - DNA, 140 bp, Homo sapiens
caagcacgtgccccgggctgtgtttgtagactggaacccacagtcattggatgaaggtcgcactgggcaacctacccgccagctcttcccaccctgaggcagctcaatcaacaggcaagggaaggatgcttgcccattaa

SEQ ID NO: 5772 - DNA, 140 bp, Homo sapiens
gcaacgcggaggaaacgggagttaaccggagagcgtagtgaccatcatgagcctcctcaacaaggcccaagagtgagatgaccccagaggagctgcagaagccgagaagaggagggaatttaacaaccggtccacttctc

SEQ ID NO: 5773 - DNA, 181 bp, Homo sapiens
aactatgagatgctcaaggaggagcacgaggtggctgtgctgggggcgccccacaaccctgctcccccgacgttcaccgtgatccacattccgcagcgagaccttcgtgcccgaccatgtcgtctggtcctgttcaacaccctcttcatgaacccctgctgcctggcttataggattcgcc

SEQ ID NO: 5774 - DNA, 190 bp, Homo sapiens
ccggacggacgctcgtcttcgcccgccatggccgagagcgactgggacacggtgacggtgctgcgcaaggaaggggccctacgggccgcccaggccaaaatccaaggcagggctatcttaggcggcacagagaccgagggagaaggattgtggagacttcccaagaaatgggcctgctggccaagaacaa

SEQ ID NO: 5775 - DNA, 233 bp, Homo sapiens
aaaacggagagggaatgggagacttgatatttaagcagcttgaatggtttttcttttctttatttttaaagaaatgcacttgcctatgatactgtctctccagtgaaatgattactcctccattactctattgatacactattgtgcatgctagtgttgtatttctatacagtagctcgaaattgattaacttatactgtaggtgttatgtatccctatgacacaaaaaattg

SEQ ID NO: 5776 - DNA, 245 bp, Homo sapiens
ggaatttgatgggaagagcctggtctcagttaccaaggagggtctgggagctgcctgaggatgaggaggagaagaagaagatggaagagagcaaggcaaagtttgagaacctctgcaagctcatgaaagaaatcttagataagaaggttgagaaggtgacaatctccaataggacttgtgtcttcaccttgctgcattgtgaccagcacctacggctgggcagcaatatggagcggatcatgaaa

SEQ ID NO: 5777 - DNA, 216 bp, Homo sapiens
ccaacgccagcgccgcctctcgctcgccgagctccagccgaagagaaggggggtaagtaaggaggtctctgtaccatggctcgtacaaagcagactgcccgcaaatcgaccggtggtaaagcacccaggaagcaacttgctacaaaagccgctcgcaagagttccgccctctacttgaggggtgaagagaacctcatcgttacaaggccttgtact

SEQ ID NO: 5778 - DNA, 181 bp, Homo sapiens
ctagtaattcctttagttttattctatcttctttatgaagacacgggtttctatttttactggttttgtccttttaaaaagcttgtctttctttagtttttgtttttcttgctctttttgcccaagcttggggttcagttgtgccattcatagctcactgaaggctcaaattcctctggct

SEQ ID NO: 5779 - DNA, 142 bp, Homo sapiens
cagaattctatttgggcaagagatgcgcttatgtatataaagcaaagaacaacacagtcactcctggcggcaaaccaaacaaaaccagagtcatctggggaaaagtaactcgggcccattggaaacaagtggcattggttcg

SEQ ID NO: 5780 - DNA, 212 bp, Homo sapiens
taaaaaagccccaaaatattgaagttcatctgaaatgcaaggtgctttcatcaatgaaccttttcaaacttttctatgattgcagagaagctttttatatacccagcataacttgggaacaggtatctgacctattcttatttaggttaacaaaaggtttgattaatttggaattcctttaattccctaattggaattctaatgtgaatatg

SEQ ID NO: 5781 - DNA, 156 bp, Homo sapiens
gagagttgctattggaccatgtagaatgttgcaatattgtttacagggtcttttttcacccagcccggaaagtcagagatgtatattggaaaatttacaacttcatctacattggttcccaggacggttctcatagcacaattacccaaggaatct

SEQ ID NO: 5782 - DNA, 171 bp, Homo sapiens
catattcacttttctggctaccgaagtggagatgcagggggagatgatcaatcggattgagaagaacatcctgagctcagcggactacgtggaacgtggggcaggagcacgtcaagacggccctggagaaccagaagaaggcgaggaagaagaaagtcttgattgccatct

SEQ ID NO: 5783 - DNA, 175 bp, Homo sapiens
ggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctgggggacaatgtggggcttcaatgtcaagaatgt

SEQ ID NO: 5784 - DNA, 220 bp, Homo sapiens
tagatattgaagggaggttatttgtggtctctaatatcatgccaccattgtccccgtccccatcagtcataactttttcttttgccctcataaagctgagcctgccaagaataatatgtttatgtctttatatacagctgcctaaacccatttatcaactatttaagggtctttattacaattcaatttttgggccatttaattgtattggaattacaac

SEQ ID NO: 5785 - DNA, 214 bp, Homo sapiens
cccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctttgggaggagaatttattcaaccagtttcctcatacagggttca

SEQ ID NO: 5786 - DNA, 290 bp, Homo sapiens
ccaacatgccatccagactgaggaggacccggaaactaggggcacgtgagcaacggccacggccgattaggcaagcaccggaggcaccccggcggccgcggtaatgctggtggtctacattaccaccggataacttcgacatataccacccaggctactttgggaaagttggtatgaagcattaccacttaaagaggacccagagcttttgcccaactgtaaaccttaaaaatttgggactttgggcagtaacagcacgggtgaattctgcttaaaacaaggtctgggtg

SEQ ID NO: 5787 - DNA, 138 bp, Homo sapiens
agctgacaccccaagaccatctggtttgagctgccacaggccaggagctgcttatacaccatctgtttcctgttgagaaagcaggtgcctttggcattaggtggccaggcatcaattggaagggtgtccaggcccggg

SEQ ID NO: 5788 - DNA, 170 bp, Homo sapiens
gcaaaacgagggctacatgcgccgcggtggctaccgcagcagcagtctcagacggcctactgagctctccactctgtttcccggcctggccatccaacctttgaggtcctaaacacacaccttaagtaattaaagggctttgtttaaaggtggtccttggtggattgctt

SEQ ID NO: 5789 - DNA, 160 bp, Homo sapiens
catctctcacaacaaaaatagctggtgtagtgatgtgctctgtagtccagttactctggattctgaaatgggaggatcgtttgagcccaaaccagtcaaggttccagtaggttttgatggtaccacctccactccagccttggcaacagatgggattctt

SEQ ID NO: 5790 - DNA, 295 bp, Homo sapiens
attgactgtatatgaccttaatctttgtgcagcctgaaggatcagtgtagtaatgccaggaaagtgctttttacctaagacttccttctcagcttctcccataaaggggaccctaatatgcattttgatttgtaattggaaatgttacctttcactgaaaggttcatggtgatggttgcattacttttaactgccaatattaagggaaggtgtgcctttgacttcaatcagtaatccctctggtacacagagaaatgtctttaaaatgctctaaaaactttaaaatttaaaatgt

SEQ ID NO: 5791 - DNA, 274 bp, Homo sapiens
cagaaagtatttttgcttcaacgtttctttcttgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatgtaataaactgtaccatgctgctgcatgttttcaagt

SEQ ID NO: 5792 - DNA, 163 bp, Homo sapiens
attgatcagagcattgtgcaatacagtttcattaactccttcccccgcttccccaaaaatttgaatttatttttcaacacttttacacctgttatgggaaatgtcaacctttgtagggaaaccaaattaaaaattggaaaataaaaccccttaaaaaaaaaaa

SEQ ID NO: 5793 - DNA, 125 bp, Homo sapiens
ggcacgaggtgaatcccagcggtgccccgactccgtgatatcgctggagccctaacctctcagagcctcagtgtcctcatctattagattgggacaatagtagacttatcttcattggctttggt

SEQ ID NO: 5794 - DNA, 254 bp, Homo sapiens
cccactgagacctatagaggaagctgctgaagagaaaggacagcagagatacaattgcctatgttgagagatgctcttgagtcccataacatacaacctaccagttttctgcaacccgaaagcccagggctggcactataatcttaactagtcactacataaggcttttgtttttatgatgtctatccatagttataagttcttcaattcccaagtgccggaaaacctgtgttatccttgagaatttgatatct

SEQ ID NO: 5795 - DNA, 269 bp, Homo sapiens
gccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccaaccaggcaaggctg

SEQ ID NO: 5796 - DNA, 305 bp, Homo sapiens
agtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgtctcatcaactgccgcaacaataagaaacttcttggccgcgtgaaggccttcgataggcacttcaacatggtgcttgagaacgtgtaaggagatgtgtgactctaggtaccccagagtgggcaagggcaagaagaggtgcacgccacttaaca

SEQ ID NO: 5797 - DNA, 241 bp, Homo sapiens
actttccaatctcagtcactctaggactctgcactgaatggctgacctgacctgatgtccattcatcccaccctctcacagtttggacttttcttccctctctttctaagagacctgaactgggcagacttcaaaataaaatctcggggttctatttatttattgtcttcccgtaagagccttcgggtcaaggcagagggcaggaaactaactctgtgtgagtgcaaatgtccccctgtag

SEQ ID NO: 5798 - DNA, 265 bp, Homo sapiens
aaaatctccaggggcaccattgaaatcctgagtgatgtgcagctgatcaagactggagacaaagtgggagccagcgaagcaacgctgctgaacatgctcaacatctcccccttctcctttgggctggtcatccagcaggtgttcgacaatggcagcatctacaaccctgaagtgcttgatatcacagagggaaactctgcattctcgcttcctcggagggtgtccgcaatgttgccagtgtctgtctgcagagttggctacccac

SEQ ID NO: 5799 - DNA, 262 bp, Homo sapiens
ggtcgacactagtggatccaaagaattcggcacgagcggcacgagctaagatgcgccgccggacctacagagctcatggtcggattaacccatacatgagctctcctgccacattgagatgatccttacggaaaaggaacagattgttcctaaaccagaggaggaggttgcccagaggaaaagatatcccagaggaaactgaggaaccaaaatcttatggcacgggagtaaattcagcattaaaatatatgtaattaaaagg

SEQ ID NO: 5800 - DNA, 278 bp, Homo sapiens
ttttactattaaccattgtatattatttaaaagccataagaatacgaaaaagcatgaccgcacaaattccagagaatttgttttttaatcaatccgatcaattttacacaccaaattatcattaggaacatagagatcatgtgaattgtattaaacctatgacatatgacactattatataggagaattttaactctaagagacaatatatttttttaaaagagagattaaatatatcacgtcttatgctaaatatatatagatatatatatatgatg

SEQ ID NO: 5801 - DNA, 318 bp, Homo sapiens
cctgcagagtactccatggaaacaattgccgagcacgtgctcgcaatttgccgagcacggtccggtttgaactcctagactaagactaggtaggtgatacataccttcttcccaccaagtactcacgatccaaactatgaattttagattcggatcaaacgaggattgatccgagggaccaacgttgtgataaatcttacgtcgtcttatatattaagtttttgtggaggatcggataagtctatagtgtttgtcacagatagtcccgtaccacaccccagaccataggagtcgctctccggaccgcggtctaatggg

SEQ ID NO: 5802 - DNA, 135 bp, Homo sapiens
cgtgcctgtaaccccagctacttgtgaggctgaggtgggaggatcgcttgagcctcgggaggcggaggttgcagtgagctgagattgtgccactgcactccagcctgagcaatagaccaggactccatctcaact

SEQ ID NO: 5803 - DNA, 285 bp, Homo sapiens
cgcggtcgtaagggctgaggatttttggtccgcacgctcctgctcctgactcaccgctgttcgctctcgccgaggaccacgtcggtcaggaagcccgcgcgcaaccagccatggcttttaaggatacccgaaaaaccacccgtggagccggaggtggcaattcaccgaattcgaatcaccctaacaggccgcaccgtaaaatccttgggaaaaggtgtgtcctgactggataagaggcgcaaaagaaaagaatctcacagtgaaaggcccagttcgaatgcctcc

SEQ ID NO: 5804 - DNA, 281 bp, Homo sapiens
  misc_feature 223: n = A,T,C or G
tgaggtctgtgtatgctcacttccacatcaacgttgttatccaggagaatgggtctctggttgaaatccgaaatttcttgggtgaaaaatacatccgcagggttcggatgagaccaggttttgcttgttcagtatctcaggcccagaaagatgatttaatccttgagggaaatgacattgagcttgtttcaaattcagcggctttgattcagcaggccacacncagttaaacacagggatatcaggaattttgggagggtatctatgtctctgaaaaggga

SEQ ID NO: 5805 - DNA, 230 bp, Homo sapiens
caccgtgtgtctaccgacttagtatgagtccgtgtgtcggactattactgtccgggactatgtaatgaatcggaccgtttggtgtcacaccccgatcccctggacgtacaggactctaccctgggtgaataggggtttgtgtcctgtggatacatggagtctctaatttgttccgaacacatggaccttttaaataattttctaaccctgcacctgtagagagttataga

SEQ ID NO: 5806 - DNA, 102 bp, Homo sapiens
agctgaggcaggagaatggcatgaacccgggagatggagcttgcagtagcgagatcgtgccacttcacttccagcctgggttacagagttggacttccattt

SEQ ID NO: 5807 - DNA, 268 bp, Homo sapiens
gttgttccagacattgatctttttcctctatgttgctaagctggtagaaggctggagttgctggcaaccatctttgcaaccatgcagggggacctactttggaaatgaggcaggacaaagaggagaccagataaagggggacacatgtttgactttgtacagctggagaccagcattgctggaaatgggcactgaaggcagtttaatggggtttgtcactcgtaaccaggtgccccatggcaggctcacagatttgtatgggcagatt

SEQ ID NO: 5808 - DNA, 103 bp, Homo sapiens
cggtaaagtccgccatcagaagactgaagggagttgaaagaccagtagacgctcctctactctttgagacatcactggcctataataaatggggttaatttta

SEQ ID NO: 5809 - DNA, 110 bp, Homo sapiens
gttggacttggtactgaagcaggctttttgggtaacagaaatgacatttaaggggtcactctatatcctgttttttagtttctctgcctctcagattctgttaactcagt

SEQ ID NO: 5810 - DNA, 138 bp, Homo sapiens
acacacatgtatgcacacacacatgccccgcacacatatccatgcacacacacacatatatacacatgcacatacacagattttttctggtggccaggtgggccaacctgggtttccctggctgggcaggaggagagg

SEQ ID NO: 5811 - DNA, 345 bp, Homo sapiens
ccgccacaatggtcgcgcatgaattgtcctgggcagatgctctcaggagtatcaacaatgccggaaagagaggcaaacgccaggtgcttattaggccgtgctccaaagtcatcgtccggtttctcactgtgatgatgaggcatggttacattggcgattttgaaatcattgatgcccacagagctgggaaaattgttgtgaacctcacaggcaggctaaacacgtgtggggtgatcagccccagatttgacgtgcactcaaagacctggaaaaatggcagaattaatctgcttccatcccgccagtttggtttcattgtactaacaacctcagctggcatcatgg

SEQ ID NO: 5812 - DNA, 138 bp, Homo sapiens
agttccaaacctgaaggctttcatgtcccgttttgaggctttagagagaatcgctgcctacttacagtctgatcagttctgcaggatgcccatcaacaccaggatggcccagtggggcaacaggcctgtatgttgagc

SEQ ID NO: 5813 - DNA, 142 bp, Homo sapiens
gtggcaagagagcctcacacctcactaggtgcagagagcccaggcctaatgtaaaatcatgcacttttaaaaggcaaaccttaaattctgcaaagacagcagcaggcttttatacggtcatctggattgatccctttgaaat

SEQ ID NO: 5814 - DNA, 109 bp, Homo sapiens
atcaaggtgaaaggagaacccatgcgggaacttcgcatccgcaaactctgtctcaacatctgttttggggagagtagagacagacttacgcgagcagccaaggtgttgg

SEQ ID NO: 5815 - DNA, 130 bp, Homo sapiens
tcgccgccctgctggccacctgcgtggtgctggcgctcgtggtcgtcgcgctgagaaagttttctgcctcctgaagcgaataaaggggccgcgcccggccgcggcgcgacttcggctgcaaaaaaaaaaa

SEQ ID NO: 5816 - DNA, 190 bp, Homo sapiens
cttgtatgtatgttatggatacataaaatgcacgcaagccattatctctccatggggaagctaagttataaaaataggtgcttggtgtacaaaactttttatatcaaaaggctttgcacatttctatatgagtgggtttactggtaaataatgttattttttacacctaattttgttacctctcagaatt

SEQ ID NO: 5817 - DNA, 165 bp, Homo sapiens
catgcccaacaagaggttctatacctctttaatgaattgactttcataaattggttatgttggtgggcaagttctttaagctggaaattgtaaattcctcctgaaatgtttttcatgcagttccatgacctattactacaataagggatggtcttgggtgtaaaa

SEQ ID NO: 5818 - DNA, 169 bp, Homo sapiens
gttgccagtgtctgtctgcagattggctacccaactgttgcatcagtaccccattctatcatcaacgggtacaaacgagtcctggccttgttctktggagagggattacaccttcccacttgctgaaaaggtcaaggcctcctgggctgatccatctgcctttgtggct

SEQ ID NO: 5819 - DNA, 251 bp, Homo sapiens
cgtgaggcggcttcggtgagagccggaaccgggcgggcagaggggcgctcgtagggttgggggacgcctgtggcttggctgcagcggccggcaagaccctggaagagaccctggctatggaaacggccaaggctgtcttgggaatgtcctgagcagccctccgagtcgagcctctccccccgagtttctgagtgacctgggttgatatagattgaccttgtgggcagcgagagtcacagacaggacagcaa

SEQ ID NO: 5820 - DNA, 241 bp, Homo sapiens
cgagccgacgccatcaacaccgagttcaagaacaaccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctggggggacctctacgaggaggagatgcgggactgcgccgccaggtggaccagctaaccaacgaca

SEQ ID NO: 5821 - DNA, 225 bp, Homo sapiens
ccaatttcaaattgtgaacccagagacactcccatccacccttctccatgctcatccccaaactggggccttggagcaaggcactctcaaatcttgaaccctggaccaagcttttccagaccccaccctaccttccacccaggtcaagacattgccaaatcttgaactcagaccccaggtgttccatgcccctgtgtggatggagtcgggtatcctgactgttgg

SEQ ID NO: 5822 - DNA, 155 bp, Homo sapiens
attagagctcaggagttcgagaccagcctgggcaacatggcaaaaccccatttctacaaaaagaacaataacaacaacaaaaaattaggcgtggtggtgcattctttcagtctcagctcctggggggcttaggcaagagggattctttaaccctg

SEQ ID NO: 5823 - DNA, 225 bp, Homo sapiens
cgcattggcgctcctacgctcagccacctcaccaggctgccctggtcagccatggctcctcgtggcctcttccacaagtacttcgcaggagggtgacaagcacaccttaagcaagaggagcttaaggagcttgatcagaaggagctcaccatttgctctaagcttcaggatgcttaaatttcaaggcttatggaggagttttacccaacaagggcacgaggggaw

SEQ ID NO: 5824 - DNA, 171 bp, Homo sapiens
gagatcgagaccatcctgggctaacaaggtgaaaccctggtctctgctgaaaatacaaaaaattagtcaggtggtggtgggtggggcgcctggtagttcccagctacttggggagggctgaaggcaaggggaaatgggcctgaaccccaggggggcaaggagctttccaag

SEQ ID NO: 5825 - DNA, 175 bp, Homo sapiens
gctacaccgggtcagcgggagagaaaggagagccgggccccccaggatctgaaggccttccagggcccccagggcccaggcgggtccccagaaggggagcccagggacccccaaggtaaacttcggtttagaagggggcacccccgggtttttaagggccaaggaagggtttttt

SEQ ID NO: 5826 - DNA, 181 bp, Homo sapiens
tcagttctacaattctggttaaaacccatgggcactggtcaattgcatgattaaatgtaggagatgggaagggtgataagttttagttaaatattatggggtttgtgctttctccccttctatgttggttagggctgtgcttctgggcacaataaattatggggccctttttctgggaatt

SEQ ID NO: 5827 - DNA, 140 bp, Homo sapiens
ttgtaaaaacctgaacccagaaacaacacaatccgttgcaaacccaaaggagccaagtactttgcaaacctctgtcacgtcttaggactctagcactcgacatgcgctcgagcctgaacctgagagtaccatcggagtac

SEQ ID NO: 5828 - DNA, 110 bp, Homo sapiens
gtctgagttatcaataagctcctagtccagacgccatgggtcatttcacagaggaggacaaggctactatcacaaagcctcttggggcaaaggtgaactttgggaagact

SEQ ID NO: 5829 - DNA, 172 bp, Homo sapiens
cagatcagtttggggtgcatgtatgattttgcagcgtcaaattggagtaaggggagatttcttgttatactttgctcgggagaaggaggaatgtttatagaaactgatttagggtgacttccaaaacttttgtttaaaaaccaattttagttttcagaaagataaacataca

SEQ ID NO: 5830 - DNA, 122 bp, Homo sapiens
ccccactctgtgaaaacttaacgctttttggaagacatttctgtagcatgtcagtttggagaaatgatgagctacgccttgatgaaagaaccctgttggtgcttgctaagtttagccattat

SEQ ID NO: 5831 - DNA, 287 bp, Homo sapiens
accaaacaaccttagccaaaccatttacccaaataaagtataggcgatagaaattgaaacctggcgcaatagatatagtaccgcaagggaaaagatgaaaaattataaccaagcataatatagcaaggactaacccctataccttctgcataatgaattaactagaaataactttgcaaggagagccaaagctaagaccccgaaaccagacgagctacctaaggaccagctaaaagagcacacccgtctatgtagcaaaatagtggggagatttataggtagaggcg

SEQ ID NO: 5832 - DNA, 288 bp, Homo sapiens
tggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctcttcagatgccccagctgctctctaccagacacattgaagagaatatttaaaatctctgtaagaagaagaagttgaatttatcattgtgtctctgccagagtgttgcagagagagatactctcaacacagtgca

SEQ ID NO: 5833 - DNA, 246 bp, Homo sapiens
cccaaacccactccaccttactaccagacaaccttagccaaaccatttacccaaataaagtataggcgatagaaattgaaaccttggcgcaatagatatggtaccgcaagggaaagatgaaaaattataaccaaggataatatatgcaaggcctaacccctatattcctctgcataatgtaattaactagagaatatctcttgcacaggagagaccacaggtcaagagcccccgcgaacacacgcg

SEQ ID NO: 5834 - DNA, 280 bp, Homo sapiens
tttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatagggtcaggccagttgagatgtaaagaaggcccttaagctctatatgggtcacatagtaaggtgaattcacaggctgtaagggtatagcacatttcacctacacagatctcgagagtagg

SEQ ID NO: 5835 - DNA, 280 bp, Homo sapiens
gacaagtttagtgatgaagaagacagcttctcacccaaggagctcggaggcagagcctagagaggaagggaattatatacacctactaccagcagcccactcctaagaccactgtggactcctcagcatgtctgtacggctaggtagggtcatccaccttctctcgcttggtgttcctccttacctctgcttctctggatcccactctcccacctcttcactctcccctcccactgtccctccatctctagagtgcccagaggctcccccctctgctgag

SEQ ID NO: 5836 - DNA, 295 bp, Homo sapiens
aaccgactttcccttcccatacccctcagggtggttccctaccagccaggcttactacttctagaagaaagcagagtgccagggagtgagattgcatccctgggcttagaagttacggagagaagacttgtttagtattttgccatcagcacacaggagaaaccaagagagagtcttccttcacagactctcgagaccttctgtctctgtatgtacagagaggttgatagagtctctccaactccagcatagctcgaactctcagagggtcttcagagctccatctccacatgtg

SEQ ID NO: 5837 - DNA, 304 bp, Homo sapiens
aagaacgtgagcaagcccaggcacagccgacgccgcgggcgtcttgaccaaacacaccaagttcgtgcgggacatgattcgggaggtgtgttgctttgccccgtacgagcggcgcggcatggagttacttaaggtcttcaaggacaaacgggcccttaaatttatcaagagaaagggtggggacgcacatatcgcgccacagagggaagcgcggagagagctctagcaacgtactctgccgccatataggagagctgctctccaagagagactctagccccttccctgtcctctctctcagata

SEQ ID NO: 5838 - DNA, 215 bp, Homo sapiens
tgcatgtttgtgttgtatatttagtatgaacttttttcagaatataatatttcttagttatcaaaagtagttggaaaacatttgcaagactattaacatagaattgctgcttttatattttaacttcagattgtgaatttcactgtccctatatatatttatttctgtaaacacaaagaggccattttttcaatataaactatctgtaaaatttg

SEQ ID NO: 5839 - DNA, 302 bp, Homo sapiens
tgactccaaaacaacttacatccacgtcttctgaaatgtggattccagaatgattgcttagggactgacaacaaagcggggtttgtaagggaagccaggtttgggaataggagctcttaaataatgtgtcacagtgcatgtgtggcctctgtgttggtttcaagttgaggttgatcttgtatctacacattgttggggaaaaggaagcgatgcagacacgcagaaaggaggggctcagactcttctgagacacactctctttgtgtgtacatcatgtcacgggctttcactcacagtgtctc

SEQ ID NO: 5840 - DNA, 290 bp, Homo sapiens
aggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgcgtacaacggactgattcaccgcaagactgttggcgtggagcccgcagaccgacggcaaaagagtgtcgtgggtgggtcatataagcggagatcccgccagacgaagccctgccacactcctatatgcggagcaccattaaccaa

SEQ ID NO: 5841 - DNA, 340 bp, Homo sapiens
gtgcgaattcggcacgaggccgaaatgggcaagttcatgaaacctgggaaaggtggtgcttgtcctggctggacgctactccggacgcaaagctgtcatcgtgaagaacattgatgatgggcacctcagatcgcccctacagccatgctctggtggctggaattgaccgctacccccgcaaagtgacatctgccatggcaagaggaggatcgccaggagatcaaagataaaatcttttgtgaaagtgtatatctccaatcacctaatgcccacaggatcctctgtggatatcccctgggacaaatctctcgtcaataaggatgtcttcagagatcctcct

SEQ ID NO: 5842 - DNA, 305 bp, Homo sapiens
attgaagacgtccagctagcagccaatatactttgtggatgccaaattatgctattttaaatatgattaacaacagcaaattagagaacacaaaccatctccaaagctccatcttacatacatttaaataattatttttgtgtgtggagagaccactattctgcaggtgtgcagatataaggcataattctttaccaccctctgtgtggtgattttaagagacacatctttctgatcattgattctccctccctatttctagagtaatattgagcctctacacttcttttaaggtgattcataag

SEQ ID NO: 5843 - DNA, 345 bp, Homo sapiens
gatctacttatggttgatggagcacattgatttggagtttcagatcttccaaagcactatttgttgtaataacttttctaaatatagtgcctttaaaggaaaaatgaccacagggaagtgactttgctacacataatgttgctgtgttaagtattcatattaaatacatgccttctatatggaccatggcagagagacttaaaattaacagttatttatttgtgtaattcagagtttcataccattcagtgttgacactcaaacattgcaaaagtggggtggcaatattcagtgcttaacacttttttagcgttggcacatcttagaaatgagtgctcaggtgga

SEQ ID NO: 5844 - DNA, 225 bp, Homo sapiens
gcgcagtggcccacacctgtaatcccaggactttgggaggccgaggcaggtagatcacgaggtcagcagttcgagaccagcctggccaacatggtgaaaccctgttctctactaaaatacacaaattaggctgggtttggtgcacacggctgtaatcccaggcaactcgggaaggctgaggcagggattcgcttaattccacggagcaagagtttcagtgagcca

SEQ ID NO: 5845 - DNA, 170 bp, Homo sapiens
gtttgccacatcaagattttagggaagggggttattattttttagtaggggattgccgtttgaaaaccagggcactcttccccttgagggattgggaaagggagctctccatttgtggaggattctaggccatatggtttaaggccagaccccctaaaggtgaccctttt

SEQ ID NO: 5846 - DNA, 105 bp, Homo sapiens
agggcctgcattggatgagactgcccagcaagctgcgctccctagggccccaggattccacctaactggcctaggaacctggtgccaccgtggctcctgccgcta

SEQ ID NO: 5847 - DNA, 320 bp, Homo sapiens
aggtcgacactagtggatccaaagaattcggcacgagtgggctcttagttcagctgctggcactcgcaggatcctgcagtgctgggcccagagcccttggacaggcctcaggagtggtcaggaccaccaagcccctcctctccccctccacacctctagacctcgggcctccggaacccccagcaggctgggcttatactagctcctgacttaggagagagcctcgtgtcacaccacgtgtccctacaggcaaagtgtcctggcatttaaaacccagattatccctgggtttgggctgcagtcacctggagacgctggta

SEQ ID NO: 5848 - DNA, 285 bp, Homo sapiens
acccactttttttagacattgataaagtcttcttcacgtggatattttatacaagaacacttcagatgtattagatgtgactgattttaacaaatcctattagatttgtatcaactagttacatgtcctattcatagtcttttgtgaatcattgcctctttggtttaaaagagatggcctattttagagcctctggtatagatacacacctctcttttgtgacacacgagaaatctctaaaattgtcccccacagagatatattggctatcagaggtatggtttg

SEQ ID NO: 5849 - DNA, 270 bp, Homo sapiens
atcccccccctttttttaaagatagggtctcactcttttgcccaggctggggtgttgtggcacgatcatagctcactgcagcctcgacctcctaggctcaggcattcctttcaccttagctcctcaaagcactgggactgtaggcatgagccactgtgcctggccccaaacggcccttttactcggcttttaggaggcaaacacagtgctaatctaaccccttctcgtgtatacaccctcaacccttgcgctggcctctctctggagact

SEQ ID NO: 5850 - DNA, 320 bp, Homo sapiens
ggcccgggcaagagtttaacatcttcggcctgcattcctacatcttgtgtctgtacacgttcttaagcagcgtgtcaggagagcaccctgttgtcttctggtaaatgtgtccagggtcatcctgtctcctgtacctcctgggaaaggggccgctgctgtctggtgccctgtgagctgtgattgattgcctttggtcagtaatgcgttcaggagtccacaccaggcacagatggggccttgaagcgctttgtcatgcttctacagtcccatggatttgaaatgaactcatcctcgctgtgagcatccaggagcccttgaga

SEQ ID NO: 5851 - DNA, 263 bp, Homo sapiens
ctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacaccttaaacccaagagggcagctgtttgcagcatccagttcatcttaagagtgtcaacggttagtcatgcaataaatgttctcgg

SEQ ID NO: 5852 - DNA, 262 bp, Homo sapiens
ctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacaccttaaacccaagagggcagctgtttgcagcatccagttcatcttaagagtgtcaacggttagtcatgcaataaatgttctcg

SEQ ID NO: 5853 - DNA, 238 bp, Homo sapiens
cggaggccgcacgatgcctggagttactgtaaaagacgtgaaccagcaggagttcgtcagagctctggcagccttcctcaaaaagtccgggaagctgaaagtccccgaatgggtggataccgtcaggctggccaagcacaaagagctttctccctacgatgagaactggttctacacgcgagctgcttcacagcgcggcacctgtaacctccggggtggcgctggggttggctccatg

SEQ ID NO: 5854 - DNA, 221 bp, Homo sapiens
tatgacccgccccctcctcctccgcctcccatggacccttctaactttgtcaccatgatgggcatgggggtggcgggcatgccgcccttcgggatgcctccagctcccccaccgcctccaccacagaaactagacttgttttttaaggaaatatatattatatatagagagaattggtctggtttaaacacgccgaacctcaccatatagagccagacatw

SEQ ID NO: 5855 - DNA, 223 bp, Homo sapiens
gtgtattagtgtgcgtgtgtgtgcatgtgtgtgcgtgtgctgtgcgtttgtgtgctgtgtgtgcatgtgtgtgctgtctcgtgccgaattcggcacgaggggaagttcttttaaatcattaaatattaagacggccatctcttctattaaattacagtacatgtatagaccattgaggatcaagcctttacttcctttgagagttttccaacaacaggtgatt

SEQ ID NO: 5856 - DNA, 226 bp, Homo sapiens
caggagttcgtcagagctctggcagccttcctcaaaaagtccgggaagctgaaagtccccgaatgggtgggataccgtcaagctggccaagcacaaagagcttgctccctacgatgagaactggttctacacgcgagctgcttccacagcgcggcacctgtacctccggggtggcactggggttggctcatgaccaagatctattggggacggcagaaaaacggcg

SEQ ID NO: 5857 - DNA, 185 bp, Homo sapiens
gctatgccttgccccatgccatcatgcgtctggatctggctggccgagatctcactgactacctcatgaagatcctgactgagcgtggctattccttcgttactactgctgagcgtgagattgtccgggacatcaaggagaaactgttgttatgagctctggactttgaaaatgagatggccact

SEQ ID NO: 5858 - DNA, 103 bp, Homo sapiens
gagagagagagagagagagagagagagagagagagagagagagagagagagagagagagagagagagagagagagaagagagagaggaggggaggagagagag

SEQ ID NO: 5859 - DNA, 188 bp, Homo sapiens
gagaaaaaaggaaggttctgtcaacacaaatcacaaaccaccccggagaactaaaccccacagggtaaagggccaaagtacaaatttgtggccctcctgtacattagcccatttaccaaaggacggggactaaaaggggagggggaaccacggaacaacctttttaagggataatggggaaaagggtg

SEQ ID NO: 5860 - DNA, 340 bp, Homo sapiens
ctgagctctatggcactggttgtttagagtgactgatgaagtgcaactttcaaaaacatttttgatgacatcaccagcctacttcagaagttcagggcaccagtaaacaccatgtattattgaagatgaatctgtttgtatgtatccttgtcaaatatattctataatgaaataaaatctgaaaagtggagttcttatttgacctatatttcatgagagcatatatattaaaatatttaaaattagatatgattcacactatattctgtttcatatgcagagtttattctcacctcgggcatttgcagatgagactctaggtttcagatgagactctagt

SEQ ID NO: 5861 - DNA, 208 bp, Homo sapiens
tgaaggttgacagtaagatgagtagggctcgcgttgaaaaggccagaggaggaaagcttctccagcactctaataagctaccagcttaattcttccacacttccttgttcctgcccttggcttgttcggtccagtctaccttggaggcagccttgccccagagcagaccacattgctctcttagaggaactctttggggcatgttctc

SEQ ID NO: 5862 - DNA, 297 bp, Homo sapiens
  misc_feature 37, 38: n = A,T,C or G
ccccaccctcagcccgctcctgcccgcccagcacccnngccctgggggaacctcggggttctcagactgccaaaggaggctttgccattttggcggctccattgggttttgcaacaacttccccttcgtttttgaggggggtcatgtccccggggagccaccagacccctcacttgggttcggaggagagtcaagaaggggccacagcacgagcacagcagagacatcggatttgggggagcgcgtgtcaaatccccagaccgctgctcactctacaccctctctccacctgtctct

SEQ ID NO: 5863 - DNA, 287 bp, Homo sapiens
aggtatagttttctatactctctaattttacagaagggaggcagcattctgagatatttgcatatttgtgtaagggtatggtgctaatgtaaggaattaatttggtaggatcataggcttccaggacttgaggggatatagagagagactctgttttcaccccttgtcagagtttgtctctcttttgagatttttaaagagcgctcatgaatttttagatacccactagagtgctctctataattctcttaatactctatacactcactttctatatattcacactr

SEQ ID NO: 5864 - DNA, 226 bp, Homo sapiens
gggctgttataggtaggaccagataagactgtaagatgttgtttttggggttaaaggggagaaacttaaagtgttttactctttttcttagggttgtggctttcttatgtaggatttttcgttgcatttttctattcaaacacattgttatctgggtaatgtgctagtactgtatacgctctgtgaaaacatatatgtgagagagtataagtgcgctctctctttg

SEQ ID NO: 5865 - DNA, 232 bp, Homo sapiens
gtcacatcattcaccaacacatcaaggtgtattcagttctcttcaaccccgcattgggccattttaatttactgttagggtaaactaatttgttacaacatcgaagggcaggcctggcctcagtaggactatgccaagctctcttgcatctcttcacagagcacttacacgcgatacacagggcagcgcgagaggaggcgttttttatctcgagcctctatatactctctca

SEQ ID NO: 5866 - DNA, 198 bp, Homo sapiens
ttataacatacttctccagtaatcataactcatatgattaacctygattgctttaataaggaagtatagagatgacaattacaggtggctttttactaaaatatttaaaggaaatacaattaggccctaatttttcttaaaagaggtatatacaggtctcatacttgccttatttgatttttaataaatcatcttttt

SEQ ID NO: 5867 - DNA, 160 bp, Homo sapiens
cagcaatggccaagatcaaggctcgagatcttcgcgggaagaagaagggaggagctgctgaaacaacttggacgacctgaaggtggagctgtcccaactgcgcgtcgccaaaagtttacaagcggtgcgggcttcaagctctttaagatccgagtcgttc

SEQ ID NO: 5868 - DNA, 215 bp, Homo sapiens
gttttgagcaaggggaagggttgccagagtgctcgggggccccagaggagcaggagtctgggagggccagagttcaacctctagtggatccaggaggagcagcacccagcccttgagttgcccaatacccttccaagaggccacagtcccagccaggacaaagtatgtcgggccatctctggtacgacaactctgggacaaatgtgtagcatagg

SEQ ID NO: 5869 - DNA, 232 bp, Homo sapiens
cacaggtccagcccgtgaggggggggcagtgggtgggcaagatggggagcaggcacccccacttcccatcaaggctcccctcccatcttctagcacgtctcagcccccactactgtccctgaagccccagggcgacttttcctcaactgcccctgagccaatactatttctgagatagtgcaagccctgctaggcgcgcttgtgtcccagcgcgtggggcccaggacaatcc

SEQ ID NO: 5870 - DNA, 400 bp, Homo sapiens
ccgccacaatggtgcgcatgaactgtcctggcagtatggtctcagagtatcaacaatgccggaaaagagaggcaaacgcaggtgcttattaggtcgtgcttcaaagtaatcgtgcggatttctcactgtgatgatgaagcatggttacattggcgagtttgaaatcattgatgacacagagctagggaaattgttgtgaacctcacaggcaggctaaacacgtttcgggtgatcagcccaagatttaacgtgcactcaaagacctcgaaaattgcagactatctgctttaagtccagccagtttgcttcattgtactgacaactcagctggcatcatggaccatgtggagcaagacgaaacaaacaggagggaaaatcttgggctcttttctagggggta

SEQ ID NO: 5871 - DNA, 300 bp, Homo sapiens
ttgagatcttactgcttgtcacttgaatcccgtgattgtcatacatctctggtataagcaacatttgattttttgaaggttgtaggccctctcttcatatttttcaaggtgtaatttttacatttctgcatttttaaaacagtttggccataatcctagatgcacgcttctaattcatgtatcccccacatgtgtagctctgtgtacagagatttgcatgtttatatgtgtgtactcgtaactctctggagatatactgctcatatctgtggagtcaggggactctgtgataaccactat

SEQ ID NO: 5872 - DNA, 194 bp, Homo sapiens
gtttatgtaaaaatgaaggtggcaccgtggtgagacctaatgagaaatagttactcagttgtaaaaattttgatttattctctttcttctgacctcctttgcctcttggtcttgaaccatagcaaaaggatactgcatctttccaatacttgtaggcctgagggtattgaaggtatacaaacacatctcagttt

SEQ ID NO: 5873 - DNA, 141 bp, Homo sapiens
cgtgagctcagcctaccgctggccctaccgttacccctccttgggcttatgcaaatacaatcagcccagtgcaaacgaaagaaaaacaaatgcagatgaaagccctgccaaaggactacttcaaaaggggaaagggcactt

SEQ ID NO: 5874 - DNA, 235 bp, Homo sapiens
ctttgggtgctgtagaaaacaaaaaaagaaaaatatatattcataaaaaatatggtgctcattctcatccatccaggatgtactaaaacagtgtgtttaataaattgtaattattttgtgtacaggtctatactggtatctgttgtcaatttcaaaacttgcacgggtcctgaaattcatctgactctaattttatgggagattcagagctctgataggcaatatatatatgtat

SEQ ID NO: 5875 - DNA, 140 bp, Homo sapiens
ctcacattgcatgcaagtttgctgagctgaaggaaaagattgatcgccgttctggtaaaaagcttggaagatgggccctaaattcttgaagtcttggtgatgcttcccattgttgatattggttcctgggcaagcccatt

SEQ ID NO: 5876 - DNA, 193 bp, Homo sapiens
cacgagcatcacctccctgcgctctcgctcctgttttactctgcttctcttcttaaaaaacaaacagtaaaagattttattttctgatgatttttctgtccttatctatgaacggagaagggaggtaggatggatattgttccttttagtaaacggagtctgtgcccaacctgtgtgcatagggaactcactc

SEQ ID NO: 5877 - DNA, 248 bp, Homo sapiens
agcaaactgccctttgtcctcaaagaaattgttgaaaagaaactttttaaagagattttttgcatattctctgccttgttcttatcaacttgaaatgttgggcattttctaaccttgttttgttggctacaataattcaggattcaagtgcaaaattgaagaaggcccctaaatgaatgtgtgtgaatttgataccctgcacacatctcttatattgagagagataatatgttaccccacactgggga

SEQ ID NO: 5878 - DNA, 166 bp, Homo sapiens
gacataggaggccgagcaggaatcggtgtgacatagggcggtcttcttcttgtaaaacctgaacccagaacaacaaaatccgttgcaaacccaaaggacccaagtactttccaatttcagtcactcttagggctctgcactgaatggctcgacccgactcgatttc

SEQ ID NO: 5879 - DNA, 142 bp, Homo sapiens
caggattgcaagctcatgtgtggaggcctggggcagggcaccagttaacaggcacaggtcccagggcccaagggggaggtgggaccatcccagttcctaaaagttgcttcttctaccctatcccatcccctgtaacggattt

SEQ ID NO: 5880 - DNA, 200 bp, Homo sapiens
cccactgcaacattgccattgtcactggagattggtgggcattgagctattagccttccctccaccagcaccctgccccttttccaacaattcttccagttcaaaattggacatggggaacagcaaacttaccccttcccttggtggcacttccacctgtgtgtaatgtgtacaaaggggcaataaagagcctctgtgca

SEQ ID NO: 5881 - DNA, 111 bp, Homo sapiens
cgcgctgtgcctgctcgtgttgcctacaatgttccttgctgttagaggcgcttcttcagcttgcaaccctttccttgtcttataaggagctctccttttgacccctctcta

SEQ ID NO: 5882 - DNA, 105 bp, Homo sapiens
gtcaaggcaaagatcccagacaagggaggcattccttcttatcagcagaggttgatcttttcttgggaaacaaacttgaagagttgagccgccccctttttagtt

SEQ ID NO: 5883 - DNA, 146 bp, Homo sapiens
ctcttccctgttaaccagttctgtcagcatccccctctacagcagcacttacatggagttgggtcttgagacttttgccgttaacacaccgctttcttcagtgtattttgttttttgggcttttttggtttaaaaaccccagaggt

SEQ ID NO: 5884 - DNA, 156 bp, Homo sapiens
agaagcgagattgcgaagggaaccgtcatcggttgggaaagcgtcgcaataaagacgcacacggtgttcccggcgggttttggcttttagggccttaccccacttcagagaggtgggcccctttgcamaatttgtggttttcctttcaaaggccca

SEQ ID NO: 5885 - DNA, 108 bp, Homo sapiens
ctcgtgcgaaattcggcacgagggtcgactgctatgttgtgttttgcagaacaggcttctcttggtatttgccttacttaattaaaaagcaagggctgttattacctt

SEQ ID NO: 5886 - DNA, 136 bp, Homo sapiens
cgccgcttgtgctgcagccatgtctctagtgatccctgaaaagttccagcatattttgcgaggacttaacaccaacatcgatgggcggcgggaaatagcccttgccattacttcccttaagggggtggggccccag

SEQ ID NO: 5887 - DNA, 141 bp, Homo sapiens
cacatgcctatcatatagtaaaacccagcccatgacccctaacaggggccctctcagcccttctaattaccttccggcctagccattgttattttacttttcacttcataaacggttctctatacttgggctttcttacca

SEQ ID NO: 5888 - DNA, 134 bp, Homo sapiens
ctttgtggtgcgggacgcccttgggaccgccagcagcagtgagaggctcctacatgagcagctctgaggaatttcccagctttggggctcaggtggctccaagaccctcccttggggccccaaacgttaatgtt

SEQ ID NO: 5889 - DNA, 135 bp, Homo sapiens
ctggagttggcaccctgcagcagttatgatccagatctatgttctgtgacggtcgtagacaagccaatttatttgcttaatctgtgaaaccacggatcaatccctccaaaacccgttgaaaaaaggataaattct

SEQ ID NO: 5890 - DNA, 145 bp, Homo sapiens
gcgagctgagccctggccgccgccacaatgggccgcgagttttggaatcttacgcggatgcggcatgtgatcagctacaacttgtcacccttcgagcagcgcgccctattcccacggcttcactaaaggaatcccccaatgttct

SEQ ID NO: 5891 - DNA, 105 bp, Homo sapiens
ccatgatccaatcaccttctaccagaccccacctccagcactgggaattacatttcaacatgagatttagggtggggacacggatcccaaccatagcactattta

SEQ ID NO: 5892 - DNA, 109 bp, Homo sapiens
tgaatcactcactcacagcacttacccagtgagcatgcaccaggacaaccacggctacatcttccttcttatttaggggggccacaaaagaaaggttcttgggtgggga

SEQ ID NO: 5893 - DNA, 130 bp, Homo sapiens
tgcgtgtatcggaaacaacgtgcccggctcgtgcggacggttcttcgggctaccagaagtgggaggcaccgaaagcccccagtaatcgcgtacacgtggyccggccatctcatggcctcggggggtccag

SEQ ID NO: 5894 - DNA, 263 bp, Homo sapiens
ctttagaaaaatggatgcccagaggactcccaaccctggcttggggtcaaagaaacagccagcaagagttaggggccttagggcactgggctgttgttccattgaggccgactctggccctggcccttacttgcttctctagctctctaggcctctccagtttgcacctgtccccaccctccactcagctgtcctgcagcaaacactccaccctccaccttccattttccccactactgcagcacctccaggccttttgcata

SEQ ID NO: 5895 - DNA, 155 bp, Homo sapiens
tctcacattggacatactcaaaattcacttataatcttcacaccaccaaaaacttacccatatcaaattataaacccacccacattacttaaaattttttacatttcccaataaaaaacccaaataaacaaaaacttccaatctccatttaaaat

SEQ ID NO: 5896 - DNA, 195 bp, Homo sapiens
gtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatcccaagatcggatcattacccttacagggacac

SEQ ID NO: 5897 - DNA, 184 bp, Homo sapiens
cactcttccattgtcttgatgaatagcattctagattccttctagacatactaatcaacccaaactttcattggtaacacccttggcgttttatcataaacacatttctctttctttaccaattggccagtctgagaatttgtcaaatccttaattttagcttcccttttgatgacaaattctg

SEQ ID NO: 5898 - DNA, 219 bp, Homo sapiens
cttgtgccgaattcggcacgaaggaagatcctggtgtcgccatgggccgccgcccgcccgttgttaccggtattgtaagaacaagccgtacccaaagtctcgcttctgccgaggtgtccctgatgccaaggttcgcattttttgaccttgggcggaaaaaggcaaaagtggatgagtttccccttttgttgccaaatagggtcagatgaatatatagca

SEQ ID NO: 5899 - DNA, 145 bp, Homo sapiens
ctaatgctgttactaacttttcagttataaattgatgaatatctttgtgcacaggctgtttcccaatgtcaagttattagggtagactccaggaggttggattcttcaactaaagaatatgaaaacctttgaggcttttactaca

SEQ ID NO: 5900 - DNA, 230 bp, Homo sapiens
ggttcctgctgccctcaaggtcgtgcgtctgaagctacaagaaagtttgcctatctggggcgcctggctcacgaggttggcttgaagtaccaagcagtcacagccaccctggaggagaagaggaaagagaaagccaagagtcccctacccggaggaggaacagctcatgaggctacggacacaggccgagaagagcgtggagaagagaatttacacatacacagagggac

SEQ ID NO: 5901 - DNA, 154 bp, Homo sapiens
ttaatctattaatcaataattactcttacatacattcgcataattctgtataagtctgaattcagtgaaaatctcgtaacacaaaagggtttcttttgacaataacatttagattatctctggaagatgctatttaaggcacattgagtatact

SEQ ID NO: 5902 - DNA, 163 bp, Homo sapiens
cctcacgtgagggcattgcccggaagatcaaggcgtgcgccttgcagcgcgccccttgaaggattaaggccactgctgggccaattccgggggggcgtgcccttactatcccttgaaagaagcaaaactcaattatttgaagggtaaatcccattgggccctt

SEQ ID NO: 5903 - DNA, 250 bp, Homo sapiens
cttgaatcctttcaaagagtggagcttctgaagaaagaaatcgataagttcaaagacaaaaaagaggtagcaattgtggtattaggaaacaaaatcgacctttctgagcagagacaagtggatgctgaagtggcacaacagttggcaaaaagtgagaaagtaagactgtgggaggtgactgttacagatcggaaaactctgattgaaccattcactttattagccagtaaactttcttaacccagagcaa

SEQ ID NO: 5904 - DNA, 300 bp, Homo sapiens
atcgtgtgctgcctggaggagaagcctggagaccgtggcaagctggcccgggcatcagggaactatgccaccgttatctcccacaaccctgagaccaagaagacccgtgktgaagctgccctccggctccaagaaggttatctcctcagccaacagagctgtggttggtgtggtggcttggaggtggccgaattgacaaacccatcttgaaggctggccgggcgtaccacaaatataaggcaaagaggactcctggccacgagtacggggtgtggccatgaattcctgttgagcatcctc

SEQ ID NO: 5905 - DNA, 276 bp, Homo sapiens
gtccctcaccttgccagagcctgtgttaatttccgagaccagcctgagtgccaagattgcctgtgtgctcctctcccagagctgcctgttcgaggagccagacctgacccagcgttgctgggaggtgattgatgcccagagctgagttagctctcaagtctgagggattctgtcgatattgacttccagcacactagaaaggtgattctccgtggggaaactctgtaatgccaaagaaaattgtggtttttgaggcagctctcaactgggctcagh

SEQ ID NO: 5906 - DNA, 295 bp, Homo sapiens
agatgcccagattacctgcagggtctgcgctaccaggaagcccctgatttgttttgaaatccacacttggccgggcgtggtggctcatacctgtaatcccagcactttgggaggccgaggcgggcggatcacaacgtcaggagatcgagaccattcctggctaacattggtgaaaccctgttctttacttaaaaatacaaaaattaggccgggcgtagttgcattcgcctgttaggtccagctacttgggaggcttaggcaggagaatctgctcttaaccttgggagcggaggtt

SEQ ID NO: 5907 - DNA, 250 bp, Homo sapiens
agtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacagggttaaaaatatatatacagttatatgaaatgtttatttctatgtgtgtgcatatagtccattataggcataaatttggtgttttactt

SEQ ID NO: 5908 - DNA, 217 bp, Homo sapiens
tgaggtcaggagttcgataacagcctgatcaatatggtgaaaccccgtctctactaaaaatacaaaaattagctgggtgttgtggtgtgcacctgtagtcccagctacttgggatgttgagacaggagaattgcttgaatctgggcggcataggttgcaatgagctgagatcgtgtcattgcactccagcctgggtgacggagtgaggctgtgtctc

SEQ ID NO: 5909 - DNA, 285 bp, Homo sapiens
ctgacatagagttggatctgtagcggtcctttggagagtgtgtgtggcgggagagtgaaaccttgggggaaaatgctaggagattcttttttctttttgttctacttttcgttcggaaagtttttaaatcctcatttggtgcatctgtattccagccaataggtgtgccagttttcatagtaatctttactggcccaacttggggagtgggggaaattgcttaaaaaaaaaagagaaagagaaaaaaaaagattattctaaataaagggagaaggggcttacact

SEQ ID NO: 5910 - DNA, 430 bp, Homo sapiens
cttatttttgaaggcagagcagaggatcttctgatggtatcagggaggtatgagagagaaaggtcaaaaaattgacttccaattttttcyttttccttttttctttttttgtttttttttaacccccgggccacctttaaaggtttgggttttcctttttttcccggggaaggtaaatttttytagggttttttattaaaaataatcttaaaatctaatcccacccccacatttgggggaaagttggcaaaaggcaagggtggaaacaaaacttttcttttttaaaggcccttttcaacaaattggcagcccctttttttggggcaattatccttttaagaagggtttgcatgttcttagccaaattcttaccctttttcaattattttcgggttaaccccaaccacttggcttgacggtttttttttcc

SEQ ID NO: 5911 - DNA, 143 bp, Homo sapiens
ggaaggtactttcttgaggagcgggccgcgggcccaatctcgattttttacaccccgggtgggggtaaccaaggtaaagtgtacccaatttcgcccctaataagtgaagtccataaaaacaaaacaaccaggaaaatagaaaa

SEQ ID NO: 5912 - DNA, 258 bp, Homo sapiens
cagacctcttgctgcccagcccagggtgggtggggcgcacacctgtctttgtgcatgcaaatctgatacacctggcgcatcctctggagagcacaacgcatggtaaggtctggaagctctgtgtagccattccttctgcagtcatcctacccaagtaaaagtaaccttggctatgttaccaccgttttggtcacccaggaggacatcttagcaagggtgcctccgagggagtgtgggacttggcctcatcctcgccgg

SEQ ID NO: 5913 - DNA, 262 bp, Homo sapiens
cggcatcccaccgccctacgacaagaaaaagcggatggtggttcctgctgccctcaaggtcgtgcgtctgaagcctacaagaaagtttgcctatcttggggcgcctggctcacgaggttggctggaagtaccacgcagtgacagccaccctcgaggagaagaggaaagagaaagccaagatccactaccggaagaagagacagctcatgaggctacggaaacaggccgagaagaacgtggagaagaaaattgacatatacac

SEQ ID NO: 5914 - DNA, 126 bp, Homo sapiens
tgaacgctacgcttacaaatattgtctctgtgctgctggtgtgacaaacgcaatgcaaaaacaatcctctttctctctcttgatgcatgatacaacataataatgggagttgcatcttgtgaatga

SEQ ID NO: 5915 - DNA, 141 bp, Homo sapiens
tgggagtacacagatatccacgttacagatatctaagatatatttatgtacagcaccactctgaaataatggtattattatgagatccaccccctgggctctgttattctttatatatgttatataagagaggacacatct

SEQ ID NO: 5916 - DNA, 292 bp, Homo sapiens
gttggggtggctggttctggggctgggattggacctgtgtttgggagcctcatcattggatatgccaggaccccttctctgaggcacacasctcttctcctacgccattctgggctttcctcctcgagaggccatggggctctcttgtctaatggtggcctctctacatcctctttcccatgtaagggagccgtctccacctccaatagttctcccgcgtctggttggcccgtgtgttcctcttcctatacctccacagacagccgtgggaaccgtggttggctaaggtttg

SEQ ID NO: 5917 - DNA, 181 bp, Homo sapiens
attttaaaattgattagcatcatatatcatctatcccattagagtatgcagatatttgccacagtgtctctctcagatcagcatatgtctctgccagcctcatttcatctcctccatggtccgcagagctttgttctggcagaagagaataaatgtacctctctgataatggagatgttaa

SEQ ID NO: 5918 - DNA, 156 bp, Homo sapiens
gtcgccagaggtggccgagagagcctgccgcatgatgattggcatgaggctaagtggccagcagagattaaccgttcgatttgatagagccgctaaaggacggttgcctctttaaaaacatcgatacgagaccctctgatttttgatattttttct

SEQ ID NO: 5919 - DNA, 220 bp, Homo sapiens
gtcgcmtggttgggcggtgctggttttcgctcgtcgactgcggctcttcctcgggcagcggaaggccgcggccggtcggagaagtggcctaaaacttcggcgttgggtgaaagaaaatagcccgcacccaagcagactgctcgtaagtccaccggtgggaaagcccccgcaaacaactggccacgaaagccgccagaaaaagctgctccctctaccgccg

SEQ ID NO: 5920 - DNA, 242 bp, Homo sapiens
cggcacgagaacaagctccatctgtcctacgacaaacagacctaaaatcgctcattgcatactcttcaatcagccacatagccctcgtagtaacagccattctcatccaaaccccctgaggcttcaccgccgcagtcattctcataatcgccccacggaccttacatcctcattactattctgcctagcaactcaactagacgcactcacagtcgcatcataatcctctctcagggcctcca

SEQ ID NO: 5921 - DNA, 186 bp, Homo sapiens
gtctcttcggaccaagggcccgcctcgagacattggcttcaaaggcatccaggccctcgggccaccctgcttgatgggaaaggaaggcatcgtcgggccctcggatcctgggacctccggactccggtccgaggtgacaaagcagcgtgggtctgggattacaaggtccgagggtctccgccccaa

SEQ ID NO: 5922 - DNA, 159 bp, Homo sapiens
gtggacgcctgtagtcccagctactcgggaggctgaggcaggagaatggcatgaacccaggaggtggagctttcagttgagccgaagccaagatcgaccactgcaactcaagcctgggcgacagagcgagactgcgtctaaaaaaaaaaaaaaaaaaaa

SEQ ID NO: 5923 - DNA, 200 bp, Homo sapiens
aagagcccaccgccgattcgtgaccaagaaggctctgtgcattcgggttttccaggagactcaaaagctgaagaagcgaagaagagccttaaaggctgcagcagcacccaaaaaacaagcaaagcggaggaacccagacagccctgccaaagccataccaagacactcaagacagccataattctgttcaatcatacaaa

SEQ ID NO: 5924 - DNA, 215 bp, Homo sapiens
ccagtgtgttgctgggtcccctcccagctgagctgtgactgctgagtactggaaggaggttgccagggtctctgctacctttgtctgcatccctcccttgctccctgctgggtggtcctcacccaggcctccaatgtggttggccctggggactcattacttctggtagctggctttctataaaaatgggtcaaacccaaaaaaaaaaaaaaaaa

SEQ ID NO: 5925 - DNA, 319 bp, Homo sapiens
ggcacgagcgccgccgcccgcccatcatggacaccagccgtgtgcagcctatcaagctggccagggtcaccaaggtcctgggcaggaccggttctcagggacagtgcacgcaggtcgccgttggaattcatggacgacacgagccgatccatcatccgcaatgtaaaaggccccgtgcgcgagggcgacgtgctcacccttttggagtcagagcgagagcccggagttgcgctgacttggcttctcgctgggtcttggatgtcgggttcgccacttggccgatggaatggtctttcacagctgctcctttttttgtccg

SEQ ID NO: 5926 - DNA, 255 bp, Homo sapiens
tccctcttcactccccctaaacccctgtcccatgcaggccctttgaagcctcagctacccactatccttcgtgaacatcccctcccatcattacccttccctgcactaaagccagcctgaccttccttcctgttcccgagctgtccccgtgttgcatgaaggagcagcattgactggtttacaggccctgctcctgcagcatggtccctgccttaggcctacctgatggagtaaagcctcacacaaaaaaaaaaa

SEQ ID NO: 5927 - DNA, 280 bp, Homo sapiens
agcccgtgggtgcctgggccttctacatgatgacagcagggtcagggcagggcacgggaatgaggggtgggcacagataactgaatgccccgagagcctttctttcctttagtctgccacagttggggtgggcgattaaaggaaagaaccctgaaaagtatataagctttgacaaccaggagatttggcttcaaatcctgcttctacaacttcttagctgtggcctttggcaattttatccaccccctgattgcccacttcctcaaccttaaattgcttt

SEQ ID NO: 5928 - DNA, 250 bp, Homo sapiens
gctggaggcaaagctggaaaggacagtgggaaggccaaggctaaggcagtatctcgctcacagagagctgggctacagtttcctgtggccgcatccacagacacttgaagactcgcaccacaagccatggaagggtgggtgccactgctgccgtgtacagtgctgcgattctggagtacctcactgcagaggtgctggagctggcaggtaattcttctaaggatctctaaggtaaagcgtattcaatccg

SEQ ID NO: 5929 - DNA, 240 bp, Homo sapiens
aggactccttcctccctggtgaagtgcccttgcagctccctagtgtccacgccatggatatttcctccacagaagtacaatgctgattatgatctgtcagctcggcaaggggcagacaccctggccttcatgtctctcctggaggagaagttgctcccggtgctggtacatactttttggatagacaccaagactacggggaggtacccgaagtgattcaagggttttccttttccctaa

SEQ ID NO: 5930 - DNA, 200 bp, Homo sapiens
gttaactccatgcatgttgtgaacagacccccggaactttctcatcttgtaattctgaagttctatacccaccgaacaactcctcttttccccttccccctgcctgccccagctcttggcaccattattctgctttctgttttcgaggagctgactacttaaggtacctcatacaaggggggtcttgggttacaattctt

SEQ ID NO: 5931 - DNA, 142 bp, Homo sapiens
cttccactgagggaagtttaaaacccaaacttccaaaggtttaaactacctcaaaacacttttccatgagtgtgattcacattgttagggtctgacctaggacagagatgaacttagggtcctgttttggtttggtcattat

SEQ ID NO: 5932 - DNA, 145 bp, Homo sapiens
gatgcttccatcccagcttctccggaatggaaacgtgaatcagaatcaactgctgcagaccaggaggtatgtgaggagggctggaacaagtaaccagggccactgttaaccgcaacttccggaaccggagaacctggttggaatg

SEQ ID NO: 5933 - DNA, 148 bp, Homo sapiens
gcagtgtggttcaagtttctttgaccgcactctatatgcattgctaatatgggagtttaagataccatacacagtctctcatggacctatctctattgtaggattatgacttatgtcttacttgggaaatttttctgaatgtgaccct

SEQ ID NO: 5934 - DNA, 140 bp, Homo sapiens
ctcaactatgggggagggccccaaagctcatattcgtaagctggctgagtgcatccgctggtcgtacggggccgggattgttctcaggctttgcaacatcgctcggtttggacttaattacttcgttcccattggatgta

SEQ ID NO: 5935 - DNA, 211 bp, Homo sapiens
tctgaagccctggaggctgcccgaatttgtgccaataagtacatggtaaaaagttgtggcaaagatggcttccatattccgggtgcggcttcaaccctttcacgttattcggatcaacaagatgtgtgtgtccgtgtctctgggctgtacaggctctcacaacagggcatgtcgcgggtgtctctttgagaagagcccaaggcactctgtg

SEQ ID NO: 5936 - DNA, 210 bp, Homo sapiens
gaaactatcaatgctggcagccagtttgaatataatgtagaaggagtgacttccaagggaatggctacccaacttgccttcatgcggcttcttggcaactattgctcttaggacatcaactaccactgcaaggacagcattgcatacatatgatgatgagactctgcaacctctaaaaagggctcgtcatatctacacaggctctctatg

SEQ ID NO: 5937 - DNA, 143 bp, Homo sapiens
gaggacttaaaagcagaaggaaaccgagatgcttcccgcagccgtggacgattcttcaggactctttttttaccttgagcacttgccttgtgaggcttcataggacagttgtttactgttccccccttcttaacttctctaat

SEQ ID NO: 5938 - DNA, 176 bp, Homo sapiens
ctcacttacacatatgaccacctgggagactcccccaaaattcttcaagacattgcttcgggaaggcatccatttagccaggtcctaaaggaagctaaaaaaccaatggttggtttaggcagttcttcacttcaaagagattatggagcagcaattcttgcagctcttttctagca

SEQ ID NO: 5939 - DNA, 222 bp, Homo sapiens
ccaacgtgcagcggctgaaggagtaccgctccaaactcatcctcttccccaggaagccctcggcccccaagaagggagacagttctgctgaaggactgaaactggccacccagctgaccggaccggtcatgcccgtccggaacgtctataagaaggagagaagctcgagtcatcactgaggaagagaagagtttcaaagccttcgctagtctccgtataggc

SEQ ID NO: 5940 - DNA, 150 bp, Homo sapiens
tgcctggttcacttggggctatcttggggactagatagtaaggccacctttacaaggcccagataaccattcccatctgggggttagggttttttggttaatggtttttcaatgtccaatggggagaagggagtaaaagatccctttttt

SEQ ID NO: 5941 - DNA, 410 bp, Homo sapiens
atttgatggcgtgatgtctcacagaaagttctccgctcccagacatgggtccctcggcttcctgcctcggaggcgcagagcaggcatcgtgggaggtgaggagcttcctagggatgacccatccaagccggtccacctcacagcctccctgggatacagggctggcatgtctcacatcgtgcgggaagtcgacaggccgggatccaaggtgaacacgaaggaggtggtggagcctgtcaccattgtagagacaccacccatggtggttgtgggcatagtgggctacgtggaaacccctcgaggcctccggaccttcaagcctgtctttgctgagcacatcagtgatgaatgcaagaggcgtttctataagaattggcataaatctaagaagaaggcctttaccaagtact

SEQ ID NO: 5942 - DNA, 405 bp, Homo sapiens
cgccgctccggctgcaccgcgctcgctccgagtttcaggctcgtgctaggctagcgccgtcgtcgtctcctttcagtcgccatcatgattatctaccgggacctcataagccacgatgagatgttttccgacatctacaggatccgggagatcgcggacgggttgtgcctggaggtggaggggaagatggtcagtaggacaaacggtaacattgatgactcgctcattggtggagatgcctccgctgaagggcccgagggcgaaggtaccgaaagcacagtaatcactggtgtcgatattgtcatgaaccatcacctgcaggaaacaagttacacaaaagaggcctacaggaggtacatcaaagattacatgaaatcaatcaaagggaaacttgagaacagagac

SEQ ID NO: 5943 - DNA, 112 bp, Homo sapiens
tctcaatcctaatttctcctccctttctttttcccttgcttcaggaaactccacatctgcctaaaaaccaaaggagggcttcctcttggaggccaaggggaaaggggggtgc

SEQ ID NO: 5944 - DNA, 135 bp, Homo sapiens
ctgactttggacaaggcccttcagccagaaagactgacaaagtcattccccgtcttcccagagcgtgcaattgtgatccctaaataaggtttaatttccggtttttccccctttggggttggaggggccaaggtt

SEQ ID NO: 5945 - DNA, 136 bp, Homo sapiens
agatgccaccgccgcaatcctcatattatatgagaagagccacgagcctccccaatgccaagataataacaattgcaaataggcggttccggtttccgaggccgccttttccacccttccttcctgggaaatggaa

SEQ ID NO: 5946 - DNA, 293 bp, Homo sapiens
tcacgcagcatggttaacgtactaaaaccgacggactttctgtaagaggtgtgacaggcaacaaccccgtaaagtgcacacagtacaggaggggacaggggttctactgttacgcaacagggaaggacggacgttgatgtacaggaaggacagagtggtttatggttgggacaaactaagaaccgtttttacggaaaaggggactaaaactaacaaggagggtttgttgactagggactttgttactttggaaccagactacgcgtctggggagtactgacttttaaggtgta

SEQ ID NO: 5947 - DNA, 295 bp, Homo sapiens
gccattggggcccaggggacaccggggatctgcgacacctcagcctgccaaggagccgtgttaggaggggtcggggagaaatcaggctctcgaagctcataaaattcaacgtgaggaagcaagttacaaggacgcccgaagcacagtggacggtcatgaaggagccgggggtgtcgcaggcgggtcacgtccaggagagggagcgcccttgctgcccctcggccgccgacttggacgcgcgggccttgccagcgagcaccctcatcgggctttcgctgacagcatacctcaaagg

SEQ ID NO: 5948 - DNA, 293 bp, Homo sapiens
tcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactttcattgttcagattcctgaacaggagttgggataatggccatcttttctttcctatccttcccccctcactgtgaaaaataacagtccacccaagtcatacactggaccagtgcctgcggggacaggactctgggtttcttggtca

SEQ ID NO: 5949 - DNA, 298 bp, Homo sapiens
aagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtagtctgtagacttgattacctgggagatg

SEQ ID NO: 5950 - DNA, 296 bp, Homo sapiens
ctcgtccaaatttcggccacgaaaaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgatataatgtagaggagttacttcc

SEQ ID NO: 5951 - DNA, 246 bp, Homo sapiens
aggacaccagaccccataatggaaaaaggaaactagagcatggcattataaaaatacacagcattacccctgcacagtttgcaaaattggacttattactccagagtatttcggttagacccaaatagaacatattgaaccgattttcaaggttgaaaatactgtacattcattcatctttgcaaatttgaccaccctgactgctgctgatggccaatgggctttccttttcctaggaacaggagg

SEQ ID NO: 5952 - DNA, 203 bp, Homo sapiens
ctcagtttgaacattgaccctgatgcaaaggtggaggaagagcccgaagaaagaacctgaagagacagcagaagacacaacagaagacacagagcaagacgaagatgaagaaattggatgtgggacagatgagaagaagaaacagcacaggaatttcagcttaaaagatgatttgtaattatctttaccctttgatctttatg

SEQ ID NO: 5953 - DNA, 117 bp, Homo sapiens
cacactcagattagccatatatgcctactgtccatggtcgttccccacttcaaggacacccaccaaaggattttcgttagtataatataccgattcctgacggatttttggaggtgg

SEQ ID NO: 5954 - DNA, 325 bp, Homo sapiens
aagactgttatcgagtaccggtcacagaagacctcacgcctccccatcattgacattgcacccatggacataggagggcccgagcaggaattcggtgtggacatagggccgctctgcttcttgtaaaaacctgacccagacacaacacaatccgttgcaaacccaaaggacccaggtactttccactctcagtcactctagggctctgcactgattggctgacctgacctgatgtcattcatccaccctctcaacagtgcggactctctccctctctttctagagacctgacctgggcagactgcaaaataaaatctcggtgtct

SEQ ID NO: 5955 - DNA, 321 bp, Homo sapiens
ctcgtcaatttcggcaggggggagtatgagttaagaaaaaacaacttctcagatactggaaactttggttttgggatccaggacacatcgatctgggtatcaaatatgacccaagcattggtatctacggcctcggacttctatgtggtgctgggagggcacggttcagcaatcgcagacaaggagcgcagacagctgcattgggccaaacaacagattcagcaaagaggaggccatgcgctggttccagcagaagtatgatgggatcatccttcctggcaaataaattccgtttctatccaacagagcaataaaaggttt

SEQ ID NO: 5956 - DNA, 142 bp, Homo sapiens
ctcgtccatttcggcggggcattatactatagttgctagttggcaatttcaggaaaggagatgttaaactctgcaagcaagggaggtagagcaaaagcaatgagtatgcatttaaaaggctgtatcgtaggagcagccaagc

SEQ ID NO: 5957 - DNA, 215 bp, Homo sapiens
aaagtatactgtgatttctctactggcgaaacctgtatccgggcccaacctgaaaacatcccagccaagaactggtataggagctccaaggacaagaaacacgtcttgctaggagaaactatcaatgcttgcagccagtttgaatataatgtagaaggagttacttccaaggaaattgctacccaacttgccttcattcggccttcttgccaact

SEQ ID NO: 5958 - DNA, 229 bp, Homo sapiens
gggcatttctgtggatccgaggaggcggaacaagtccacggagtccctgcaggccaacgtgcagcggcttaaggagtacccgttcaaacttattctcttccccaggaaggccttggcccccaagaagggagacaattcttctgaaggactgtaaacttggccaaccagactgtaaccggacccgttcaaatcccctcccggaagctctatataagaaggggagaagagt

SEQ ID NO: 5959 - DNA, 245 bp, Homo sapiens
  misc_feature 65: n = A,T,C or G
aagaagctctcctacatccgcattgctgataccaatatcaacagcatttctcaaggtcttctctnccttccttacggaattacatcttgatggccacaaaatcagcagaggttgtatgtcagactagagcctgtaaaggatctttaaatatattttggctaagatttgggattgagattttcaacagacatctctgtctgtttgcacaatgggctctctggcccacacacgcgctcatctgtagg

SEQ ID NO: 5960 - DNA, 260 bp, Homo sapiens
tctcactcatatgtgacagctgagaatcttgatctcacagaggtagaaagtagaatgatagttactagaggctgacaaaggtaggaaggagggatgatgaagaggaggcttgttagccgttgcaaaaatacagttagaaagaataagttctagtgttttgatggcatatgtagagtgaccatagttaacagtgaatttgttgtatatatcacaacagctagaagataagatttgtgaatatatcccaacccaaagagaat

SEQ ID NO: 5961 - DNA, 150 bp, Homo sapiens
ctgctgccctcaaggtcgtgcgtctgtaagtctacaagagagtgtgtctatctcgggcggcttgctcacggagtttcgcttggaagtacccagcagttacaaccacccttgaagagaagagaggaagagaaagccaagatccactaccgg

SEQ ID NO: 5962 - DNA, 140 bp, Homo sapiens
  misc_feature 140: n = A,T,C or G
acaagttgaaccttcacagcaaccctgtctggtgggcgccactccacccattttatagatgggaagacccaggcaaggagaagtaactcaacactagtcccttgagccagtaggtgtgtaaaattgagatgttgccccan

SEQ ID NO: 5963 - DNA, 323 bp, Homo sapiens
cggcacgagagaaattttgcctgccattttcagaatcatcttttgaagctttctgttgatgttaactgagctactagagatattcttatttcactaaatgtaaaatttggagtaaatatatatgtcaatatttagtaaagcttctctctttttaatttcccggagaaaataaaaagagtatgagtctctctgtaattcatatgagcagattagctcatttgagataaagtcacatgccacacactcagctctgtattaatccccatcaattactcggtaaagcctcatttgtaatgtgttgaatcaatacagggctatgtaaa

SEQ ID NO: 5964 - DNA, 271 bp, Homo sapiens
  misc_feature 261: n = A,T,C or G
catatcagaaaagaagggaaatggctttcaattcctttatattgtatcctatacttagtaatgttatttaactacctgattaccctattctaggctgtttgtactgatggcaagctcttcaaccacttagagactatttggcgatacagaccctggtgattcctgcctcatcctcgaacctgcactgtggacttttcgatttcctttgaaattcgttctctgctgcactcccagctggccaccatgtttttttatgaggtngtcaaacaga

SEQ ID NO: 5965 - DNA, 145 bp, Homo sapiens
aggtgcagtgggtacaggaagagatcccttgcagacttagctgggatgtcgttgctggcaattgtcttagcatttccaggctggtaacttgaacctcttattttgtaggcctgggtattcgtgaggcgggaggttaggaccaggg

SEQ ID NO: 5966 - DNA, 217 bp, Homo sapiens
cagacatcgaagccgttctgattggccgaggacaggatggggcaggacagggtagctgttttggcccagcccagaaattcctcctctccctaaccagaaggggaggaggaggaattggccaatagctcttgttgttccgaggttttccccagcctgtccctgtgggctcaatgccccttggcgttggggctttttgtcccttgcaaggggcttgggc

SEQ ID NO: 5967 - DNA, 145 bp, Homo sapiens
gggggtgtgtacccacgagagaacccccgcatcctgtttttcctgagcaaccagagaaaccatttgaaccttgcaacaatattagttcctcctcgccctctgtactaatatgaatgacaaccatggtttagaccacagtgttcct

SEQ ID NO: 5968 - DNA, 270 bp, Homo sapiens
gctgggagaaactggcaaggagaagctcccgcggtactacaagaacatcggtctgggctttcaagacacccaaggaggctatttgagggcacctacatttgacaagaaattgcccctttcacttggtaattgttgtccatttcgagggcggattcctctcttggcgttggtgacccacggattgaaggattgcagagggaccatttgttattccgccgagactattctgcactacatacgcaagtacacacgctttgagaggcgccacaa

SEQ ID NO: 5969 - DNA, 230 bp, Homo sapiens
caagctagaagaagaacacatggtgatagtcatcgtcagagacactgcctagcccaagcctgtctttcccagcgtaatgtttgtgtcacaaaggcagttattttaaaatctgatcccctcttttaccctaccactttggtttgaattatctcctggggttattttggttaatttgggtggggatcaaagtgctcttccaccaccaaaactaaggttcttaggatttttgg

SEQ ID NO: 5970 - DNA, 136 bp, Homo sapiens
gcacctctggtcccggctactgggaggctgaggtgggaggattgtttgagccaggaggtggaggctttagtgagtcatgatcatgccattgcattccagcgtggctgacagagtgaagcttaatacatacttaaaa

SEQ ID NO: 5971 - DNA, 145 bp, Homo sapiens
ctttcttaaatatttcatttatgacctgcaaattcaagaataaaggcactgaagtaagtttgaagccctaccagttgttttccagtcttttcagattggatgcctactgtggagattaactttggcatattccagtgtccagctt

SEQ ID NO: 5972 - DNA, 191 bp, Homo sapiens
tgacaagtaaagacttttataatacctaccttcaaaattagaatcagcagcactgtacaaataaagtgcctgtgcttcacctccacaccaaggaatcttgcctaaccctgtccagagtgcctaatatcctgtggtgattatgtataatgaaacagtcttattttgtgctctttggtttcttaaaagggaag

SEQ ID NO: 5973 - DNA, 110 bp, Homo sapiens
cggagagccttcaagcattccattacgccccatctcgctctgtgccccttcccaccagggctttagcaggagccctggacttattattaataaaacacctttttcagcaa

SEQ ID NO: 5974 - DNA, 178 bp, Homo sapiens
cttaatatttgcatgataagctagtttattgggttagtattcttgttggttacggaatggatcaactaattcctgggttatctaaccaccgagggctagaagcgcgcgcgaaagaggtcctgggtacacagagccatgagccacccattttataagacactctgtatttctaaaagtt

SEQ ID NO: 5975 - DNA, 255 bp, Homo sapiens
ctctctcttcgccgccgacgcagaaagaaactggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagagtatgatggggagatggtacccagaccgggtcacacagcagcttttctaagtcacactaaagatcgagg

SEQ ID NO: 5976 - DNA, 125 bp, Homo sapiens
caagatccaaatatatacaagaaactcacctcacctgtaaggacacacataaacttaaaagtgaaattcatagaggaggatacacatggaattggaacctgaaaaggagctggattggctatgct

SEQ ID NO: 5977 - DNA, 193 bp, Homo sapiens
gcaaactagagggtgggatgaagggtgctgtcccaggcttcttctgggcttatcttaccacatcttatgagaggagttgggaccatgtattattagtttccagttaactgtactgttaaggcaaatgtctgaagattctgtgcttcgttttgggagttggacttgaaatattagagtaggcattatcaaaggt

SEQ ID NO: 5978 - DNA, 320 bp, Homo sapiens
tgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtaaccatgagaagtatgacaccagcctcaggatcatcagcaatgcctcctccaccaccaacttcttagcaccctggccaaggtcatccatacactttggttt

SEQ ID NO: 5979 - DNA, 296 bp, Homo sapiens
ctggcaatttggagaacctagaatgtcagcgtttacatacgacgtagctttcctacaatacagcctctaacaaaactaggctgtccgaacccctggtaatagaattgtttacctttataccaggaaggttgggaaagcaccaaaatctgcatgtggtgtgtgcccaggcagacttcgaggggttcgtgctgtaagacctaaagttcttatgagattgtccaaacaaagaaacatgtcagcagggcctttggtggtccatgtgtctaatagttttcgtgacagatcaagcgtgcttt

SEQ ID NO: 5980 - DNA, 227 bp, Homo sapiens
gtcatacttcttccagctcgatagcatagcatctgaatgggttggacttccacctttgccttcagccaggtgtctcttcggtctgggagaggtggatgataaaatctatgtagttgcaggcaaagaccttcaaacagaggcttcgctggattcagtattatgctatgatcctgtggctgcaaaatggaacgaggtaaaaaaactccctatcaaagtctatggccata

SEQ ID NO: 5981 - DNA, 105 bp, Homo sapiens
tatttctcctctaatccaagacctagattaaagtcaggacactttgacatatcactctgaacatgagaggattgccaacacaaaaggcaccccaggaggaaagag

SEQ ID NO: 5982 - DNA, 135 bp, Homo sapiens
ttggctgccttgtgaaatgattccctgcagtaaacggacttttcattttattttagatcattacaaactttccatttcacattcttccattgatttaccagaacaaccactgggggatattgtaggacttaggtt

SEQ ID NO: 5983 - DNA, 230 bp, Homo sapiens
ttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaagggctcaacccagatttagggctcttcttaattgatcatgttcagaaaggggactcattttggtccactttgttacaatggga

SEQ ID NO: 5984 - DNA, 145 bp, Homo sapiens
ctactctgggggggaagggaggtggggggcaagcgtcctgctgagaacagtgcagggcagggttggcgcaggccactgcaggcaccgtcagtacagtgactctctcctcacaggggtttccaaggcaaggaccggcccttccagg

SEQ ID NO: 5985 - DNA, 210 bp, Homo sapiens
attggtaatagcaacttttaaaattgtcattagttctgcaatattagctgacatgtagtacagaaaaggattgtacatttagacatttggggttcagttgcttggtagtctggtaaatttaaacccagcttaatttgggtacagggtacacacatatgggccatttaatgtaaaggtccctctaggattcacatactttttggttaaaac

SEQ ID NO: 5986 - DNA, 201 bp, Homo sapiens
tagctctatggttcaccttggaaccactttatagagaattggagcgaatacaggctgatgaagtgattgcaattatggatcaagaacaagcaagggaagcatgaactgaatatcaaccctaaagatgagctttaaaaaaaagaaagaatgttctgtcaaatatttatttaaaatattatcttatggggcccttttttattt

SEQ ID NO: 5987 - DNA, 270 bp, Homo sapiens
cggcacgagactatgagaccagcaagatgaaagtcctcaagtttgcctgcaaggtacaaaagaaggatcccaaggaatgggcagctcagtaccgagaggcgatggaagcgggatttgaaggctgcagctgaggctgcagctgaagccaaggctagggccgagattagagctcgaatgggcattgggctcggctcggagaatgctgccgggccctgcaactaggacgaagctgatatcggaccctgggccaaagcccgataccaagcggga

SEQ ID NO: 5988 - DNA, 366 bp, Homo sapiens
ctttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatatagaaggagacgtgccacaagatggagaggacgggtcactgtgcttggct

SEQ ID NO: 5989 - DNA, 235 bp, Homo sapiens
tggaggtagccccggttatggaggaggaagaggaggatatggtggtggaggacctggatatggcaaccagggtggggcctacggaggtggtaatgacaactatggaggaggaaattatggaagtggaaattacaatgattttggaaattataaccagcaaccttgtgaactgacggtccatggaagagtgggaaactgtggggggtagcaggacacatggggggaccatgatggg

SEQ ID NO: 5990 - DNA, 429 bp, Homo sapiens
ccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaggaaacgcttcaaggtgctcatgacccagcaaccgcgccctgttctctgagggtcctttaaacttgaatgtcttttctgccgtctgttacccctcgcagacttcgtaaccaaaacttttcggactttgagccctgatgcctttttgcagcatactttttggcatcaggcttttgggcgctgatcatgcttttgtatggaatattggtgcaattccattttgggacacattt

SEQ ID NO: 5991 - DNA, 420 bp, Homo sapiens
caattatcaagaaatatcgaccaaatgcctgtgaagaagcattaattaatggatctggagtcaagttcaaagagtttatccactacttgctggattcccaccgtccagtagggatggacattcactgggaaaaggtcagcaaactctgctatccgtgtttgatcaactatgattttgtaggggaatttgagcctttggaagaagatgccaattaacttttcacagatgatcggtgctccaaaggagtgaaatttcccaactttaaggatagacactctcctgttgaaagaccaatctcacgtcgtgagcagtatttaaaggatctgactagactgagaacaattaatctatgacttttgatacttggactattaatgtaaattacacacctcattttagaagttgcatacatctcaagcc

SEQ ID NO: 5992 - DNA, 388 bp, Homo sapiens
ctcgtgcgaatttcggcacgaggatggcattgaacaaagttttaaactattttattaagattatttttcacatctgtggtatatcattacaatttagcaaccaaagtttaaagagttgccataaagtattcctaagctgtatggcttttctttattagatcacagtttgatactttctcagtaaactctttgagtaaaagagttaccttactgaaacttttccatacttacacaggggtgggaggtcaaatgtttggtttggagtttaaattattgggcttttaaaatatcagatttgtattacaattcctcccagtaacctctcaatttctccttcccccaccgtggtttatctacagacagtctctcaacagggcgctaatctggg

SEQ ID NO: 5993 - DNA, 366 bp, Homo sapiens
ttttctaggatttctcattgtcagcaccgtacaactaaagttaaggaggcactgttaattaaaacttgcacagtttctgaattagaagcacaacttagacagttgacagaggagccaaatacactcaatatttcttttcaaaaggctactcataagttagaggcaaaggaaaattccaatttaagagcatgaaggctgatattgaaaggtccttgtgacaggacaaagcaggccttacagcagggcgggaggcaatcagcaacaggactgctttttaaaggagctttgattaccaacagcttgaagacagagtttctgacaccatcaatgcygtcacattgatgaaagagagcttaagaaaaacga

SEQ ID NO: 5994 - DNA, 431 bp, Homo sapiens
  misc_feature 411: n = A,T,C or G
tagtgcctttcagaagtagatgtcattatatgccaaaagtctagctctttgctttaccatacaggggcctgtcccaaagaaaaaggctctttttagccagcatatttccccttctacccttttactttgttgttctgattttaggacttttgcttgccatgttccttttgggtgccattccctcatttgccatttggattgcaaccttaattggtttgggggacaaagagcagcgagtttttgggtcagacctctctgctcttcacagtagttgttaaaaaagggcacggggcccttctcataggagagaagcgacaatgatggtggctccttgttgagggcgaaatacggcatgccctsctgtgagaggvtctaagttggtagtagtagtagagattgttgactggtagntagtactacatcacttactc

SEQ ID NO: 5995 - DNA, 478 bp, Homo sapiens
  misc_feature 464: n = A,T,C or G
acccacaggacttcagctggatctcgttgggaaaagctcaagattgggaaatggaactttggtaggcacatgtcagtatgaaacatttgcctcacagccccatacatgattaaccctttactttgggrggggaaaggtttaaacaagtctttacttgcagaattgagataaacctcatttcagtggtttaataaacctttcttaaaattggttaccaagattataggccttaaaaaattttaagaacaatttggtatttcagtctgagctctgccacttaagattctggggactttgggcaggctgcttattatccactaaccttccaatttttcttccagcttccttaaaagggcagttgttccattacccttattaattaatttggccaccttgtttttttgagggaagaaatgaggtaattgccttaaaggttttaaacataagtccctgcacagcgaggntactaataatgtga

SEQ ID NO: 5996 - DNA, 428 bp, Homo sapiens
taaaaatttggttggtgtttcatgacatgtgggacttcttttgaaatagcaagtcaaatgtagtgaccaaattgtggaaggagatttctgtcaaataggaaatgtgtaaggtcgtctaaaagctgatggggtaattgtaaggtgcctccaggcactccaggattggaccagccaggtttcttgggttgcttgggagtggtcctggtccctcttacatgccttggaggcctcatggtcttcagtccttggagggcccggccaacacccttttgggcacacctgcggttaatgttgcggttgtggcccagtcacaagggaattgtgttggtctagccaaggggggagctgactgtgattyaccacaaaatttctgtattcaacccacatgtctgcgcatcacagtttgatacttccttgtaatcagacag

SEQ ID NO: 5997 - DNA, 426 bp, Homo sapiens
ctcgtccaattcggcacgagtgaagtttcattacctgatccatgggggctttgttggttttggcatcacacagggggaggctcttgccccctccattctctggatttggaaggatgtccattggagcctgccagtgcctgggacaagggttaagatcgggaaccttttgaggagtgtcaatagttgtaacagttcaacctgttaggaaggccaattaatgggggggctcattaatccccttttgggcttttagtgcctttgcccttttatcacaaccttattgcgctcctactcatctgaaccaacaaaaaatgaattgagttgttgagtactaattggcaaagacttttaatcatggcccagaactttcattgacttgaaagtacttctcccacaggaaggaccaaaaacctgttttacttaaaa

SEQ ID NO: 5998 - DNA, 224 bp, Homo sapiens
agaattactctcaactcaccagaattaaattttatatctgcatattttacactattagctcatataatttataagataaattttcaaaggatctggttttaaattttttggaaatgaaatgaattggccttttctgcctctttcgcaaggactattttgttaactatattggcactaactatatccaaaacacacatctgaggcatcactgtgagtgacagccc

SEQ ID NO: 5999 - DNA, 252 bp, Homo sapiens
ctcgtgccgaattcggcacgaggcggaccttccgcaagttcacctaccgcggcgtggatctcgaccagctgctggacatgtcctacggcagctgatgcagctgtacagtgcgcgccaggcggccggctgaaccggggcctgcggcggaagcagcactccctgctgaagcgcctgcgcaaggccaagaaggaggcgccgcccatggagaagccggaagtggtgaagacgcacctgcgggacatgatcatccta

SEQ ID NO: 6000 - DNA, 254 bp, Homo sapiens
ggatcatcgatgttgtctacaatgcatctaataacgagctggttcgtaccaagaccctggtgaagaattgcatcgtgctcatcgacagcacaccgtaccgacagtggtacgagtcccactatgcgctgccccttggccgcaagaagggagccaagctgactcctgaggaagaagagattttaaacaaaaaacgatctaaaaaaattcagagagatatatgatgaaaggaaaaagaatgccaaaatcagcagtct

SEQ ID NO: 6001 - DNA, 145 bp, Homo sapiens
tggcgacaagggcagccaagcagggcttaggatatcccagcctaccaatatgctcattcgactaactaggagggtgcagttcggccctgtctcttcctccttcccctgggacctcagtttccttcagtgcaggcttggtaaggaa

SEQ ID NO: 6002 - DNA, 251 bp, Homo sapiens
aaattaaccactaaaacattgtttatagcaggagattaaagtgaatttaggtgttcctcagtagctgaatgattacataaattattgtatgtctagataatgaatgaaattctacatagaatgaggaagctctctctgtactaacatggaaagatttccaaggcatgtaattgattttaagaaaaggtacagaacagtgtatagcatactacaatatgaattttttttaataaaagagagagaaggaggga

SEQ ID NO: 6003 - DNA, 249 bp, Homo sapiens
ctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtccccccagaactgtcctggctccttccgtattaaacgcatttgcattttgagaagtgtccttccacttcagccctccggagagactacctagtctctctgggg

SEQ ID NO: 6004 - DNA, 253 bp, Homo sapiens
ggagatttgtgataacgtgaccatgtattggatcaatcccactctaatatcagtttctgagttacaagactttgaggaggagggagaagatcttcactttcctgccaacgaaaaaaaagggattgaccaaaatgaacagtgggtggtccctcaagtgaaagtagagaagacccgtcacgccagacaagcaagtgaggaagacttccaataaatgactatactgaaaatggaatagaatttgatcccatgctgg

SEQ ID NO: 6005 - DNA, 252 bp, Homo sapiens
taaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgccccagaaagctcagaaggctaaatgaatattatccctaatacctgccaccccactcttaa

SEQ ID NO: 6006 - DNA, 259 bp, Homo sapiens
ctgacatccaaacagcagagtctggagactgccatgtcgtttgtggccaggaacacatttaagcgtttgtaggaccggattcctaatggaggaaagttggctttttttttcagcaacacacccacaagagcatccccacagctcagagaggctttgctcaagctctcagatgcgggggatcacccccttgttccttacaaggcaggaagaccggcagctcatcaacggctttgcagatcaataacacagcagtgggggc

SEQ ID NO: 6007 - DNA, 253 bp, Homo sapiens
ctcgtgccgaattcggcacgagccaggttttgcagctctcccctgggccactaaccatcctggcccgggctgcctgtctgacctccggacctagtcgtggctctccatcttgtctcctccccgtgtccccaatgtcttaagtggggggcccctcttgggtcccctcctctgccatcacctgaagacccccacggcaaacactgaatgtcacctgtgcctgccgcctcggtccaccttgcggcccgtgtttgac

SEQ ID NO: 6008 - DNA, 145 bp, Homo sapiens
caaaggaggaagtaaggcgaattctggggctgctggatgcttacttgaagacgaggactttcttggttggcgaacgagttacattggctgacatcacagttgtcctgcaccctgttgttggctctataagcaggtgctagagcct

SEQ ID NO: 6009 - DNA, 114 bp, Homo sapiens
ccgccgcgccgccatcatggacaccagccgtgtgcagcctatcaagctggccagggtcaccaaggtcctgggcaggaccgggtttcagggccagtccacgcaggtgcgcgtgga

SEQ ID NO: 6010 - DNA, 177 bp, Homo sapiens
gccaaacgtcaccgtcccctgattgctctacccacccaagagcccgcccacgggggcgcccccccagagatggccagcaatcggaagtgagcacactgccgcagtctgcagcccggcgccaccatctgcagcctcctcctgaccacggacgtttccatcaggttccatcccgaaaat

SEQ ID NO: 6011 - DNA, 110 bp, Homo sapiens
ccagacatgggaggaggaggaagccaagcaatctcgctgagcgaagccattcgcagcttggcatcttcaacgaccctggccttccgcaaggccaaccatttaaccctctc

SEQ ID NO: 6012 - DNA, 110 bp, Homo sapiens
cggctggttatcgggagtttgagggctgaggtcgggagggttgtgtgtacagagctctaggactaacgaaccaggccagttcgcgggttttgggccaaggcctgggtaca

SEQ ID NO: 6013 - DNA, 273 bp, Homo sapiens
  misc_feature 266: n = A,T,C or G
ctatctcgcacctgaaacaagataacatgactaacacccttaattccatccaccctcctctccctaggaggcctgcccccgctaaccggctttttgcccaaatgggccattatcgaggggttcacaaaaaacaatagcctcatcgtccccaccatcatagccaccatcaccctccttaacctctacttctacctacgcctaatctactccacctcaatcacactacttcccatatctaacaacgtaaaaataaaatgacagtttgnacataca

SEQ ID NO: 6014 - DNA, 266 bp, Homo sapiens
atttttgtgatagggaaacacattctttgaaataaaaataaataacaaaaaaggttattgagccacgaataaataaatatgtatatattacttttttcttatttaaatatttttaaaagataatttttacataaaaattatgtaggttataacatgcagaagtacaaggcataacaacaatagctgggaggggaaaaattgaagtattcttctataagattcttctaggatgcattaggtataatatctactagaaggcagacagt

SEQ ID NO: 6015 - DNA, 132 bp, Homo sapiens
cgccacacccgtgaaacatgccttgtccatctggctcagcgtaatcgttttcggcaacaagatcaccagcttgtcggccgtttggcacagccctggtgaccgtttggggtcccgctctacaacaaagccagg

SEQ ID NO: 6016 - DNA, 143 bp, Homo sapiens
tcgtactgaaacaggcacaccttggaaaaccaaatattttattaaagagggagatggctgggtttatcataaaccactttggaaaataattccaacaacacaaccagcagggttgacaaatactatctaaaactcgaccaaat

SEQ ID NO: 6017 - DNA, 225 bp, Homo sapiens
cggaggcggaaggcttgggtgcgttcaagattcaacttcacccgtaacccaccgccatggccgaggaaggcatttctgctggaggtgtaatggacgttaatactgctttacaagagggttctgaagactgccctcatccacgatggcctagcacgtggaattcgcgaagtgcccaaagccttagacaagcgccaagcccatctttgtgttccttccaatccaact

SEQ ID NO: 6018 - DNA, 247 bp, Homo sapiens
ctgatgtcggctgcgagagctgtgcttaagtgactaataaaggtaccagaagaatatggctgcacaaataccagaatctgatcagataaaacagtttaaggaatttctggggacctacaataaacttacagagacctgctttttggactgtgttaaagacttcacaacaagaggagtaaaacctgaagagaacacctgttcagaacattcttacagaaatatttaaaaatgacacaaaggaatatcc

SEQ ID NO: 6019 - DNA, 282 bp, Homo sapiens
agacgctggtggtgcagttcacggtgaaacatgagcagaacatcgactttgggggcggctatttgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatacgttgcaaggatgatgagtttacacacctgtacacactgattgtgcggccagacaacacctatt

SEQ ID NO: 6020 - DNA, 110 bp, Homo sapiens
gccaccagtacataccattgggtctgttcattcctttggccagcttctcaaggtggctttagacctcaacaagccctatcttcaccaatgttctatcttgttcccctaaa

SEQ ID NO: 6021 - DNA, 105 bp, Homo sapiens
tgaagccactgagcatgatagtaaaagcaatggtggaaagggagcagagactagatgctaacccaggcaggaggtctattcaaaagctctttaaattagctagga

SEQ ID NO: 6022 - DNA, 290 bp, Homo sapiens
ctttctgttctgcagcatgcgctgttgtgccattagatggagtctcgcttctgatgggcagatgtcacagttctcggctctgtctccagtcacaccacccctccaattcaggctcagagagtccccagctggccacacctgctcatctcacccaggagagaggagtgtcgaaatggatacagcctcatgttttcaccagtcacatctcttactactgctagtcgctgcaacactcctctcagtttgagctttgtaccgaaagcctggtttgcaaagtagggtacctgact

SEQ ID NO: 6023 - DNA, 325 bp, Homo sapiens
ctgaggttatcaataagctcctagtccagacgccatgggtcatttcacagaggaggacaaggctactatcacaagcctgttgggcaaaggtgaatgttgaagatgctggaggagaaaccctgggaaggctcctcgttgtctacccatggacccagaggttctttgacagctttcgcaacctgtcctctgcctctgccatcatgggcaaccccaaagtcaaggcacatggcaagaaggtgctgacttccttgggagatgccataaagcacctggatgatctcaagggcacctttgccagctgagtgactgcactgtgacaggctgc

SEQ ID NO: 6024 - DNA, 316 bp, Homo sapiens
agagaagagttggttaaaaccttggtaccatagccaaatctgggacaagcgagtttttaaacaaaatgactgaagcacaggaagatggccagtcaacttctgaattgattggccagtttcgtgtcggtctctattccgccttccttgtagcagataaggttattgtcacttcacaacacacaacgatacccagcacatctgggagtctgactccaatgaattttctgtaattgctgacccagaggaacactctaggacggggacgacaattaccttgtcttaaaggaggagcatcttattaccttgaattggatac

SEQ ID NO: 6025 - DNA, 320 bp, Homo sapiens
atcggcatttctgtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccggaccggtcatagcccgtccgcagcgtctatatgaaggagagagctcgagtcatcactgaggaggagagaatttcaaagccttcgctagtctccgtatggcccgtccaacgcccgctcttcggcatacgggcaaaagagcaaggaa

SEQ ID NO: 6026 - DNA, 316 bp, Homo sapiens
tggaggccgaagatagtccctagcttgaagatgataaaacttttccaggctgtgtacttaaggggattcatttattcttaacgcttctataagtttgcctctaaatatattcaattctgtcttgatttctgaattttgaagtgctgtgtttgtttttcacacgatacatgtattcagcttttaataactgtgtttctggaggagcttgaaacaacagccatctgtatgcatgcctgcatgtgtcttttgcttgtaagataccttccttgcttcttcagagtgagctgggttttctatttaaaattaaatttggcat

SEQ ID NO: 6027 - DNA, 320 bp, Homo sapiens
ctcgcctttcggcgagggggaaacttgatgggaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgagttgctaccctgaccacagttcttttggactatgagaaacttcttagatttttattatgtaaatgcctgtggaccac

SEQ ID NO: 6028 - DNA, 320 bp, Homo sapiens
ctgcagtcagaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgagggcttcattacaacaaacaggggtgtaaggc

SEQ ID NO: 6029 - DNA, 317 bp, Homo sapiens
attcattcaagggctaaatttatattttttggaaatcatggcaactacacaggatgttgcttaccaggacggagttttggtatcttagtactgaagttagcactatgtttacatgcaaaagattaaggcaaaaacccttaaagtggacaggtatccaaagttcattttctgtgactcatcagagtgacacaggacttgtaacaactttgcctggacttttttcattttacaacagttcatccattcacaatgatttggttctctgctccatattttgtgatcccttgagcatttgatgaacactctgtggtgctata

SEQ ID NO: 6030 - DNA, 335 bp, Homo sapiens
gccaaagaggccatggagcacccatacttctaccctgtggtgaaggagcagtcccagccttgtgcagacaatgctgtcctttccagctggtctcacgggcagcacgatgaagacttggaaagcgacgggtctcttgccggtcctcccacctttccataagcagaacaaggaaccacatcaaacgtcttaacgcgtatagagagatcacgttccgtgagcagacacaaaacggttgcaggttttggcgagcacgactagaccaagcgagggcagcccaccaccgtatatcaaacctcacttccctaatgtaaaggctcacttgcctttgctttcct

SEQ ID NO: 6031 - DNA, 366 bp, Homo sapiens
cacagactcagagagaacccaccatggtgctgtctcctgccgacaagaccaacgtcaaggccgcctggggtaaggtcggcgcgcacgtgggcgagtatgggtgccggagccctcggagaggatgttcctcttccttcccaccaccaagactaacttcccgcacttcgacctgagccacggctctgtccaaggttaagggccacggcaagaggtggccgacgcgctgcaccaacgccgtggccacgtggacgaatgcccaacgcgctgtccgccctgagcgacctscacgcgcacaagcttcgggtggaccggtcaactccagctcctaagccactccctcctgtggaccgtgccgcccaccttccc

SEQ ID NO: 6032 - DNA, 139 bp, Homo sapiens
aaaatgttctgtaaatatctattaggttcatttagtctataatgcagattaattctaatgtgtccctggtgatttttcttgtcttgataatgggcatggaaatctcccagctattttttcattgggatctatttctctg

SEQ ID NO: 6033 - DNA, 377 bp, Homo sapiens
gcaccaggttcaaggcatttgttgctatcggggactacaatggccacgtcggtctgggtgttaagtgctccaaggaggtggccaccgccatccgtgggggccatcattcctggccaagctctcccatcgtccccgtgcgcagaggctactggggggaccaaggatcggcaggccccaccactgtcccttgcaaggtgacaggccgctgcggtcctgtcctggtacgcctcatccctgcacccaggggcactggcatcgtctccgaacctctccctaagaagctgctcatgatggctggtatcgatgacttgctacacctcaagccggtctgcacttcccaccttggaaatcttgacaaggcacctttgatgcatttt

SEQ ID NO: 6034 - DNA, 276 bp, Homo sapiens
gtgaacataaagttatttgattctacagtattattgtcattgtctttattaattgaagcttaaggaagttatatgagtttttcaaagttggatatagctttccagtttcaaagttcaactctttctgttgttcatagtgttgtgattatataattcatggtctaaattgggatgcttgtgagattaataggaggctgtctaggtgggtacactagacaccgaggtgcgatataccagggcttttctagacacactggggatgtatgattaactccg

SEQ ID NO: 6035 - DNA, 418 bp, Homo sapiens
attgagaagaggaagaaaaaggaaagatgagagacaaagagacacggagagaccacaggcaaagaaagtcatattgggagacaaagacagagctgtgatggaggcatataaacaaagcaggagaatcataaaaagagaggaagagatgaaaataaaaggcaaaagtgtcagtgagtgtattagtccattctcatgctgctaataaagacatacccatgacttggtgatttttaaaggaaagaggtttaattgactcacagttcggtgtcgccagtgaggcctccagaaacttacaatcatggcagaaggggaaggcaaacagatccttcttcatgtgacagcagaagagaaagaacataagttcatgacaaggcagaagagacagaggaagccagacagcagaggcagatttagagag

SEQ ID NO: 6036 - DNA, 487 bp, Homo sapiens
cagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaagagaaaacactaatcttaaattatatccagcaatgtttctggtatcctttaagaaaagttaagactattatttccttcccttccctgtgcagcattcaaaatcacccctagaaaaagtgagtgttttaatgagacttcctaggagggatgcactgtaaacaaaagtattcttgtactcagttttgtgaaaggtaaaaactactatgttttaggtacactttagaaagtctcttcaaacaaacagtcctgtatttgactctgttcatagtttttttttgacagtttagcaaacttctggaattaaccaatttcctgcattaggtgagcaag

SEQ ID NO: 6037 - DNA, 453 bp, Homo sapiens
gcatcatttttgaagcagaacgtggcaagggcaaaaccggcgaaatcgcagtggatggcgtcttgcttgtttctatgcttattgtccagatagccttttatctgtggatgactgaatgttactatctttatatttgactttgtatgtcagttccctggtttttttgatattgcatcataggacctctggcattttagaattactagctgaaaaattgtaatgtaccaccagaaatattattgtagatgcctttcttgtataagatatgccaatatttgctttaaatatcatatcactgtatcttctcagtcatttctgaatctttcacattatattataaatatggagatgtcagtttatctccctcctcagtatatctgatttgtatagtaaggttgatgagcttctctctacaacattctggaaataggaaaaaagccagggaatgtttac

SEQ ID NO: 6038 - DNA, 319 bp, Homo sapiens
gttcaagaaccctttcaaaatgtaagaacatgcttatgaaaacaaagggaagtggaaaagccgcagctggccataagctctaagtcaaagctgtatttggggtctcagtaaagaggagataaacccagtaagtctggaacttactaactggctacacaattcagattaaagagaactcagaaatgatcattacagatttacaaacctaagagtataaaggatggcagtgcttaaatcagagtaatatttggggcaacagtctaagtggaaaatttggttcaaatcgtgttttgtttttagggggtcagtagatgccagg

SEQ ID NO: 6039 - DNA, 189 bp, Homo sapiens
cggcacgaggtcacttgtacctggtggtttctctgttagcagtccattagctcatgctgaattatttttgccttactttcttaagaaacattaattttatgtatagtgagtatattttcgcatgttttaaattgtaaatggagctaagtccaagaagtacttgaagctctcttccagcgatgcttaatt

SEQ ID NO: 6040 - DNA, 283 bp, Homo sapiens
gcaaaatcaaaaccatgatgagatatcatctgccagtcaggatggctacaaaaaagtaaaaaaataatagatgttggtgaggttatggagaaaaggacttatacacttgttaggagtgtaaattagttcaatcactgtggacagcagtgtggtgattctcagagagctaaaacagactaccatttgactcaccaatccattactggatatttacctaaaggatataaatcattccaccataaagcacatgcaggctatgttcattgcagcctattacagtaca

SEQ ID NO: 6041 - DNA, 350 bp, Homo sapiens
ggaagttctgcgcatggtggcaccatttcccgtgaacacccatgggaggtcatgcctgatctgtacttctacagagatcctgaagagattgaaaaagaagagcaggctgctgctgagaaggcagtgacccaggaggaatttcagggtgaatggactgctcccgctcccgagttcactgctactcagcctgaggttgcagactggtctgaaggtgtacaggtgcctctgtgcctattcagcaattcctactgagactggagcgctcagcctgccacggagactggtcgcagctccactgctcaggccactgaatgggtaggagcaaccactgactggtcttagctgtctgc

SEQ ID NO: 6042 - DNA, 169 bp, Homo sapiens
cacggctcacattgcatgcaagtttgctgagctgaaggaaaagattgatcgccgttctggtaaaaagctggaagatggccctaaattctggaagtctggtgatgctgccattgttgatatggttctggcaagcccatgtgtgttgagagctgctcagactgatccacct

SEQ ID NO: 6043 - DNA, 182 bp, Homo sapiens
aatttttgtaggtagaattttctacattccctctgaatgttagttgtcagttgtatttagctaatcccataattcccagaggaaggcagaagaaagaagacttctctgctcctcggctggtggaagggaggtctcgccatttttctgtctcctctctctttatagtcccagaattcctattc

SEQ ID NO: 6044 - DNA, 173 bp, Homo sapiens
cacctctgtattcagcatagctattcctgttgatggtgatgaagacagtgcatctgggggaggtgttgtagccattgccaccaaatagaccagcatggatctggtgaaaagccatttgatgtatcagtagagagagttggaggtttaaaggaccaattaaagtattagttgta

SEQ ID NO: 6045 - DNA, 149 bp, Homo sapiens
gaaattcatatcttaaagaaacagctttcaagtgcctttctgcagtttttcaggagcgcaagatagatttggataggataagctctagttcttacaaccgcactcctacaagatttaggaaaagtttacaacatatctaggtttcagaa

SEQ ID NO: 6046 - DNA, 228 bp, Homo sapiens
ttggtcattatgaccaggtgagcatgctactataccgcagaggatccaaccatgagctcttcccagcctaggggaagctggatttgccctcatgtaggagctggctaggactgttgactctctcagctgagtcagggacactcaggcactggacagttgggcatttgaggccgtgtgtaattctgctctcatgctgagtctccatttcttccctttctctgtcatcca

SEQ ID NO: 6047 - DNA, 310 bp, Homo sapiens
gtaaaacctgaacccagaaacaacacatccgttgcaaacccaaaggacccaagtactttccaatctcagtcactctaggactctgcactgaatggctgacctgacctgatgtccattcatcccaccctctcacagtttggacttttctccctctctttctaagagacctgaactgggcagactgcaaaataaaatctcggtgtctatttatttatggtcttcctgtagaccttcgggtcaaggcagagcaggaactactgtgtagtcaatgcccctgagtactccccagccagcagaggcctccttcagt

SEQ ID NO: 6048 - DNA, 134 bp, Homo sapiens
tagctttgaatcccaattacacattggtcagtgggaaaactaagggcctccaacaggcaaattcagggaggataggtttcagggattataaatttattttatattagtggccttcaaggataaactgatgtaat

SEQ ID NO: 6049 - DNA, 288 bp, Homo sapiens
agatggcggaggtgcaggtcctggtgcttgatggtcgaggccatctctgggccgcctgccgatccgttggctaaacaggtactgctgggccggaagtggtggtcgtacgctgtgaaggcatcaacatttctggcaatttctacagaacaagttgagtacctggctttcctccgcaagcggatgaacacacccttccggaggcccttaccacttccgggccccagccgcatcttctggcggacgtcgagtatgctgcccacaaacagcaggcagcgctctgacgttcag

SEQ ID NO: 6050 - DNA, 313 bp, Homo sapiens
gcctgttgggccaccggccttgccaggagagagaggccaccctggagctccggggccttcggggagccctggcttgccttggtgtgcctggctccatggagacatggtgaattatgatgaaatcaagaggttcatcagacaagagatcattaaaatgtttgatgagagaatggcttactacacctccaggatgcagttcccatggagatggcggcatccgggacgaccagggccttcaggaaggatggtgctccgggcaggccaggtctccaggtcacctgctcctgtcagattgcagcagacggcaggcttc

SEQ ID NO: 6051 - DNA, 227 bp, Homo sapiens
ggaatcctaagtcttctgtataagtagggtacaatatacaatgaaactaaaacagctcttgtcttttagcccctggaatcgtggcggatataataggaggggcaacatgcacagagaggtggtggcggtggaggagtggtggatcggctatccatacctcgtgccctgtttttcctggccgtggtagttactcaaacagagggaactacacagagtggaatgccaca

SEQ ID NO: 6052 - DNA, 250 bp, Homo sapiens
aaggaatttaatgcagaagtacatcggaagcacatcatgggccagaatgttgcagattacatgcgctacttaatggaggaggatgaggatgcttacagaaacagttctctcaatacataagacagcgtaactcagacatgatggaggagatgtataagaaagctcatgctgctatacgagagaatccagtctatgaaaagaagcccaagaaagaggttaaaagagaggtggacctcccaaatgtccttgt

SEQ ID NO: 6053 - DNA, 249 bp, Homo sapiens
cttggggggaggttgagaacacacccttgagagttgaagggtcggaaacgccctacgtggacaggacacccggcccagcttttaagatcctggagccaggccgcaggagcgttggggtctgaagatggccaacgaggcgctgcaagaaccgggccaagagcaggaagcctttcggagagtgacggagaatcttggccagcctcacccccaaaggcctgagcccagccatgtcgcagcctacagcgcttg

SEQ ID NO: 6054 - DNA, 144 bp, Homo sapiens
ggaaagcaaaataacaaaaaagagaacgccaacaaaatcagcagatgattgaagacaggggcctcgggggtgggctccggcaccgacatcctagagtcaggcactttcctcagtgactgtgtgtaggggggatttcagggctga

SEQ ID NO: 6055 - DNA, 336 bp, Homo sapiens
agaacactatgtggctgccgtgtaagagtggactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttg

SEQ ID NO: 6056 - DNA, 335 bp, Homo sapiens
gctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggacagattgatccttccacccatcgcaagaactacgtacgtgtagtgggccggaatggagaatcagtgaactg

SEQ ID NO: 6057 - DNA, 333 bp, Homo sapiens
atttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggcacagcagggagtcagccctaccttcttccttggcagctggagaaatctggtttcaatatactcatttaaaatt

SEQ ID NO: 6058 - DNA, 306 bp, Homo sapiens
agcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtagtcttgctgatttgcagaatgatgaagttgcatttagaaaattcaagctgattactgaagatgttcagggtaaaactgcctgactacttccat

SEQ ID NO: 6059 - DNA, 244 bp, Homo sapiens
gtcgcccaggttggtttagaacttagagctctgcccgcctcagcctctcaaagttctgggattacaggcatgaatcaccacacctggcctttagaaaaaatttaaaaattagccaagtgtggtggcaagtgcagtattccagctacttgggaggctgagttggagtactgcttgatcctgggaagttgaggctgcagttagccgtgattgttccacttaactccagcttggcgacagaggcctg

SEQ ID NO: 6060 - DNA, 227 bp, Homo sapiens
gtggcaatccggtcagcgtggaggttcagtccgtcaccgacgcgtgaaggtaaaagtgagccgtgttcctgacggtgttgctgaatacagcgtatgggagctgaagctgccgacgctgcgccacgactgtttccgcttgcgtgagtatccgtgagaacgacgacggcacgtattgccatcaccgtccgttcagcatgtgccggaaaaagaggccatcgttgatatcg

SEQ ID NO: 6061 - DNA, 178 bp, Homo sapiens
aattgttctccgacatctacaagatccgggagatcgcggacgggttgtgcctggaggtggaggggaagatggtcagtaggacagaaggtaacattgatgactcgctcattggtggaatgcctccgctgaaggccccgaggcgaaggtaccgaaagcacagtaatcactggtgtcgcta

SEQ ID NO: 6062 - DNA, 310 bp, Homo sapiens
cgtgccgccatcatggacaccagccgtgtgcagcctatcaagctggccagggtcaccaaggtcctgggcaggaccggtttctcagggacagtgcacgcaggtcgccgtggaattcatggacgacacgagccgatccatcatccgcaatgtaaaaggccccgtgcgcgagggcgacgtgctcacccttttggagtcagagcgagaagcccggagtttgcgctgaacttggctgctcgctgggtctgggatgtcgggttcgccacttgcccatgggaatggtctgtcacatctgctccttttttttgtccgc

SEQ ID NO: 6063 - DNA, 186 bp, Homo sapiens
acaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacct

SEQ ID NO: 6064 - DNA, 246 bp, Homo sapiens
tgaaaccctcctccacagctgcagcccatcctcccggctccctcctagtctgtcctgcgtcctctgtccccgggtttcagagacaacttcccaaagcacaaagcagtttttccccctaggggtggggaggaagcaaaagactctgtacctattttgtatgtgtataataatttgagatgtttttaattattttgactgctggaataaggcatgtgggagatgaccccaaacataaaagtaaaaaga

SEQ ID NO: 6065 - DNA, 190 bp, Homo sapiens
ggggacagaaatcaggtattggcagtttttccattttcattttgtgtgtgaatttttaatataaatgcggagacgtaaagcattaatgcaagttaaaatggtttcagttgacaaggttcagcggttcaactttataattattataaataaacccgttaaatttttctggacaatgccagcattgggattg

SEQ ID NO: 6066 - DNA, 245 bp, Homo sapiens
gcacgagggagcatattctcctgctttgtacatagggtgtggtcccctggcacgtggccaccatcatgtttaggcctatgctaggaggcaaatggccaggctctgcctgtgtttttctcaacactacttttctgatatgagggcagcacctgcctctgaatgggaaatcatgcaactactcagaatgtgtctcctcatactaatgctcatatgtttaatggtgatgcctcgcgtacaggatctcg

SEQ ID NO: 6067 - DNA, 112 bp, Homo sapiens
gtcttcagcagccaactcctgggagctgccaggtgaggggttaaagaagaggttggggaagcaagtgttggcctccttgggaaaggtcttgctgccttctggttcttaagcc

SEQ ID NO: 6068 - DNA, 108 bp, Homo sapiens
gttttgcaggcactgcctgctactggagggacaggatgctcccccagggaagagaccggaatagtgtggggtgtgttccagggtctgcatcccgaagatgggctggga

SEQ ID NO: 6069 - DNA, 230 bp, Homo sapiens
ccaccccagaggggcccttcaatgttgggagccagagggcatgtcccccattggacccagccgggccgttttccccctttgccagggcccccagagggcacaccgggaggcttagagggagacacccatttggaagtttccctctttcacagagacccccttctccccacacatctcggtctctctcccagggagccagcgccccctctccagagggccccctgtgccct

SEQ ID NO: 6070 - DNA, 105 bp, Homo sapiens
ctcgtgccgaattcggcacggggggatttttgagacttaaagcggttttgggacctcttattttattttggaatacttaattttttccattaagggattattggt

SEQ ID NO: 6071 - DNA, 178 bp, Homo sapiens
gtgcgtagtccgccgcgtcttgggtcagcggataaggctagcccgcttaggggacccccccggaggttggttcagcaattggtcaagacctgagaggtttttaaggaaccttaggaccccagaaggccctttcagacaagaaaggctttaggggggggtaaccctgggcaggaccctt

SEQ ID NO: 6072 - DNA, 201 bp, Homo sapiens
gggagggtgaagaaggcaagcagaggccagctggtgccactgagggagaattggagtcacagagcattcttgggtcacgctcttcctgctgcttcttcagaacgcggttttctggctcacttggcggtcccgaggaacggttagcttcttagagctttcggggatttgtgggagggggcttgggaagggctctccacacgg

SEQ ID NO: 6073 - DNA, 210 bp, Homo sapiens
aaatacaaaacttggaccacccaaatgtccacacgatagactggattagaaaatgtggcacatatacaccatggattactatgcagccataaaaaggatgagttcatgtcctttgtagggcacatggatgaggctggaaaccatgatttctgagcactctatcgcaggcacacaaacccacacaccgcatgtctctcactcataggtggg

SEQ ID NO: 6074 - DNA, 272 bp, Homo sapiens
ccacagctcacaaactcagccgcagcctcgaccccgctgctctgcccgcggctttcctggctgttggacatctgagccaggccagactcctgatctgcgtctcctagacccacacacctcttaggaatggccccgcagtactcctccattacactggcaggttcccacatgtgtgtggtcaaagacagttcgctacatatatagagtgtacacactaaaacactcttctttcacatctcactcgagatacgctactctcccaagacagacgc

SEQ ID NO: 6075 - DNA, 216 bp, Homo sapiens
cggcacgagttcatccagcacttggacctgattgaacatgcgagtacacacacgggaaagaaactctgcgagtctgaatgtgtgtcagagttccagtctaacaggccataggaaggtcctctttggagagaaggttcatcattttcatagagtgtggaaaaacccttccagagagggtcacacacctgtgaaaagacatacagaaatatcccatct

SEQ ID NO: 6076 - DNA, 270 bp, Homo sapiens
cagcagtcgcgcatccgcatcgacagcctctctgccccagctcagccagctccagaaggcagctggcagccagggaggcgaggtttcgggacctggaggactaactggcccttaagcggacaaccagccgcgcgcttcttggcgaaaaagaagcggagagatggccgagatgcggcacacgtatacagcagcatctggcgcgtgtaccacgagcttctgagacatcacgctgcgccctgacacatgagagacgccacgtctcaccccaat

SEQ ID NO: 6077 - DNA, 245 bp, Homo sapiens
cttcttccctctctctctttggacaatagttaaattagcagtattagttatgagtttggtttccagtgtcctaatcttgtgggctgttttccaaaaaccacatgctcctgatttaaccagggatcctaatacctacacaatgcaaaccctcttactcccaggcyttttctctgtgccacacgggggagcttgcgcacacactcagagcacagtgggcccctacagagagctctcttgtgttagag

SEQ ID NO: 6078 - DNA, 279 bp, Homo sapiens
ggcacctgtacctccggggtgggcgctcggggttggctccatgaccacgatctattgggggacgtaagagaaaccgccgtaatggcccagcccacttaaggccggggttccaggagttttggccccccgggttcctccaggccctgggagggcttgaaaattggtggaaaagaaccagagttgggcgcccaaaactcttacaccctcagggcacagagagatctaaacagtctccccccacagatcacatctcccaccacggcgttttagcacacacca

SEQ ID NO: 6079 - DNA, 258 bp, Homo sapiens
attacatgtattagattcgaaaggactgaaatcgtatgaatgtaatcaaatagaccggatttgattccatggattgaatagaaggtattcaattggattggattagcctggattggattggatccgtttggatttgtattgaatgtgtattggagggaattcgcatatggagtggattggattggatacacactgggcccgggtttatattgagggcccaatggtatcacagggagattagagccaagaggtagtgat

SEQ ID NO: 6080 - DNA, 143 bp, Homo sapiens
gtgaattatagaggaaatacagagagaacctctctcactcttacttttcgtccaaataaaattgataggtgtaccagcaagttgaaggatccggtttaagaatttggggcttactctcattacaaattaggccccccacacay

SEQ ID NO: 6081 - DNA, 206 bp, Homo sapiens
cgccatcgtggtgtgttcttgactccgctgctcgacatgtcttctcacaagactttcaggattaagcgattccctgggccaagaaacaaaagcaaaatcgtcccatttcccaattggattcggatgaaaactgggaataaaatcaaggacaacttcaaaaggagacaattgaggagagacccagtttgggtctataaagggatttc

SEQ ID NO: 6082 - DNA, 324 bp, Homo sapiens
  misc_feature 15, 305: n = A,T,C or G
caaaagactcacagnctccatgcggctggagaggcctcacaatcatggaagaaggctaaagacatgtcttacatggcagcagacaagacagaatgagagagaggcaaaagcagaaaccccttataaaatcatcagatctcatgagacttattcactgccacaagaacagtatgggggaagctgcccccatgattcaatatctcccaccaggtccctaccacaacatgtgagaattatgggagctacaattaaagatggaatttaggtgggaatacagagccagaccatatcattctgcccctggnccctcccaaatctcatgtc

SEQ ID NO: 6083 - DNA, 295 bp, Homo sapiens
  misc_feature 142: n = A,T,C or G
ggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccanaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaagga

SEQ ID NO: 6084 - DNA, 131 bp, Homo sapiens
  misc_feature 124: n = A,T,C or G
ctgaggaggagaatcacttgaacctggaggctgaggttgcagtgagtcgaggttgcgctactgcactccagcctggacaacagagggagactctgtctcaaaaaaaaaaaaacctacagctgtncaaggac

SEQ ID NO: 6085 - DNA, 351 bp, Homo sapiens
  misc_feature 339, 341: n = A,T,C or G
gtcagcatttcagaaaggaccatccaaaccttaacgcataatatgggcattgcaactggtaatatgctggtaaggaagatgtgtggagaaggagggccttcagggtcctggctaaataatgccctatatgaagctgcctacctcctactccttggtctattcctggtcacatgtactgattttccaaaacaaagaaattcccatcttacccaaattcttggagttgatgttgactgtggaattctaatgtgcttggctcttagggtatgactggtttccctggtgctgctggacggactggtcccccaggaccctctgtaagtaaatcactgtaaacgngncttcatttac

SEQ ID NO: 6086 - DNA, 302 bp, Homo sapiens
  misc_feature 4, 78, 89, 152: n = A,T,C or G
tgcnaatgcctctttgaagcaattcaggctaggtaaaccgattttgccatttcaaaacgtctttattttactttgttntatatcagagncttataaaacctgctgcaaatatttctgaatgtctttgtaaaagtgtttgttagtgtacctgngattatagtacttcacttttttcctttggattaattggttaaatgaatgagaaatgtgttatgttttttactaaaaagtataaattaaaattttggaaagaaaaggcaatattatctggctccccaattaaagtttgattttattgtcac

SEQ ID NO: 6087 - DNA, 328 bp, Homo sapiens
  misc_feature 22, 26, 27, 77, 123, 191, 271, 311: n = A,T,C or G
aagcccttctaccttcacggcnctgnngtttagatcccataaatccattcatatggataatgtgctttgagcagtgnccggcacacagtcgagcctatggaactttcagtagttacaatgggnacaaaaagatggataatacatattactttattgtcacttggaaataggtttgagttttctgcaactgnggcaacacagttcccggcaccaggtctacaggctgacttgcacaatggaagcgatttggggtttttcaaaagaacctggngtctagggtcagagtctgttgttggttggttgggagaggncaagaaaaggggagagg

SEQ ID NO: 6088 - DNA, 114 bp, Homo sapiens
  misc_feature 13, 21, 32, 68, 70: n = A,T,C or G
gagagaactagancttgaatnttaatttttgnttttactttttatgtacacagtataatgatgttagngntaaatattaaaaatctgactcttcactgggacttttttatagat

SEQ ID NO: 6089 - DNA, 347 bp, Homo sapiens
  misc_feature 33, 90, 139, 198, 278, 321: n = A,T,C or G
aggatcttgagctttagtgtgctatacctatgngtcttatcgtgggccactgtgccaataaacaaaaacaactgtttggtttacctcagntgcagtagttattttcatttagaagttgttctcagattattgtttcagntatatagaggattactagactagttatgaagaaaccccactacattcaatggaattggngcttaaaatctcatcgatgtgctgtctctggagtgataagaaagggctacatctcccgaaatgatttctttacgtcatgnattgggttccttcttcaccttgaacttttgttgaactgtatgnactttaccccaaacctgttaatattt

SEQ ID NO: 6090 - DNA, 349 bp, Homo sapiens
  misc_feature 18, 72, 105, 116, 174, 198, 255: n = A,T,C or G
ccgagcagtacatgctangacttcaccagtcaaagcgaactactatactcaattgatccaataacttgaccnacggaacaagttaccctagggataacagcgcantcctattctanagtccatatcaacaatagggtttacgacctcgatgttggatcaggacatcccgatggngcagccgctattaaaggttcgttngttcaacgattaaagtcctacgtgatctgagttcagaccggagtaatccaggtcggnttctatctacttcaaattcctccctgtacgaaaggacaagagaaataaggcctacttcacaaagcgccttcccccgtaaatgatatcatctcaa

SEQ ID NO: 6091 - DNA, 333 bp, Homo sapiens
  misc_feature 6, 42, 76, 79, 112, 287: n = A,T,C or G
tgcgcncctgcaggtcgacactagtggatccaaagaattcgnacgagaacggactgattcaccgcaagactgtggncgnggagccggcagccgacggcaaaggtgtcgtggnggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagncagaagcctgtgatggtgaagaggaagcggacccgccccaccaaga

SEQ ID NO: 6092 - DNA, 349 bp, Homo sapiens
  misc_feature 19: n = A,T,C or G
cttttttgagacatgaganatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattatttttggg

SEQ ID NO: 6093 - DNA, 331 bp, Homo sapiens
  misc_feature 88, 91, 124, 162: n = A,T,C or G
taccactcccctgccccaggagccactcccactccagctgcctgtttccagcaggttcccagtgcccctgacaagcccctgctggtgnctncatctcctgccaagcatcctccagtgcctcctnctgtgggcctggcctcagggctatggacagactcctgncccatcccagagacccctcgtgatcgtgccctggcacgtgggccgtggcccggctgggtcggctgaagaactgcggatggaagctgcggaaagaggcccttgatggggcccaccatcccggacccaagtcttcttcctggcgggcctctcgtctccttcctggtttggg

SEQ ID NO: 6094 - DNA, 144 bp, Homo sapiens
  misc_feature 20, 33, 35, 56, 65, 68, 93, 98: n = A,T,C or G
gcccaatgaagatgaagtanatcaggactcggncnaaaaaaactcgagagtacttntagagcggncgngggcccatcgattttccacccgggnggggnaccagggtaagtgtacccaattcgccctatagtgagtcgtattaca

SEQ ID NO: 6095 - DNA, 400 bp, Homo sapiens
  misc_feature 9, 11, 52, 54, 55, 229: n = A,T,C or G
tggtttttngngcgcctgcaggtcccacactagtggatccaaagaaattcgntnngagctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgnggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcatttgtggatgcaaatc

SEQ ID NO: 6096 - DNA, 316 bp, Homo sapiens
  misc_feature 203, 301: n = A,T,C or G
aggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcanttgacctgggtcttgaaagagtcgggagtgacaagctcagagagcatgaactgatgctggcatgaaggattccaggaagatcatggagacctggctgntagctgtaacagaga

SEQ ID NO: 6097 - DNA, 343 bp, Homo sapiens
  misc_feature 85, 330: n = A,T,C or G
tatgaatcgtaagttaggatggacattagatgtgattatgatgataaagcgaaggtctgcggtcctatatctacagacacgtggngagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcattgagaggtgagcccagggctaggcctgggccangccccggcagcac

SEQ ID NO: 6098 - DNA, 350 bp, Homo sapiens
  misc_feature 48, 83, 146, 172: n = A,T,C or G
ttaaagcttaccaaattgatggtgaatttatcagattaacctttttgnggtgcaggatggttctaagtatcaggtgacagggnattctactctttctagtcaattaaaattgataatgcagcatgattcataaactaaccagctgngcctccttttattttgaggaccctgnagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatt

SEQ ID NO: 6099 - DNA, 328 bp, Homo sapiens
  misc_feature 30: n = A,T,C or G
gtgaaatcacttcatatatcatgtgctgtnaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttg

SEQ ID NO: 6100 - DNA, 343 bp, Homo sapiens
  misc_feature 212, 319: n = A,T,C or G
ctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgntccaaattatcaaattcaagtgaatttatttgtgtgttctttacttatataaaaaaagataactttaaggatgtgcaagtacatttccaactgctagcacaaccagnattttgtaattaaacaaattgctg

SEQ ID NO: 6101 - DNA, 398 bp, Homo sapiens
  misc_feature 12, 15, 60, 61, 67, 99, 136, 174, 218, 251: n = A,T,C or G
gcgcctgcaggnccnacactagtggatccaaagaaattcggtacgagccactggactggnnccacanggaataggaccaggcccttatcaggccatggnactcatctcccaccacccgcagcccaacctctgttcnagcatgatgggcagaactcaggcctttttccgtgctgntcttattcctatatctgcttttgcttttggtggtctctttatgngaaatatctttcccgtccttctgaacacgtggnaaccctttgagcctagatgactccaaagactaggactctccatctgtgctgcagaacggggcggccttggcatgtctggtcttttgtggacttcccagggatctgggtggcttccaaggccctggatggcccaaattctcttccctt

SEQ ID NO: 6102 - DNA, 400 bp, Homo sapiens
  misc_feature 5, 23, 52, 142: n = A,T,C or G
tggtnttttgcgcgcctgcaggnccgacactagtggatccaaagattcggtncgaggacccctggagtccagccaccaccacctcagatgggagagattattagctgctgtggaggcacatacctacccagcatgcctcggncctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtgggaagaaagaactcagggcgttagaaaggattg

SEQ ID NO: 6103 - DNA, 142 bp, Homo sapiens
  misc_feature 117: n = A,T,C or G
gtaaaattgacagagaggggaaaccccgtaaagtggttggttgcagttgtgtagtagttaaggactatggcaaggagtctcaggccaaggatgtcattgaagagtatttcaaatgcnagaaatgaagaaataaatctttggc

SEQ ID NO: 6104 - DNA, 398 bp, Homo sapiens
  misc_feature 2, 18, 38, 308: n = A,T,C or G
tnacaattcactgcccantagtggatccaaagaattcntttcgagcatgggtctggagatatttctgattgtcacgactggggcaggagtgctagccagggatgctgctcaacatcttgtaatgcacagtataatcgtaacaataaagaattatttggtctaaaatgtcgataaagccactgttgagaaaccctgatctagagggttcaggggtttggagaaaggggacaaaagttgagtagatgagccaggacatgtttccctgattcctccagctatgctgggttcttggctggttcagcctcggngaccaactccagactgtctgaactttgggaggacgaggtgggtggatcacctgaggtcaggagttcaagatcagcctggccagcatggcg

SEQ ID NO: 6105 - DNA, 400 bp, Homo sapiens
  misc_feature 15, 17, 102, 175: n = A,T,C or G
tgcgcgcctgcaggncnacactagtggatccaaagaaattcggtacgagcccaaaaagaactggtggagcagcaagagcaaggagaagaaacacatactggnttggagaaaccatcaatggtggcttccatttcagctatggagatgacaatctggctcccaacactgccaacgnccagatgaccttcctacgcctgctgtccacggaaggctcccagaacatcacctaccactgcaagaacagcattgcctatctggacgaagcagctagcaacctcaagaaggccctgctcatccagggctccaatgacgtggagatccgggcagagggcaatagcaggttcacgtacactgccctgaaggatggctgcacgaaacataccggtaagtggggcaagac

SEQ ID NO: 6106 - DNA, 331 bp, Homo sapiens
  misc_feature 25, 154, 229, 274, 287: n = A,T,C or G
gtcatgcaggtcttccctggctganctcatggcccgcacctccctggacttggagctggatctccaggcgtcgagaacacggcagaggcagctgaatgaggagctctgcgccctccgtgagctgcggcagcggttggaggacgcccagctccgnggccagactgacctcccaccctgggtgcttcgggacgagcggctccgtggcctgctgcgggaggccgagcggcanacaagacagaccaaacttgactaccgtcatgagcaggcggctganaagatgctgaaanaaggcctccaaggagatctaccagcctgcgtgggcagagcccca

SEQ ID NO: 6107 - DNA, 400 bp, Homo sapiens
  misc_feature 3, 195, 218, 282, 397: n = A,T,C or G
tgngcgcctgcaggtcgacactagtggatccaaagaaattcggtacgagtgagcataagtcttttatttctttttaaggttaaatcgtaaactgtatacctttactactgaaaacaaaactatagggcatcatactaattgaaaatcaatagtaatgggttccatccattggctttttaaatgaatagatctggnattgatttccttcctgttttttngaggcacattcctttacaaccagtgtttaaaccaccacgtaatcatcttctgcaaacaaggggngccagtgttgcctaacagaagataatctttaataaagcaaatcctctgcttcaaaggtttttgaaataattggatccctttttgaaaaggaagatgagtttaactgtgtccaggngga

SEQ ID NO: 6108 - DNA, 400 bp, Homo sapiens
  misc_feature 3, 17, 41, 75, 117, 222, 233: n = A,T,C or G
tgngcgcctgcaggtcnacactagtggatccaaagaattcntttcgaggccatgagtatgctcaggcttcagaanaggctcgactctagtgtcctccgctgtggcaatgaagaaggnctggttagaccccaatgagaccaatgaaatcgccaatgccaactcccgtcagcagatccggaagctcatcaaagatgggctgatcatccgcaagcctgtgacggnccattcccggnctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgat

SEQ ID NO: 6109 - DNA, 400 bp, Homo sapiens
  misc_feature 3, 21, 61, 92, 118, 120, 167, 193, 227, 265, 374: n = A,T,C or G
tanggaaaaaccctgtttttngcgcgcctgcaggccgacactagtggatccaaagaaattntgcacgagaaatggctacccaacttgccttnatgcgcctgctggccaactatgcctntnagaacatcacctaccactgcaagaacagcattgcatacatggatgangagactggcaacctgaaaaaggctgncattctacagggctctaatgatgttgaacttgtngctgagggcaacagcaggttcacttacactgttcttgnagatggctgctctaaaaagacaaatgaatggggaaagacaatcattgaatacaaaacaaataagccatcacgcctgcccttccttgatattgcacctttggacatcggnggtgctgaccaggaattctttgtgga

SEQ ID NO: 6110 - DNA, 213 bp, Homo sapiens
  misc_feature 18, 78: n = A,T,C or G
tcaggagttgaagaccancctggccaacatggcgaaaccccatcttttctaaaaatacaaaaattagctgggcgtggnggcgggcgcctgtaatcccagctactcgggaggctgaggcaggagaatcgtttgaacccgggaggcagaggttgcagtgagccgagatcacaccactgcacttcagcctgagcgacaagaatgagagtctgtcta

SEQ ID NO: 6111 - DNA, 220 bp, Homo sapiens
  misc_feature 15, 21, 35, 43, 62, 63, 70, 97, 142, 155, 171, 215: n = A,T,C or G
aaggaaaaaacctgnatttgngcgcctgcaggtcnacactagnggatccaaagaattcggtnngaggtgnaaggcccgggaccgcgggatgggtgtnggcgtgaccaggcctgagctccctgtctctcctcagtgacatcgnctttaaaccctgngtggcaatccctgacncaccgccgtgatgccccagggaaaaaaggggccaacctgggaancccaa

SEQ ID NO: 6112 - DNA, 348 bp, Homo sapiens
  misc_feature 109, 268: n = A,T,C or G
ccgctgtctgttctccgacgcctacccgggacgcctccctgggatgcttctggcgcgcagtggtcctcgcggaggtgatccaggcgttctccgccccggagaatgcagngcgcatggacgaggctcgggataacgcctgcaacgacatgggtaagatgctgcaattcgtgctgcccgtggccacgcagatccagcaggaggttatcaaagcctatggcttcagctgcgacggggaaaggtgtccttaagtttgctcgcttggtcaagncctacgaagcccaggatcctgagatcgccagcctgtcaggcaagctgaaggcgctgtttctgccgcccatgaccctgcca

SEQ ID NO: 6113 - DNA, 351 bp, Homo sapiens
  misc_feature 17, 41, 44, 62, 119, 153, 154, 266: n = A,T,C or G
tgcgcgcctgcaggtcnacactagtggatccaaagaattcnttncgaggaactgagcatctncagcattctcagccacaaccaaaaaaaaataaaaagggcagccctccttaccactgnggaagtccctcagaggccttggggcatgacccanngaagatgcaggtttgaccaggaaagcagcgctagtggagggttggagaaggaggtaaaggatgagggttcatcatccctccctgcctaaggaagctaaaagcatggccctgntgcccctccctgcctccacccacagtggagagggctacaaaggaggacaagaccctctcaggctgtcccaagctcccaagagctt

SEQ ID NO: 6114 - DNA, 239 bp, Homo sapiens
  misc_feature 41: n = A,T,C or G
gcgcgcctgcaggcccgacactagtggatccaaagaatttngcacgagtggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgt

SEQ ID NO: 6115 - DNA, 383 bp, Homo sapiens
  misc_feature 3, 36, 41, 55, 65, 93, 329: n = A,T,C or G
tgngcgcctgcaggcccgacactagtggatccaaanaattntttacgagcagtgngctccctcangtgccacggccgcaccagtgagatgcangcacctggcagaccctctggctagcctgcagccccccctctcccatcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggngctaggctggctgggtgtcaaggagcaagctccaggccaaggtcctggcccagc

SEQ ID NO: 6116 - DNA, 400 bp, Homo sapiens
  misc_feature 3, 42, 220, 251, 333: n = A,T,C or G
tgngcgcctgcaggcccgacactagtggatccaaagaattcnttacgagcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagntcagaagaggtttggctttccagagggcagngtagagctttatgctgaaaaggtggccactagaggtctgtgtgccattgcccaggcagagtctctgcgttacaaactcctangagggcttgctgtgcggagggcctgctatggtgtgctgcggttcatcatggagagtggggccaaagg

SEQ ID NO: 6117 - DNA, 398 bp, Homo sapiens
  misc_feature 61: n = A,T,C or G
gcgcgcctgcaggcccgacactagtggatccaaagaattcttgcacgagcaatgatattgngtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatag

SEQ ID NO: 6118 - DNA, 349 bp, Homo sapiens
  misc_feature 33, 131, 240, 278: n = A,T,C or G
actgcaagaaacagcattgcctacatggatgangagactggcaacctgaaaaaggctgtcattctacagggctctaatgatgttgaacttgttgctgagggcaacagcaggttcacttacactgttcttgnagatggctgctctaaaaagacaaatgaatggggaaagacaatcattgaatacaaaacaaataagccatcacgcctgcccttccttgatattgcacctttggacatcggnggtgctgaccaggaattctttgtggacattggcccagnctgtttcaaataaatgaactcaatctaaattaaaaaagaaagaaatttgaaaaaactttctctttgccatt

SEQ ID NO: 6119 - DNA, 400 bp, Homo sapiens
  misc_feature 3, 6, 41, 43, 67, 93: n = A,T,C or G
tgngcncctgcagggcgacactagtggatccaaagaattcntnacgagggtaaacgcaaggcttganttttctcggggccttatgatgctggntcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaactttt

SEQ ID NO: 6120 - DNA, 398 bp, Homo sapiens
  misc_feature 13, 15, 39, 66, 119, 368: n = A,T,C or G
atccaaagaattntncacgagctcgtgccgtactttttnccctctcaaaatctgtattgataagtntctatctaaatttatatgtcaaataatcaaagattgttttacctacatgttgnaaataatattaaaaattgcctagatgatcaatttgaaatatttgtatattcatgttagcttatatgtggcaaaaataagagaactagtagagttttttatagactacatagtccaaagaaaagtaatgcaataaaacagtagtaacagtacaattgtactatgatgttacaaaaattgtaaaaataatgacagctctttacttcttgagcacttatgatatatattattgagaacttgtttggtagtgntctgatcactttctaagcatcagttcattt

SEQ ID NO: 6121 - DNA, 392 bp, Homo sapiens
  misc_feature 8, 58, 220, 241: n = A,T,C or G
ggaaaaancctggtttttgcgcgcctgcaggtcgacactagtggatccaaagaattcntacgaggacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggnctttagccatgcacaaacggnagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 6122 - DNA, 277 bp, Homo sapiens
  misc_feature 99, 136, 138: n = A,T,C or G
gctgagagcaagatgggtcaccagcagctgtactggagccacccgcgaaaattcggccagggttctcgctcttgtcgtgtctgttcaaaccggcacggnctgatccggaaatatggcctcaatatgtgccgccagngnttccgtcagtacgcgaaggatatcggtttcattaagttggactaaatgctcttccttcagaggattatccggggcatctactcaatgaaaaaccatgataattctttgtatataaaataaacatttgaaaaaacccttc

SEQ ID NO: 6123 - DNA, 190 bp, Homo sapiens
  misc_feature 4, 27, 137: n = A,T,C or G
aagntgtttaactagactgcgtgctgnttttcccgtataataaaaccaaagaatagtttggttcttcaaatcttaagagaatccacataaaagaagaaactattttttaaaaattcacttctatatatacaatgagnaaaatcacagattttttctttaaataaaaataagtcattttaatatctaataa

SEQ ID NO: 6124 - DNA, 329 bp, Homo sapiens
  misc_feature 25, 34, 260: n = A,T,C or G
ggagcagcacagtactcagaggagngaggagcgnggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggnagaaagtcgatgccttctagtctcagtgaatttaacctgtgattttatgtctacgtatattgttccttt

SEQ ID NO: 6125 - DNA, 328 bp, Homo sapiens
  misc_feature 49, 62, 76, 288: n = A,T,C or G
atggcagacaatgattgaagctcacgttgatgtcaagactaccgatggntacttgcttcgtntgttctgtgttggntttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgntagaaaagtaaaaatgctgaagaagcccaagtttgaattg

SEQ ID NO: 6126 - DNA, 320 bp, Homo sapiens
  misc_feature 2: n = A,T,C or G
tncggcacgagcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagg

SEQ ID NO: 6127 - DNA, 350 bp, Homo sapiens
  misc_feature 6, 68: n = A,T,C or G
atttgnagtcatgtacagaacatgatccagggtgttacactgggcttccgttacaagatgaggtctgngtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagca

SEQ ID NO: 6128 - DNA, 330 bp, Homo sapiens
  misc_feature 110, 113: n = A,T,C or G
ggaaataggactggtgcggggagtataataggaattcatctttatctgttatcctttgtctttttattttgagacggagtctcattctgtcacccaggccggagtgcagnggngtaatctcggctcactgcaatctctgcctcctgggttcaagtgattctcctgcctcagcctcccgagtagctgggattacaggcgcacgccaccgtgcctggctaattttttgtgtttttagtagagacgaggtttcaccatgctggccaagctggtcttgaactcctgacttcatgatctgcctgccttggcctcccaaagtgctgggatcacagg

SEQ ID NO: 6129 - DNA, 284 bp, Homo sapiens
  misc_feature 61, 250: n = A,T,C or G
ttcggcacgaggatatatttgcacatcaacctcaaatagatgatttttgaagccacagcanctagataaaatcataccagggagagtgtgcagagtgaagaaataagcaggctgaggttggaatcctgggaacacccatcatttaagggatggagggtagaggaaactgaaggaaatgaagtgtgagcacagaagtaaaagccaagaagaagagtgttataaagaggaaatagccaaagatactacttgnggttcaattagtatttacccaaagaaaatacttc

SEQ ID NO: 6130 - DNA, 353 bp, Homo sapiens
tcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtcttggattgaccccaaccaaggctgcaacctggatgcca

SEQ ID NO: 6131 - DNA, 348 bp, Homo sapiens
  misc_feature 78, 152, 180: n = A,T,C or G
gaggagtagggccgcctcggggctgggcatccggcccctggggccaccccttgtcagccgggtgggtaggaaccgtanactcgctcatctcgcctgggtttgtccgcatgttgtaatcgtgcaaataaacgctcactccgaattagcggtgnatttcttgaagtttaatattgagtttgngatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatccc

SEQ ID NO: 6132 - DNA, 395 bp, Homo sapiens
  misc_feature 7, 35, 54, 55, 60, 65, 80, 158, 181, 221, 236, 273, 304,322, 342, 343, 368: n = A,T,C or G
gctatanccaagaaccaacctgctcttagctcttncttttctgtaaaaggctgnngaggntgggncctgatactgggttntggcttttgcatggagctcctgacattcccattcctgaggtctttgaaggatgcagcacacaccttccctgttctagntttccccttttggagctcagagncctaaggtgtggcttccagtcccccacaccacagcctgangaataagctgtcagnggtaccaagggggctggaatcctcttcaccacagatnttttaatttctcaaggatttactggcacttnttttcttttgcttctggnttgccaattgaagggcatgnncttccacctacatttttgcaactgnctactgttaagctgtggctctcacatt

SEQ ID NO: 6133 - DNA, 343 bp, Homo sapiens
  misc_feature 5, 35, 52, 107, 124, 154, 180, 190, 211, 216: n = A,T,C or G
tattntgattcaatgtttaagtttctaaaaaaggngatattaaagtatatgnattccttcagcattaccttaaaggctagaaaaacgggataaatcttcagaaaagngtcaaaagtgtcacagnacatgttcaaatttaaacttgaatcctggntcatctttgacttttgatgtgcattnttaatgcttntttatttttgatacacagaangcagntgaacttgatcttttaaaattgagacatgtaagctaatcagcaaaagacagaaacaaaactgcacatctgtaataatcagatagcaattctactgcacaattcattgattgtaaggtatcctgtaac

SEQ ID NO: 6134 - DNA, 331 bp, Homo sapiens
  misc_feature 7, 8, 30, 191: n = A,T,C or G
cctgcanngccacactagtggatccaaagnaattcggtacgagtgcatgcagaggcaacatgagtcctgccttaaaattccagcttttctgtatcaatcgtactgacataattcaactgtctttctttgcaagttcttgttcttttcgaaattatatcactgcagaataactttcttccactattcagtanaccttccatagtttcttatcttctctctcattattaaatttccacatttaagtgattagggatagaaatagccctactacagaagcatcattgatgaattctaagtacttgaggcaggatatctctactttttttttttt

SEQ ID NO: 6135 - DNA, 312 bp, Homo sapiens
  misc_feature 118: n = A,T,C or G
agcggctgaaggagtaccgctccaaactcatcctcttccccaggaagccctcggcccccaagaagggagacagttctgctgaagaactgaaactggccacccagctgaccggaccggncatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttgg

SEQ ID NO: 6136 - DNA, 324 bp, Homo sapiens
  misc_feature 20: n = A,T,C or G
aaataaccgaatagtagaanaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaat

SEQ ID NO: 6137 - DNA, 329 bp, Homo sapiens
  misc_feature 36, 126: n = A,T,C or G
aaaaagcttctaaaaagctatttcgccaggcacggnggctcatgcctataatcccagcactttgggaggccaaggtgggtggatcgcctgaggtcaggagttcgagaccagcctggccaacgcggngaaaccccatctctactaaaaatgcaagaattggccgggcgtggcggcacatgtctgtagtcccagctacatgggaggctgaggtgggagggttgcttgaacccaggaggcggaggcagaggctgcagtgacccaagattgtgccacttgcactccaccctgggcaacagagcaagaccccatctcaaaaataaataaatata

SEQ ID NO: 6138 - DNA, 213 bp, Homo sapiens
  misc_feature 19, 114: n = A,T,C or G
catgttagatactcactanttatgtgttttattaattttcaggatgtttgtctttctatcagtactgagttccctaatgataaactggtcatctatatgccaaatacagtttgncatgagtaatccatttagggtacaaataaataagtggctatatttgaaatgaaaatcactttctagaaggtttggtagtcccagttactggtttttttt

SEQ ID NO: 6139 - DNA, 333 bp, Homo sapiens
  misc_feature 6, 192: n = A,T,C or G
gctggnctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggnggcaggaacaactatcctcgtctgtcccaacactgagcaggcactcggtaaacacgaatgaatggatgagcgcacggatgaatggagcttacaagatctgtctttccaatggccgggggcatttggtccccaaattaaggc

SEQ ID NO: 6140 - DNA, 327 bp, Homo sapiens
aggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcacccatcctggagtacctcaccgcagaggtacttgaactggcaggaaatgcatcaaaagacttaaaggtaaagcgtatt

SEQ ID NO: 6141 - DNA, 400 bp, Homo sapiens
  misc_feature 5, 8, 37, 38, 49, 66, 333: n = A,T,C or G
ccctncantgcgacactagtggatccaaagaattctnnacgagcgtgcngccccagccgctgccgnctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacacttttcaagtaaaccaggtggnggagaccccatccttggctgcttgcagggccacttgtccaggcaaatgccaggccttgtccccagat

SEQ ID NO: 6142 - DNA, 398 bp, Homo sapiens
  misc_feature 43, 103, 351, 353: n = A,T,C or G
tgcgcgcctgcaggtcgacactagtggatccaaagattcggtncgagcatacaagcaacattttgctgagatggctgccagtcttaagcgtccagactcaggngccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcananatggccgagacggtgagcgaggccccccaggggtggcaggaattc

SEQ ID NO: 6143 - DNA, 400 bp, Homo sapiens
  misc_feature 4, 25, 31, 71, 143, 252, 317, 382: n = A,T,C or G
cttntattgggaaaaaaccctggtnttttgngcgcctgcaggcccgacactagtggatccaaagaaattcnttacgagaatccacattcctcttgagttctgcagcttctgtgtaaatagggcagctgtcgtctatgccgtanaatcacatgatctgaggaccattcatggaagctgctaaatagcctagtctggggagtcttccataaagttttgcatggagcaaacaaacaggattaaactaggtttggntccttcagccctctaaaagcatagggcttagcctgcaggcttccttgggctttctctgtgtgtgnaagttttgtaaacactatagcatctgttaagatccagtgtccatggaaacattcccacatgccgngactctggactatatcag

SEQ ID NO: 6144 - DNA, 102 bp, Homo sapiens
  misc_feature 14: n = A,T,C or G
tgataacgtgaccntgtattggatcaatcccactctaatatcatgtttctgagttacaagactttgaggaggagggagaagatcttcactttcctgccaacg

SEQ ID NO: 6145 - DNA, 334 bp, Homo sapiens
  misc_feature 59, 282, 285, 321: n = A,T,C or G
cagactttgcttaccatcagcatctgcaatgggccaaacacacctcaaattggctgagntgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgnggntaatctgtttcacctggtttgtcctaaggccatagntaaaaagtaccag

SEQ ID NO: 6146 - DNA, 324 bp, Homo sapiens
  misc_feature 44, 283: n = A,T,C or G
gtacaatgattgaagctcacgttgatgtcaagactaccgatggntacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgntagaaaagtaaaaatgctgaagaagcccaagtttgaattgg

SEQ ID NO: 6147 - DNA, 329 bp, Homo sapiens
  misc_feature 4, 84, 172, 234, 247: n = A,T,C or G
gtcnacctggggacggctgcggctgcaggggagggcccggcggtgcgtttcacacttgctcctacttccgccttccagggctgnggggctgcctcccctctagggtccagcgcaggggctggggccctaccaaaggtaggaggggcttccgggataagatggcaggcgtggntctggccctcctgctcccctgtgtcctcacccctcgggggtccgtgggtgaggctgctgcanccgtgagtctcantgacacttcctaccaggtctttatctacaccactatttgctccaattataactaattggacacgtactgtatcttcatggca

SEQ ID NO: 6148 - DNA, 240 bp, Homo sapiens
  misc_feature 15, 37, 78: n = A,T,C or G
cacccactacctaanaaatcccaaacatataactganctcctcacacccaattggaccaatctatcaccctatagaanaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaagg

SEQ ID NO: 6149 - DNA, 290 bp, Homo sapiens
  misc_feature 24, 26, 150, 156, 285: n = A,T,C or G
cactagtggatccaaagaattcgntncgagcagtattttagtttttcacagcgaatttgattttagtctaccaaggagtttaacttttctatgttccctaactctaagattagggctgtattacctagacaggccttaaaaggtttttgngttgtnctctgttaataagaatttgttcctttaaaccagaggatcaaccttggaactattaacattttgggattgataattcattgttgttgggggctgtcctgtgtgcttaggatgttcagctgcagccctggnctcta

SEQ ID NO: 6150 - DNA, 332 bp, Homo sapiens
  misc_feature 12, 20, 102, 173, 175, 185, 312: n = A,T,C or G
caagaccccgcncacggggncgcccccccagagatggccagcaatcggaagtgagcaaaactgccgcaagtctgcagcccggcgccaccatcctgcagcctnctcctgaccacggacgtttccatcaggttccatcccgaaaatctctcggttccacgtccccctggggcttntnctgacccagnccccgtgccccgcctccccgaaacaggctactctcctcggccccctccatcgggctgaggaagcacagcagcatcttcaaacatgtacaaaatcgattggctttaaacacccttcacataccctccncccaaattatccccaattat

SEQ ID NO: 6151 - DNA, 347 bp, Homo sapiens
  misc_feature 6, 27, 207, 217, 310: n = A,T,C or G
ggccgncttgacccaggctacccttanccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccanggcccagcanggggcagtggcacctgttgacggaaaaggccgaggtgcttaccagtgaaccttctggcccgcccctcccctgtcacttgtcgggcatccaggnccccgacctgtgcctagccgccagggtgacaggaagg

SEQ ID NO: 6152 - DNA, 319 bp, Homo sapiens
  misc_feature 20, 196: n = A,T,C or G
gaagaactggtacatcagcnagaaccccaaggcacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgnggcctacatggaccagcagactggcaacctcaagaaggccctgctcctccagggctccaacgagatcgagatccgcgccgagggcaacagccgcttcacctacagcgtcactgtcgatggctg

SEQ ID NO: 6153 - DNA, 352 bp, Homo sapiens
  misc_feature 89, 132, 317: n = A,T,C or G
tagaagctctaagaaaagaaattctccctggagactcatacagggttaataaagccacaacttttctatactgctgagccacagctgcngaaaaagagagaaagaagaagaagaaaacaggtctgtccttgntagctttctgtcttgaagccttagatgtaacctggcctcttcctgagaaggaagggagcattactgcacttaccctagctcattgaagatggaggtactgtgctcacaaaatgaggctttattactctctccatttgatgtccaaatcccagagcaacaataaaattatgcttgtagatgtgcgngggtcattctgctgaccttctgacttcccagcaca

SEQ ID NO: 6154 - DNA, 291 bp, Homo sapiens
  misc_feature 56, 106, 192, 230: n = A,T,C or G
agattatcaaagctgaagctggctttgctgagaagctccctacctccctgcccttntcctccttcctgctggaatgaactaaagcagatgtcaagcaggggctggngggggtgcctactcccttttccactctatctttagatttcaaaccttaggcttacagcccctcaatatctctctgctaacaccagngtctctttctagttaggcctctaatcttctgtttctgnttaccagcttcccagcaactttccttttttaaaatattaaaaatttaattcaggttctctt

SEQ ID NO: 6155 - DNA, 286 bp, Homo sapiens
  misc_feature 246: n = A,T,C or G
caaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggntggctggattcagtaataaatatgtaaggcctttcttttt

SEQ ID NO: 6156 - DNA, 294 bp, Homo sapiens
  misc_feature 17, 45, 63: n = A,T,C or G
cgcgcgcctgcaggtcnacactagtggatccaaagaaattcggtncgaggagacgacgtgcanaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttgg

SEQ ID NO: 6157 - DNA, 323 bp, Homo sapiens
  misc_feature 3, 5, 32, 42, 111, 121, 182, 249, 254, 296, 313: n = A,T,C or G
cancnccttcagattcatgcacgggatgctgnggaggcttangagtcatgagactggaaaaaggagaatcgattgccaggagcttcagaccaacagagtatatggagtagntaggccctgncctccctagctcacactgactctaccaattccccaaccctatgtgaggtatcagggatagncttaggctacattgaatcagagatactctagactcaaggattgggcccaggagagaggatgaaactncacanagagaacaggggaaaccctcctggactattccctgacatagntcccagggaacctacanctagggactg

SEQ ID NO: 6158 - DNA, 355 bp, Homo sapiens
  misc_feature 15, 18, 43, 45, 46, 116: n = A,T,C or G
tgtgcgcctgcaggnccnacactagtggatccaaagaaattcntnncgagtagggatcctgaccacaatgactgtcctgctacatgaagtgccccacgaggtcggagactttgccntcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatca

SEQ ID NO: 6159 - DNA, 297 bp, Homo sapiens
  misc_feature 2, 16, 130, 133, 199, 287: n = A,T,C or G
gntagatgatgcaggntcttcctagtctcgatggtctttacattttggcatgattttgcagcggctggtaccagttattcctttccatgtttagcgcttccttcaggagctcttttagggcaagcctggnggngacaaaatctctcagcatttgcttgtctgtaaagtattttatttctccttcacttatgaagcttantttggctggatatgaaattctgggttgaaaattcttttctttaagaatgttgaatattggcccccactctcttctggcttgtagagtntctgccaaga

SEQ ID NO: 6160 - DNA, 169 bp, Homo sapiens
  misc_feature 12: n = A,T,C or G
gccattgcactncagcctgggcaacaagagcaaaattctgtcaaaaaaagaagacagaaagaagagaaagagacagagagagaaagagggaaggaagggaggaagggagggagaaagggagggagggaggaaagaaaagaaaagaaagaaagagaagagaaaagaaaag

SEQ ID NO: 6161 - DNA, 293 bp, Homo sapiens
  misc_feature 42, 287, 291: n = A,T,C or G
ctcgtgccgccatgattttcctcccattcatcatgagggagnttctcaaaccaggagtttatatttattttttagaaaatacacacttttcaggagaaacctgagcatgattttggattctccacctccccccagtctctgcacctgggattcagctcaaggattcagggtcttcatttttacaaaagttcccccaagaaatcagcaaccagcctctgtttcatctgggagcccctcccttggccccctgggtttgggggtgctgccctactgggaacagcgggggnctgnca

SEQ ID NO: 6162 - DNA, 395 bp, Homo sapiens
  misc_feature 14, 113, 195, 210, 211, 254, 270, 291, 297, 334, 368: n = A,T,C or G
gaaacaaaaggganagccccacaaaactttggggacaagggagagagagactcatctgacacttcttttggaggtcaggatttgtatatcaggaattgaagttagaattaagngaattaaactgaatttgattgtgagtgaacctagaacagcactgaagtattacataacctggaagactgagaagggtatatnatttgaaggatcttnntatttccccgaggtctttcgcactggagacagcataaaagagngaacaaatgttgggangagagaagatgacatcaatgngggagntcagtataactggggataaactagaagaacctgtgantttacagtcatcttattacctgccagggctcatntagccatggcaatggttgccttgaatg

SEQ ID NO: 6163 - DNA, 124 bp, Homo sapiens
ggtgtgtgcctataatcccagctactcaggaggctgaggcaagagaatcgcttgaacccaggatggggaggtttcagtgagccgagatcgcaccactgtactccagcctgggcacagagcggga

SEQ ID NO: 6164 - DNA, 395 bp, Homo sapiens
  misc_feature 86, 174: n = A,T,C or G
gtcattctcttgggggagatggattaaacaaatgatgtattctcccatcggtcagtgcttttatgctaactagagactgggcaggntgagtagaaagtgtatgaatgccattgtatgatctgagctgaaatctggtgtgcacatacttcacactgaagcagcagaaagctctgngaaataggtctaattattcccattttatagataacaacactgagacatagctggtaagtggtaggaccaggacttgaactcatgactctgattccaaagttcatggttgcctggctgttccatgcactatgcttagagaaaaggcaaatttctcagtctttactcacataccctgatatctaccataagaaaaagaagcaaagaggcctgttacccagaat

SEQ ID NO: 6165 - DNA, 253 bp, Homo sapiens
  misc_feature 42, 58, 81, 84, 87: n = A,T,C or G
cagccgtgtgcagcactatccgctggccagggtcaccaaggncctgggcaggaccggntctcagggacagtgcacgcaggngcncgnggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatg

SEQ ID NO: 6166 - DNA, 273 bp, Homo sapiens
  misc_feature 5, 16, 62, 94, 130, 180, 204: n = A,T,C or G
acccngggaaaatggngaagaaaattgaaatcagccagcacgccaagtacacttgctctttntgtggcaaaaccaagatgaagagacgagctgnggggatctggcactgtggttcctgcatgaagacagnggctggcggtgcctggacgtacaataccacttccgctgtcacggtaaagnccgccatcagaagactgaaggagntgaaagaccagtagacgctcctctactctttgagacatcactggcctataataaatgggataatttatg

SEQ ID NO: 6167 - DNA, 112 bp, Homo sapiens
  misc_feature 8, 17, 45, 106: n = A,T,C or G
agtacttntagagcggncgcgggcccatcgattttccacccgggnggggtaccagggtaagtgtacccaattcgccctatagtgagtcgtattacaatttcactgnccgctg

SEQ ID NO: 6168 - DNA, 284 bp, Homo sapiens
  misc_feature 3: n = A,T,C or G
cgngcgcctgcaggtccgacactagtggatccaaagaaattcggtacgaggcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatg

SEQ ID NO: 6169 - DNA, 399 bp, Homo sapiens
  misc_feature 224, 377: n = A,T,C or G
gcgcgcctgcaggcccgacactagtggatccaaagaaattctgcacgaggccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagngcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctncttccacacctgattagaacat

SEQ ID NO: 6170 - DNA, 142 bp, Homo sapiens
  misc_feature 44, 138: n = A,T,C or G
cccgcagtggcttttgccccagaaaggggaaaggaacacgcggntagatgatttctagcaggcaggaagtcctgtgcggtgtcaccatgagcacctccagctgtactagtgccattggaataataaatttgataaggnggtg

SEQ ID NO: 6171 - DNA, 394 bp, Homo sapiens
  misc_feature 2, 17, 43, 96, 102, 107, 174, 221, 249, 310, 375: n = A,T,C or G
gngcgcctgcaggtccncactagtggatccaaagaattcggtncgagatgactttgaaattatggatttatattaatggcactataaaccaatggnaatggnaattnttaaacttgctaaatattgagaaactaaactactaagttaataaattatatatagcagtgtagctgntctctctagatggtgtctcacaatggatttctgttgcttgactattntcttagtgaatatttatactaaggtagngactgagatttggtgatctggctgagtattttgaaacacattttgaataatatggcttagngttaacggggacttaaatatgatttttttttcttactcatttcaccttccctgtactgtatgttnggaattgatcataaaacat

SEQ ID NO: 6172 - DNA, 260 bp, Homo sapiens
  misc_feature 66, 95, 103, 232, 247: n = A,T,C or G
ccaaactacatcgcacccgaggtgctcctccgcaaagggtacactcaactctgtgactggtggagngttggagtgattctcttcgagatgctggnggggcagncgccctttttggcacctactcccacagaaacccagctgaaggtgatcaactgggagaacacgctccacattccagcccaggtgaagctgagccctgaggccaggggacctcatcaccaagctgtgctgntccgcaaaccaccgnctggggcggaatg

SEQ ID NO: 6173 - DNA, 325 bp, Homo sapiens
  misc_feature 37, 216, 222, 230, 324: n = A,T,C or G
ctgatttgtaattctgtttgtacaagtttagagcagnctagctcgagtcctcaaccccagtcctcttagaagtgaactgattgcactggatccctaaacccacaatgttgaggacacatgtgatgactccacttgctcagccagctggcctcttgcactttcccctgcccaccacttgtaactaccacttaattatcttgtgttaattgcttttgntgtgtngggtctgnatttttgtggtcagtgcctgcaggcagaaatgtgaaagcatttggtatgttgaagatacttgcttcttttttaataaaattaaaagtgcagcana

SEQ ID NO: 6174 - DNA, 134 bp, Homo sapiens
  misc_feature 6, 7, 28, 40, 51, 54, 66, 74: n = A,T,C or G
gcacannctgagagcaatcatgacacancattaacactancttgtgcaggnggncatgaagaactngtatctgngctcattgcacgggatgccaaaattgaacacagagacaaaaaaggtttcacaccactaat

SEQ ID NO: 6175 - DNA, 324 bp, Homo sapiens
  misc_feature 50, 176, 240, 299: n = A,T,C or G
ggacacttaggttgtgttcattacttggttattgagaataatgctgcagngaacatggaagtacagatatttcttcaagacagtgattaaattttctttggatatacaccctgaaatcggattgcttgataatatggtcattctgtttttaatttttttagtatcatccataatgnattacataaccctttgctggtattttatacaggcaacacaatatgccttttgaaaacactgagntgaggatatttgcatctatgtttatcagaattggcctgtaattttcttttcttgtaagngtgtttatctggctttgggataagg

SEQ ID NO: 6176 - DNA, 319 bp, Homo sapiens
  misc_feature 303: n = A,T,C or G
tcaataacgctaataatagctaacaataatctgcaatgcctggaatacacatattttagattcttaaaagacatctttaactttttaccaagaatttctatttgactttaagtaagtaagctgttttatctatcctaatgtcgcatagctaaagagtggtagaactgatattgaacatgcatttctctcattcaagtgtctttaaattttccagcaagccaagttcctgtcatgctggtctctttcttcttctgcatatagtctatgcccaccctgatttctatactttcaactcagattggnctttgattttgaattg

SEQ ID NO: 6177 - DNA, 279 bp, Homo sapiens
  misc_feature 3, 43, 78, 184: n = A,T,C or G
tgngcgcctgcaggtcgacactagtggatccaaagaattcttnacgaggcgcttcgggagccgcggcttatggtgcanacatggccaagtccaagaaccacaccacacacaaccagtcccgaaaatggcacagaaatggtatcaagaaaccccgatcacaaagatacgaatctcttaagggggnggaccccaagttcctgaggaacatgcgctttgccaagaagcacaacaaaaagggcctaaagaagatgcaggccaacaatgccaaggccatgagtg

SEQ ID NO: 6178 - DNA, 400 bp, Homo sapiens
  misc_feature 12, 14, 39, 42, 52, 65, 66: n = A,T,C or G
gcgcctgcaggncnacactagtggatccaaagaaattcnttncgaggtgggngtgggcaatgccnnggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccggg

SEQ ID NO: 6179 - DNA, 163 bp, Homo sapiens
  misc_feature 43, 45, 59: n = A,T,C or G
tgcgcgcctgcaggtcgacactagtggatccaaagaaattcgntncgaggctacggaancaggccgagaagaacgtggagaagaaaattgacaaatacacagaggtcctcaagacccacggactcctggtctgagcccaataaagactgttaattcctcataa

SEQ ID NO: 6180 - DNA, 359 bp, Homo sapiens
  misc_feature 6, 10, 12, 61, 92, 145, 153, 164, 183, 207, 232, 237, 289: n = A,T,C or G
ctgacnttgncntctcatttcaacgtgtcaggcacagaggaagcatcgcatagacatgggnctcctccatcacatgccttgtggaatatagngagacctctctgctcatagatttcctggtctttctgctgcccccaagccttanggatatgncaagttagccntcatttgaattaacctcancactttctcttgcatcaggtattngaactgcattctttcagatctcatngattntgaaatcaattccgttgatgcagaattgctctgtgtaattatttatacaaanctcttgatgtgattggtggagccttacttcagagcacagcagcatgatgctacgcagagctctaaatatg

SEQ ID NO: 6181 - DNA, 125 bp, Homo sapiens
  misc_feature 15, 61, 66, 67, 91, 100, 104: n = A,T,C or G
ccgacaagctggagncattgactaaccacatccacaaagcacaccattaatccactatgancaagnnggggggaatctggagaagggttcngaatatctncctnttcatccctcccgaaatctgg

SEQ ID NO: 6182 - DNA, 338 bp, Homo sapiens
  misc_feature 16, 87, 91, 101, 129, 131, 171, 258, 328: n = A,T,C or G
gcgcgcctgcaggtcnacactagtggatccaaagaaattcggtacgagcgagtttttttttttgctggatattatcttgtaaaacgngaanactacctgtntgctgtgagggaccgggaaatgtttggntntatgaaattacatccagaggattttcctgaagaagataanaaaacatatggggaaatttttgaaaaattccatccaatacgttgaagtcttcaaaatgcttgctccagtttcactgatacctgctgnttctgaatttgatggaacatgtttcttatgacagttgaagcttatgctaatctgtatgttgacaccttgnaattaaaata

SEQ ID NO: 6183 - DNA, 338 bp, Homo sapiens
  misc_feature 75, 76, 78, 86, 101, 297, 304, 309: n = A,T,C or G
aaaaaagttaaaaaaattaacattaaaatatatataaattgagacgggttcttttttcttttcttgagatggagnntngctcttgntgcccaggctggagngcaatggagcaatcttggctcaccgcaacctcccgctcccaggttcaagggattctcctgcctcagctactcgggaggctggggcatgaggatcgcttgaacctgggaggcagaggttgcagcgagccgagattgcaccactgctctccagcctaggcgacagggcaagaccctgtcttaaaaaaaaaaagaaggnggagggnactgntaaaaagttaaaaatttagagctttaaac

SEQ ID NO: 6184 - DNA, 330 bp, Homo sapiens
  misc_feature 228: n = A,T,C or G
acgtaaaacttgatgtttatcaggattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagnttatgttgattttgaccctcttatttaatctctagtgcagaagtgcagctttctgcaggctgcgcctcaatcgctaagttccactctccatcctctgccgcg

SEQ ID NO: 6185 - DNA, 285 bp, Homo sapiens
  misc_feature 20, 21, 106, 134, 140, 171, 218, 223, 248, 257: n = A,T,C or G
ggaagtacaggctacaccannccaccaccattggccacgtgctacagacctggcatcccttcctccccaagttctccatccaggatgccgatcgccagacagtctngcgagtggtggggccctgctggacctgnggctgnggcacagacaccaactttgaggtgaagactngggatgaatcccgcagtgtgggccgcatcagcaagcagtgggggggnctggnccgagaagccctcacagatgcagangactttggnctacagttcccgctggacctggatgtga

SEQ ID NO: 6186 - DNA, 279 bp, Homo sapiens
  misc_feature 6, 47, 50, 127, 145: n = A,T,C or G
ctgcancggctggcagacggggccctcgacctctatgccatggtggnggntctctcgagggcctcaagatccctgagtgagggccaccccacggcccagcatgagaaaatgctctgtgacacctggngtatcgaggctgcagctnggatccgagagggcatggccgccctgcagtctgacccctggcagcaagagctctaccgcaacttcaaaagcatctccaaggccttggtggagcggggtggtgtggtcaccagcaacccacttggcttctgaata

SEQ ID NO: 6187 - DNA, 400 bp, Homo sapiens
  misc_feature 10, 14, 38, 41, 70, 224, 260, 320, 392: n = A,T,C or G
gcgcctgcangtcnacactagtggatccaaagaattcnttncgagagcagacccacatacccggagcggnggaccagcgaggcactagtagaggcagtcccgtggagcccgcctctccagtcccagccagaggggaccctggcctttggtgaccactgagaaggacacttcacgggcccagagctcctggtactgcccttcctttgagggccgaggagggctgnggacagcccagcaacctgtcgctcttggaggctggngtggccttgaggagggaagcctcgcatggccgctggaagagaggcgcctcctggcctggntctgcagaacccaggggcacgctctgggcctgggcctgaggaagtcccgctctccccgcggctctgagttgnactgagga

SEQ ID NO: 6188 - DNA, 400 bp, Homo sapiens
  misc_feature 9, 14, 123, 126, 128, 167, 223, 225, 302, 330: n = A,T,C or G
cagaaaaangaccnttattttttcattttcagcaaacatcatacttaaaggggtaatgcaagcatttattttaagctagaggaactgagtattactactgctactattcaaaattgaactggnagntntaattagaacagtaaaagagggaaaagacatgaaaagtnaatgtactgactgatactacctgacttcaaggcttactgaaaagctaccagacagngnggtataagccaaagaataaataaatagatcagtggaacagaataaggagtccagaaataaacccacacagacatagncaattcttttgaaaaaggtgcaaaggcnatccaaaggagaaaagataatattttcaacaaaaggtgctggcacaacaggacatccagaagcaaaaaag

SEQ ID NO: 6189 - DNA, 396 bp, Homo sapiens
  misc_feature 6, 19, 49, 75, 215: n = A,T,C or G
cactgncacctttgatccngggctcaagcgatcctcccaccttggcctnccaaagtgttggattttcaggtgtgngccaccaagcccggcctcagacttacttctgataatgtaactctgactatactaattcgatttaattactctatgattttaggttttagttttctaaaaactcctttccagcaaattttttactcctcacttgtgttcgntgtgtctatcattaaggtattattgctttactcctaacatgggaagctctcagctcctttaaaacacaactttgggagggaaatgcttgcatccacttgcatctacttttccatgaattacttgaacaagtatttgtccacggcaggagggattgagcatggtgggatggatttgcagagt

SEQ ID NO: 6190 - DNA, 267 bp, Homo sapiens
  misc_feature 17, 94, 108, 119, 152, 154, 166, 185, 193, 208, 221, 250: n = A,T,C or G
acaacgaaggccgagcntgcctttcccatctgtctatctatctggctggcagggaaggaaagaacttgcatgttggtgaaggaagaagtggggnggaagaagtggggngggacgacagngaaatctagagtaaaaccaagctggcccaaggngncctgcaggctgnaatgcagtttaatcagagngccatttntttttttgttcaaangattttaattatnggaatgcgcaatttttttaatatgcaaanaaaaagtttaaaaagtt

SEQ ID NO: 6191 - DNA, 128 bp, Homo sapiens
cacattctctgtcgacgtctgggctgcagctgtcctttgaggtccctcggtgggcactgccaacctgagctgcaataggggctgactccggccctgtatcctcagcacctgtgagagtgttggatgag

SEQ ID NO: 6192 - DNA, 122 bp, Homo sapiens
cataaatggattttaaactgtctacggttcttaacctcatctgttaagttcccatgcctggagaagctaatgccaactcatcatgtgataattcaatttgtacaataaattatgaacctgga

SEQ ID NO: 6193 - DNA, 400 bp, Homo sapiens
  misc_feature 24, 28, 30, 38, 69, 71, 83, 199: n = A,T,C or G
cttcttggggaaaaaacccctgtntttngngcgcctgnaggcccgacactagtggatccaaagaaattntntacgaggttagnttcctccctcatttataccccaatggcataccattccagagatctcataaaaacagacacagacttctccctctttatatggttatcttacgacttacctagtccttgagtctggncattaactccttggtgaggagagaacccataagcttaggaagtgctctgcgagaaagagactgctaagaagtagaggcattagctcggccagtgctctagagttgggtaaaatgtaaatgttatggcggggagaaggatggggtagagggtatgcatgtatggggaatgggaccattatttagcagcaaaaaggaaagttt

SEQ ID NO: 6194 - DNA, 168 bp, Homo sapiens
  misc_feature 92, 137: n = A,T,C or G
ctggcaactgaaggctggaacacttgctactggataatcgtagcttttaatgttgcgcctcttcaggttcttaagggattctccgttttggntccattttgtacacgtttggaaaataatctgcagaaacgagctgngcttgcaaagacttcatagttcccaagaatt

SEQ ID NO: 6195 - DNA, 143 bp, Homo sapiens
tgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagatta

SEQ ID NO: 6196 - DNA, 130 bp, Homo sapiens
  misc_feature 21, 23: n = A,T,C or G
cccacagcttcacgtggtggngngcagtgtgaggcagctccttggctttcctggttttcacaacaagctagagattttcaaagctacacttttgagtaaaaacccttattaaaagaaaaacatgattaat

SEQ ID NO: 6197 - DNA, 400 bp, Homo sapiens
  misc_feature 59, 110, 157, 180, 188, 220, 312, 376: n = A,T,C or G
tgcgcgcctgcaggtcgacactagtggatccaaagaattcttacgagctgacagctggngcgcctgcccgggaacatcctcctggactcaatcatggcttgtggtctggncgccagcaacctgaatctcaaacctggagagtgccttcgagtgcgangcgaggtggctcctgacgctaanagcttcgngctgaacctgggcaaagacagcaacaacctgngcctgcacttcaaccctcgcttcaacgcccacggcgacgccaacaccatcgtgtgcaacagcaaggacggcggggcctgggggaccgagcancgggaggctgtctttcccttccagcctggaagtgttgaagaaggtgtgcatcaccttcgaccangccaacctgaccgtcaagctgcca

SEQ ID NO: 6198 - DNA, 324 bp, Homo sapiens
ggcgcgcaaattacccactcccgacccggggaggtagtgacgaaaaataacaatacaggactctttcgaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtt

SEQ ID NO: 6199 - DNA, 398 bp, Homo sapiens
  misc_feature 4, 5, 27, 28, 30, 31, 61, 92, 95, 97, 106, 167, 200, 206,248: n = A,T,C or G
gccnnactagtggatccaaagaattcnntnngagcgacagcacccatttgctttctgcttntggggacaaaacttccaagatttgggacgtnagngngaactccgnggtcagcacatttcccatgggctccacggttctggaccagcagctgggctgcctatggcanaaggaccacctgctcagtgtctccctgtccggntacatnaactatctggacagaaacaaccccagcaagcccctgcacgtnatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacg

SEQ ID NO: 6200 - DNA, 229 bp, Homo sapiens
  misc_feature 109: n = A,T,C or G
gtgaagtgagaccttccttttacttttcttctattgcctctgagagcatcaggcctagaggcctgactgccaagccatgggtagcctgggtgtaaaacctggagatggnggatgatccccacgccacagcccttttgtctctgcaaactgccttcttcggaaagaagaaggtgggaggatgtgaattgttagtttctgagttttaccaaataaagtagaatataagaag

SEQ ID NO: 6201 - DNA, 325 bp, Homo sapiens
  misc_feature 4, 12, 15, 112, 191, 222: n = A,T,C or G
aggncatgaagnttntttgcatttttatttaaatgaaggaattccaaataactcacctacagatttttagcacaaaaatagccattgtaaagtgttaaaatttacgataagnattctattggggaggaaaggtaactctgatctcagttacagtttttttttcctttttaatttcattattttgggttttnggtttttgcagtcctatttatctgcagtcgnattaagtcctattgctagaataggttactacaaaaaaggttatattctgaaagaaaaataactgacattatatataaccaattaatttaaagtattgccattt

SEQ ID NO: 6202 - DNA, 350 bp, Homo sapiens
  misc_feature 80, 154, 183, 255: n = A,T,C or G
ctgctattatctgctctccgcgcctgacccctcccaggactcgtgatgccaaggccgctgcgagcggctacgaagagtcngggttgagccccagctgagccgagggctcgcactcttctggtctcccaggcccaacccacctgaagaaatgagnggtggattggctccaagtaagagcacagngtatgtatccaacttgcctttttccctgacaaacaatgacttgtaccggatattttccaagtatggcaaagntgtaaaggttaccatcatgaaagataaagataccaggaagagtaaaggggttgcatttattttatttttggataaagactctgcacaaaactgta

SEQ ID NO: 6203 - DNA, 204 bp, Homo sapiens
  misc_feature 6, 80, 85: n = A,T,C or G
ctccgnaccagctggacccggccaacatcacgctggaacccatggaaatccgcactttcctggcctcagttcaatggaangaggnggatggttaggtctgctgggatgggccctccaagcccaagcctcctgctccgggggcagaccagactctgactctcctcttggggctgctgccattaaaacgctactactaagactcag

SEQ ID NO: 6204 - DNA, 319 bp, Homo sapiens
  misc_feature 26, 286: n = A,T,C or G
agcagatccgcatgtcccttcgcggnaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctnctttttccaggctttaggtatcaccactaaaat

SEQ ID NO: 6205 - DNA, 317 bp, Homo sapiens
ctaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagg

SEQ ID NO: 6206 - DNA, 164 bp, Homo sapiens
gtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccgg

SEQ ID NO: 6207 - DNA, 393 bp, Homo sapiens
  misc_feature 6, 20, 115, 138, 182, 345: n = A,T,C or G
ggcatngctgctggaggcgnaatggacgttaatactgctttacaagaggttctgaagactgccctcatccacgatggcctagcacgtggaattcgcgaagctgccaaagccttanacaagcgccaagcccatctttgngtgcttgcatccaactgtgatgagcctatgtatgtcaagttggnggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcangccaaggatgtcattgaagagtatttcaaatgcaagaaatgaagaaat

SEQ ID NO: 6208 - DNA, 400 bp, Homo sapiens
  misc_feature 17, 41, 54, 157, 382: n = A,T,C or G
tgcgcgcctgcaggtcnacactagtggatccaaagaattcnttacgagcgcggncgtcgggtgtgagctgcgccgaccgctctgagggttcgtggcccaccgctccttcgcggtccctgccgccaccgtccacgctcagcgttgtagagaagatggngggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttgntgaagagttactagctca

SEQ ID NO: 6209 - DNA, 351 bp, Homo sapiens
  misc_feature 67, 166, 322: n = A,T,C or G
ctgattttccctacaaagatgacctcctggccttggactccagctgcctcctgttcattgttcttgngttctttgccttattcatcatttttaaggcttatctaattaactgtgtttggaactgctataaatacatcaacaaccgaaacgtgccggagattgctgngtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgntacagaatgctgcaattcagggctcttca

SEQ ID NO: 6210 - DNA, 190 bp, Homo sapiens
  misc_feature 21, 104, 130: n = A,T,C or G
tcttgatgggtttctgttagncatgtattttgctaataatttccctagtttgtagtttgccacttagtgctatttttgacataaatgatgtattttaatgtagntgcatgttgacctagtccattatggnttttgtatttggtccacgtggattggaaaacctttgctttgattatacttttctttgggc

SEQ ID NO: 6211 - DNA, 128 bp, Homo sapiens
gatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 6212 - DNA, 330 bp, Homo sapiens
  misc_feature 112: n = A,T,C or G
ggtcccccaagtcccgagatgaggtcaatgtggaaaacaggcagaagcttcgggttgatgagctgcggagagaatattacgaggaacaaaggaatgaatttgagaacttcgnggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcag

SEQ ID NO: 6213 - DNA, 298 bp, Homo sapiens
ggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactgg

SEQ ID NO: 6214 - DNA, 109 bp, Homo sapiens
  misc_feature 2, 52, 62, 63, 66, 77, 90, 106: n = A,T,C or G
tngcgcgcctgcaggcccgacactagtggatccaaagaattctgtacgaggncggacagcgnncgncccccatgctncactcccacgctntcatctgcaggcctgnctt

SEQ ID NO: 6215 - DNA, 136 bp, Homo sapiens
  misc_feature 62: n = A,T,C or G
cggagtccctgcaggccaacgtgcagcggctgaaggagtaccgctccaaactcatcctcttncccaggaagccctcggcccccaagaagggagacagttctgctgaagaactgaaactggccacccagctgaccgg

SEQ ID NO: 6216 - DNA, 329 bp, Homo sapiens
  misc_feature 194: n = A,T,C or G
gagaaagacagagagactgagagagactgccttgggaaggggaagctcttctcatttcagctctttaaaaataaaaaggaatgtgggtaccatgcttgcatttacacactgattatgcagacagtctctcatttacgtttcatctctgagagtggcctattcatagccagactgttttacattacacaatcagncaattatcacatgatcaagtcacatcaagacaatctgaaaattacatttctactgggcaatatctcgagagtacttctagagcggccgcgggcccatcgattttccacccgggtggggtaccagggtaagtgtac

SEQ ID NO: 6217 - DNA, 153 bp, Homo sapiens
  misc_feature 51, 152: n = A,T,C or G
gatgcatttatcttaataaaatgctaaatgtcaatttatcactgcgcatgnttgactttagactgtaaatagagatcagattgtttctttctgtgctgggaacaatgagcgtcgcacagacatggtttcaggtaaataaatctattctatgnt

SEQ ID NO: 6218 - DNA, 134 bp, Homo sapiens
  misc_feature 14, 68, 116, 126, 127: n = A,T,C or G
tggaattgcctcanagtctgctgtggatccccatgaaatgaaatcactttgctttaatcacacttcangtttcaggtaatacatagattggtgaatgaaataaaataagcagtttnttagcattgnntttcttt

SEQ ID NO: 6219 - DNA, 242 bp, Homo sapiens
  misc_feature 191, 218, 229: n = A,T,C or G
cccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccacccnactcttaatcagtggtggaagaacggnctcacaactgngtggttgaattgg

SEQ ID NO: 6220 - DNA, 125 bp, Homo sapiens
cccaggagctgctcagggtgctgcgggcccaacctgtgcaggtggcagaaggcagcgagccagatggcttctgggaggccctgggcgggaaggctgcctaccgcacatccccacgggtgaaggac

SEQ ID NO: 6221 - DNA, 273 bp, Homo sapiens
ccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaag

SEQ ID NO: 6222 - DNA, 246 bp, Homo sapiens
  misc_feature 43, 97, 125, 157, 210, 218, 222: n = A,T,C or G
caagactgttatcgagtaccggtcacagaagacctcacgcctncccatcattgacattgcacccatggacataggagggcccgagcaggaattcggngtggacatagggccggtctgcttcttgnaaaaacctgaacccagaaacaacacaatccgntgcaaacccaaaggacccaagtactttccaatctcagtcactctaggactctnggcgactngganatgggcttgacctggacctggatt

SEQ ID NO: 6223 - DNA, 149 bp, Homo sapiens
gtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttt

SEQ ID NO: 6224 - DNA, 202 bp, Homo sapiens
cagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtt

SEQ ID NO: 6225 - DNA, 110 bp, Homo sapiens
  misc_feature 35, 41: n = A,T,C or G
cgcgcgcctgcaggtcgacactagtggatccaaanaattcngcacgagttccacggtgctaggctgagatggatcctctcagggcccaacagctggctgcggagctggag

SEQ ID NO: 6226 - DNA, 113 bp, Homo sapiens
  misc_feature 17: n = A,T,C or G
aaaagattgatcgccgntctggtaaaaagctggaagatggccctaaattcttgaagtctggtgatgctgccattgttgatatggttcctggcaagcccatgtgtgttgagagc

SEQ ID NO: 6227 - DNA, 275 bp, Homo sapiens
  misc_feature 4, 10, 237, 258, 270: n = A,T,C or G
aaanctggantctcgcgcgcctgcaggtcgacactagtggatccaaagaattggcacgaggcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaatgnggttatgctgtttggacaatnaactcaccttgncctga

SEQ ID NO: 6228 - DNA, 208 bp, Homo sapiens
ctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaag

SEQ ID NO: 6229 - DNA, 135 bp, Homo sapiens
  misc_feature 10, 12, 124: n = A,T,C or G
aagaacttcngncgagaagtagttctttgaaagttaaagaaacttgaccaaaagacagtacaaaaacactggcacttgaatgttgaatgtcaccgtatgcgtgaaattatatatttcggggtantgtgagctttt

SEQ ID NO: 6230 - DNA, 106 bp, Homo sapiens
  misc_feature 10, 12, 60, 72, 74, 78, 79, 83, 89, 94: n = A,T,C or G
aagaatttcngncgagctgataggctggtgcagcctgccagggaaagttctactggactnaatactggcttngnggtnngganagccancaacntgaatcttaaac

SEQ ID NO: 6231 - DNA, 142 bp, Homo sapiens
  misc_feature 15, 17, 40, 55, 105, 117, 118: n = A,T,C or G
cgcgcgcctgcaggncnacactagtggatccaaagaattntgcacgagtcttggnaaatacggcatcatctgcatggaggatttgattcatgagatctatactgntggaaaacgctnnaaagaggcaaataactggcctgtg

SEQ ID NO: 6232 - DNA, 107 bp, Homo sapiens
  misc_feature 103: n = A,T,C or G
gttggggtgaggccctcacttcatccggcgactagcaccgcgtccggcagcgccagccctacactcgcccgcgccatggcctctgtctccgagctcgcctgcntcta

SEQ ID NO: 6233 - DNA, 112 bp, Homo sapiens
  misc_feature 17, 25, 26, 27, 29, 50, 51, 67, 70, 72, 88, 90, 94, 97, 98,103, 104, 106: n = A,T,C or G
ggggggttcaaaaaaancccaggtnnntncgccggcgccgcccctaggcnnaaggcccgggaccacnggngnggggcgacccccaaananaaanttnnggggnnanaggaag

SEQ ID NO: 6234 - DNA, 100 bp, Homo sapiens
  misc_feature 2, 11, 28, 41, 45, 53, 59, 61, 62, 90: n = A,T,C or G
anaacctggtnttttcgcggcgcctgcngtccgacactgantggntcccaaanaattcngnncggagttggaaatgacgatatccacagntttcaggaat

SEQ ID NO: 6235 - DNA, 131 bp, Homo sapiens
  misc_feature 13, 16, 33, 38, 42, 64, 115, 118: n = A,T,C or G
aagaatttcttgnacnatggtcgcacgcgtganacttntccnccgcctccgccgcagacgccgncgcgatgcgctacgtcgcctcctacctgctggctgccctagggggcaactnctnccccagcgccaag

SEQ ID NO: 6236 - DNA, 150 bp, Homo sapiens
  misc_feature 43, 44, 87, 141: n = A,T,C or G
ttcgcgcgcctgcaggtccgacactagtggatccaaagaattnngcacgaggtaaacgcaaacagggtttgatagcacttaaactanttcatttcaaaattaagctttaaaataatgcgcaatttcatgttatgccttaantccaaaaag

SEQ ID NO: 6237 - DNA, 209 bp, Homo sapiens
  misc_feature 9, 14, 51, 66, 119, 155, 170, 193: n = A,T,C or G
aagaattcngcacnatggcctgcacccagggggaagcacggacccgagacnacggcgatgaggaanggctcctgacacacagcgaggaagagctggaacacagccaggacacagacgcngatgatggggccttgcagtaagcagcctgacaggancaatggccaccagcnggtgaagggcatcgctgccccangcctcaagccgggcac

SEQ ID NO: 6238 - DNA, 101 bp, Homo sapiens
  misc_feature 1, 14, 30, 55, 90: n = A,T,C or G
naaaaacctggttntcgcgcgcctgcaggncgacactagtggatccaaacaattntgcacgagatggaacgaattcaggaatcctgagtnttcaacaacta

SEQ ID NO: 6239 - DNA, 100 bp, Homo sapiens
  misc_feature 3, 55: n = A,T,C or G
cgngccgcctgcaggtccgacactagtggatccaaagaattctgcacgagcaatntgaatttgaatgatcatagctatatgtcacataatagaatactct

SEQ ID NO: 6240 - DNA, 175 bp, Homo sapiens
aaaacacaagtgccttctccacggtgcaattcagacttcagtgatctccagtggtcaaaagacatttacccttaatatcatgacaacatttatattttagtgaagaaacaagttctcgggtggggaatctatgtttcactcagatttatatgtttggaggaaaaaagcctttttt

SEQ ID NO: 6241 - DNA, 119 bp, Homo sapiens
  misc_feature 67, 73, 83: n = A,T,C or G
tgggggaacaaaaacctggtttttcgcgcgccctgcaggtccgacactagtgggatccaaagaattntgcacnaggccgaggnaaggcattgctgctggaggtgtaatggacgttaata

SEQ ID NO: 6242 - DNA, 108 bp, Homo sapiens
  misc_feature 6, 34, 42, 64, 77, 87: n = A,T,C or G
agaaangggaggttttttgggggggacaaaaaancctggttntctccgccgccgccctgcaggnccggacactgagngggacccaanagaattcgggcacggagcaca

SEQ ID NO: 6243 - DNA, 170 bp, Homo sapiens
  misc_feature 60, 145, 154: n = A,T,C or G
caccaaggtggcttctccttggctgagagatggaaggcgtggtgggatttgctcctgggntccctaggccctagtgagggcagaagagaaaccatcctctcccttcttacaccgtgaggccaagatcccctcaaaaggcaggagngctgccctntgccatggtgcccgtg

SEQ ID NO: 6244 - DNA, 100 bp, Homo sapiens
  misc_feature 6, 16, 29, 32, 38, 44, 46, 51, 58, 71, 74, 88, 98: n = A,T,C or G
actttnacttgcgcantccacagagaggnaantttttnacaacngnagccncctcctncccatgcgggagnaangcgcgggccttcangaggagcccnac

SEQ ID NO: 6245 - DNA, 100 bp, Homo sapiens
  misc_feature 2, 28, 44, 55, 56, 57, 75, 76, 82, 91: n = A,T,C or G
tntcgcgcgcctgcaggtcgacactagnggcatccaaacaattntgcacgagggnnngggctgccaaaaccaggnnaacctnctacatggntcatgactc

SEQ ID NO: 6246 - DNA, 282 bp, Homo sapiens
  misc_feature 235, 270, 273: n = A,T,C or G
gtaagaccctgtctcaaaaaaataaataattatcataataataaaaatcaatttctcaatgcattatctcatttaatccccaaaacaatcctataactaaagtgtcttcacctcactttatagaaggcaaaattactaagaatggcgatacttagtaatttgcccaagaaagtaaaaaggctgagattcaaatccaatcatcctgacaccagcttttcttatctatttgttaagngacaattacctcattgtgaattattattgcaggtntantttaattat

SEQ ID NO: 6247 - DNA, 128 bp, Homo sapiens
  misc_feature 4, 7, 36, 121: n = A,T,C or G
cgcntgnaggtccccactagtggatccaaagaattntgcacgagcaactacacaggagatttctcagcctacaaattgtgtctatacatttctaagccttgtgttgcagaataaacagggnatttagc

SEQ ID NO: 6248 - DNA, 235 bp, Homo sapiens
  misc_feature 100, 107, 170: n = A,T,C or G
ccaaggtgggcggatcgcctgaggtcaggagtttgagaccagcctggccaacatggtgaacccccatctcttaaaaatataaaaattagctgggcatggnggcaggngcctgtaatcccagctactcaggaggctgaggcacgagagtcgctttgaacccgggaggtggnggttacagtaagctgagatcttcccactgcactccagcctgagcgacagagtgagactccatctc

SEQ ID NO: 6249 - DNA, 246 bp, Homo sapiens
  misc_feature 17, 35, 179, 233: n = A,T,C or G
gatacaagggaacgtantcgtttggaaagcgtcgnagtaagacgcacacgttgtgccgccgctgtggctctaaggcctaccaccttcagaagtcgacctgtggcaaatgtggctaccctgccaagcgcaagagaaagtataactggagtgccaaggctaaaagacgaaataccacccgnaactgggcgaatgaggcacctaaaaattgtataccgcagattcaggcatggatncctgggaaggaac

SEQ ID NO: 6250 - DNA, 205 bp, Homo sapiens
  misc_feature 8, 12: n = A,T,C or G
ctttgtgnctcnaagaatttcggcacgatgctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgg

SEQ ID NO: 6251 - DNA, 118 bp, Homo sapiens
  misc_feature 2, 16, 44: n = A,T,C or G
tncgcgccccctgcantgcgacactagtggatccaaaaaatttngcacgaggcccctcacccgattggggacatgggtgcacgtgagtgggggcagcgaatgttgctgtggacagagg

SEQ ID NO: 6252 - DNA, 123 bp, Homo sapiens
  misc_feature 4, 5: n = A,T,C or G
gcgnnactagtggatccaaaaaatttggcacgagctaagtacctcacggcatcactgaaagatgagtattattagttggaattttagggatgagaaaactgaccctcaggggagaataactga

SEQ ID NO: 6253 - DNA, 273 bp, Homo sapiens
  misc_feature 3, 15, 50, 175, 187, 194, 231, 238, 244: n = A,T,C or G
cgngcgcctgcaggncgacactagtggatccaaagaattttgcacgagcnagacaaaaaacaaacaaacaaacaaacaaaaaaacaactctgtcaggtggaaggaacgtgaaacgtgttaacccatgaaaaacagaagcaggccagaaggaagccagctagaatctagggtttanaatgcgagcagngcctgtnaatctacccttcagttctagatttgagaaaagtagtnaaccacnacaccnatggacaatgaggcaggaccaacagaaac

SEQ ID NO: 6254 - DNA, 195 bp, Homo sapiens
  misc_feature 180, 193, 195: n = A,T,C or G
gtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgggttgcttaaatatcaagtattgnttataacccccgnan

SEQ ID NO: 6255 - DNA, 202 bp, Homo sapiens
  misc_feature 147: n = A,T,C or G
cttcaggggatgattaaaccatcctttattatagcctgagtctagtctaagggaagaaggtcattctctataccagtgaaggctccatccaaaccagtgtttgggggcatagtcataattgaaaaatgattgttttccttatctgtnagacaggtaaatggtattaatcctcaggtggttgtgaggattaagtgatacatgt

SEQ ID NO: 6256 - DNA, 187 bp, Homo sapiens
  misc_feature 25, 158, 159, 168: n = A,T,C or G
cagatacttgaagaatgttgatggngctagaagaatttgagaagaaatactcctgtattgagttgtatcgtgtggtgtattttttaaaaaatttgatttagcattcatattttccatcttattcccaattaaaagtatgcagattatttgcccaaagnngtcctcttnttcagattcagcatttgtt

SEQ ID NO: 6257 - DNA, 100 bp, Homo sapiens
  misc_feature 2, 9, 80, 90, 92, 93: n = A,T,C or G
cnatgcacngcgacactagtggatccaaaggaatttggcacgagctggaaatgcaaatgaggctgtcaatggggtaaganaaatgagggntnntaaacac

SEQ ID NO: 6258 - DNA, 259 bp, Homo sapiens
  misc_feature 9, 150, 179, 191, 212, 223, 226, 245: n = A,T,C or G
gcgcaggtncaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtnatgaccattccgtaccagcccatgccggncagctgcccatncatctgcggcgggcggccaanatcgggtgcangtnacgctggggggctaccccncatgccacccatga

SEQ ID NO: 6259 - DNA, 214 bp, Homo sapiens
tcgcgcgcctgcaggccgacactagtggatccaaagaatttggcacgagcgtggccctccaggaagaggtcccaacggtttgcctggagctataggtctcccaggtgacccaggccctgccagctatggcagaaatggccgagacggcgagcgaggccccccaggggtggcaggaattcctggagtgcctggacccccgggacctcctgggctt

SEQ ID NO: 6260 - DNA, 111 bp, Homo sapiens
  misc_feature 14, 43: n = A,T,C or G
tcgcgcgcctgcangtccgacactagtggatccaaagaatttngcacgagcccttatgacatgttggaaagcatcaggaaagaggttaaaggagacctggaaaatgctttc

SEQ ID NO: 6261 - DNA, 149 bp, Homo sapiens
  misc_feature 3, 4, 34, 114, 130: n = A,T,C or G
ctnnactgcgacactagtggatccaaagaatttngcacgagctcactcctgtaatcccaacactttgggaggccgaagtagacggatcacttgaggtcaggagttcgagaccantctggccaacatggtngaaaccccctctctactac

SEQ ID NO: 6262 - DNA, 139 bp, Homo sapiens
  misc_feature 77, 80: n = A,T,C or G
caaaaaactctgtttctgcaggggatgatattggtgagttgccaaagaagcaatacagcatatctgcttttgccttntgntgtttatcttacctgcagatattaagaatgtatgcattatgtaaaatgctcaattgtat

SEQ ID NO: 6263 - DNA, 177 bp, Homo sapiens
  misc_feature 155, 157: n = A,T,C or G
gctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccaggatctngnggagaattttgatgaggctt

SEQ ID NO: 6264 - DNA, 104 bp, Homo sapiens
  misc_feature 3, 51, 56, 83: n = A,T,C or G
acngcgacatctagtggatccaaagaattttgcacgagcctttcttgcttncagcnagtacccaaagcatctgtggcagtcgnaaagaaataatacattctagc

SEQ ID NO: 6265 - DNA, 106 bp, Homo sapiens
aatgaagactattctcagcaatcagactgtcgacattccagaaaatgtcgacattactctgaagggacgcacagttatcgtgaagggccccagaggaaccctgcgg

SEQ ID NO: 6266 - DNA, 100 bp, Homo sapiens
agccattacagtatccaatgtcttttgacaggtgcctgtccttgaaaaacaaagtttctatttttatttttaattgggtgagttcttaactgctggccca

SEQ ID NO: 6267 - DNA, 109 bp, Homo sapiens
  misc_feature 5, 7, 82: n = A,T,C or G
cgtcnangcgctgaaaaaactaacaagaataaaaaactggtcaagaagctggccaacaagtatgatgcgtttttggcctganagtctctgatcaaggcaggatgccacg

SEQ ID NO: 6268 - DNA, 101 bp, Homo sapiens
  misc_feature 85, 88, 97: n = A,T,C or G
tacttctagagcggccgcgggcccatcgattttccacccgggtggggtaccaggtaagtgtacccaattcgccctatagtgagtngtnttacaattnactg

SEQ ID NO: 6269 - DNA, 226 bp, Homo sapiens
  misc_feature 56, 128, 131, 204: n = A,T,C or G
ccacaaagtgaccaagaacgtgagcaagcccaggcacagccgacgccgcgggcgtntgaccaaacacaccaagttcgtgcgggacatgattcgggaggtgtgtggctttgccccgtacgagcggcgcnccntggagttactgaaggtctccaaggacaaacgggccctcaaatttatcaagaaaagggtggggacgcacatccncgccaagaggaagcgggaggag

SEQ ID NO: 6270 - DNA, 103 bp, Homo sapiens
  misc_feature 56: n = A,T,C or G
ctcccgcaaagaagggtggcagagtaagaaaaagggccgttctgccatcaacgaantggtaacccgagaatacaccatcaacattcacaagcgcatgcatgga

SEQ ID NO: 6271 - DNA, 173 bp, Homo sapiens
  misc_feature 83, 100, 159, 170, 172: n = A,T,C or G
gctaaccacccagcttgctcagagatctcatattgaagcaacatacaggcaatccacatctttctttccctttgaagtatagncacttggatgggatganggacagggcctgttgggttcacagggccttgcactgcatgggcacatacttaaaagctnttgtgcatggnant

SEQ ID NO: 6272 - DNA, 102 bp, Homo sapiens
  misc_feature 9, 10, 32, 83, 99: n = A,T,C or G
gcttaggcnngcggggcaccctgcagtggcanggactcggcaccgcgccctccaccgccggttggtggcctgcgtgacagttncctcccgtcgacatcnaaa

SEQ ID NO: 6273 - DNA, 100 bp, Homo sapiens
  misc_feature 44, 94, 98: n = A,T,C or G
cgcgcgcctgcaggtcgacactagtggatccaaacaattctgcncgagggactacaatggccacgtcggtctgggtgttaagtgcttgcaaggnaggngg

SEQ ID NO: 6274 - DNA, 118 bp, Homo sapiens
  misc_feature 116: n = A,T,C or G
cagttccagcccctcgctgctgggggcgcaaccaccccttccttaggttgatgtgcttgggaaagctccctccccctccttccccaagagaggaaataaaagccaccttcgccctngg

SEQ ID NO: 6275 - DNA, 116 bp, Homo sapiens
  misc_feature 5, 12, 33, 93: n = A,T,C or G
gcgcntgcaggnccgacactagtggatccaaanaattctgcacgaggctgctaccacccttttcaattgctatcttttgaaaggcaccagatntgtgttttagattgatttccctg

SEQ ID NO: 6276 - DNA, 100 bp, Homo sapiens
  misc_feature 50: n = A,T,C or G
gcaagatcctgtacagccagtgtggggacgtgatgagggccctgggccanaaccccaccaacgccgaggtgctcaaggtcctggggaaccccaaaagtga

SEQ ID NO: 6277 - DNA, 146 bp, Homo sapiens
  misc_feature 4, 24, 45: n = A,T,C or G
cacnttgtgactccaagaatttcngcacgatgaaggatggaatgnaaaacaacgctgcatatacaggtaccactttaggaaataccgatgcctttgtgggggcaggaatcacatggcaaaagctttgaaaatcataaagatataag

SEQ ID NO: 6278 - DNA, 109 bp, Homo sapiens
  misc_feature 3, 4: n = A,T,C or G
aanntccggagcccagagggcagccgcaagaaccccgcccgcacctgccgtgacctcaagatgtgccacctctgactggaagagtggagagtactggattgaccccaac

SEQ ID NO: 6279 - DNA, 100 bp, Homo sapiens
  misc_feature 2, 11, 45: n = A,T,C or G
gnccacacttntggatccaagaattctgcacgagcccaaatgttnggaaacagtataatttgacaaagaaaaatgatacttctctttttttgctgttcca

SEQ ID NO: 6280 - DNA, 101 bp, Homo sapiens
  misc_feature 46, 62, 84: n = A,T,C or G
atttcgcactgtattaaatgtaacttatttaatgaaatcagaagcngtagacagatgttggngcaatacaaatattgtgatgcntttatcttaataaaatg

SEQ ID NO: 6281 - DNA, 117 bp, Homo sapiens
  misc_feature 106, 111: n = A,T,C or G
ccctaatgaagtggtttaactcagtaaataaggaattataaaaacaattcttataagttatgtagtgttttttttctgttgcaaacactaacattttaatgtgatnacatncattac

SEQ ID NO: 6282 - DNA, 153 bp, Homo sapiens
ctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatt

SEQ ID NO: 6283 - DNA, 105 bp, Homo sapiens
  misc_feature 40, 55: n = A,T,C or G
cgcgcgcctgcaggtcgacactagtggatccaaagaattntgcacgagcggaggngcaggtcctggtgcttgatggtcgaggccatctcctgggccgcctggcgg

SEQ ID NO: 6284 - DNA, 121 bp, Homo sapiens
  misc_feature 2, 18, 60, 86, 96, 102, 105: n = A,T,C or G
tnggggaaaaactggttntcgcgcgcctgcaggtcgacactagtgggatccaaaaaattntgcacgagcttctgacagctggtgcncctgcccggnaacatnctnctggactcaatcatgg

SEQ ID NO: 6285 - DNA, 163 bp, Homo sapiens
  misc_feature 152: n = A,T,C or G
gaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttntggtgctaatg

SEQ ID NO: 6286 - DNA, 156 bp, Homo sapiens
  misc_feature 3, 8, 33, 34: n = A,T,C or G
aanctgcnacactagtggatccaaagaattttnnacgagcggaaaacagctggaagatggtcgtaccctgtctgactacaacatccagaaagagtccaccttgcacctggtgctcccgtctcagaggtgggatgcaagatcttcgtgaagaccctg

SEQ ID NO: 6287 - DNA, 236 bp, Homo sapiens
  misc_feature 2, 11: n = A,T,C or G
gnacaatgctnaaacccacaaacacttagttaacatgctaagcaccctaataaactggcttcaatctacttctcccgccgccgggaaaaaaggcgggagaagccccggcaggtttgaagctgcttcttcgaatttgcaattcaatatgaaaatcacctcggagctggtaaaaagaggcctaacccctgtctttagatttacagaccaatgcttcactcagccatttttacctcacc

SEQ ID NO: 6288 - DNA, 206 bp, Homo sapiens
  misc_feature 192, 204: n = A,T,C or G
tccaattagtctgaaaagggtactttggaattgtcccatattaatctgagatggcaaaagaaaaagttctcatattaccaggttgattttgtgtctcatttcaaattttaatttaaaattatggttttcatttttgtttaccttaaagtgatgcttaaaagtggcatgtaattaaggacacttaggtttgtngaaagcattttnga

SEQ ID NO: 6289 - DNA, 125 bp, Homo sapiens
cagaatcacatggcaaaagctttgaaaatcataaagatataagttggtgtggctaagatggaaacagggctgattcttgattcccaattctcaactctccttttcctatttgaatttctttggtg

SEQ ID NO: 6290 - DNA, 147 bp, Homo sapiens
  misc_feature 1, 16, 32, 79, 83, 140: n = A,T,C or G
naaaaaaacctggttntcgcgcgcctgcaggncgacactagtggatccaaaaaattttgcacgaggaggaaaccagggngacngaggagacaaaggcgcggcaggagcagggctggacgggcctgaaggagaccaggggnccccaag

SEQ ID NO: 6291 - DNA, 255 bp, Homo sapiens
  misc_feature 199, 250: n = A,T,C or G
gaacattttcatcatcccaaaaggaaaccctatactcattacgcagtcactccccagtcttcctcctcccagccccagcaaccactcatctattttctgtctctatagatttgtctattctgatggaaatgtacaatatgtgcccttttgtgtctggcttttttcacttagcatgttttcaaggtttgtccatgttgtnccatgtattggcacactgttactttttatggccaaataaatattacactgngcgat

SEQ ID NO: 6292 - DNA, 147 bp, Homo sapiens
gtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 6293 - DNA, 216 bp, Homo sapiens
  misc_feature 11, 15, 29, 53, 120, 132: n = A,T,C or G
cgcgcctgcangtcnacactatgtggatncaaagaattctgcacgagccctgngcttcctggaaggcctggccctcctggtccccccggccctcctggagagaatggtttcccaggccanatgggaattcgnggccttccgggcattaaggggccccctggtgctcttggtttgaggggacctaaaggtgacttgggaaaaaagggggagcgtggc

SEQ ID NO: 6294 - DNA, 164 bp, Homo sapiens
  misc_feature 150, 151: n = A,T,C or G
cgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggnntttagccatgcac

SEQ ID NO: 6295 - DNA, 128 bp, Homo sapiens
  misc_feature 44, 48: n = A,T,C or G
ggatgcagtgctcgctgttgctgaataggcgatcacaacgtgcnttgngcttctttctttgggaatatttgaatcttgtctcaatgctcataacggatcagaaatacagattttgatagcaaagcgac

SEQ ID NO: 6296 - DNA, 100 bp, Homo sapiens
  misc_feature 33, 59, 68: n = A,T,C or G
ggaattcttttgaagctcagccccaggcctggnggtttccgttccttcctcaccctgtntcaagcatncctgctcttctcccctccaggctcccctgggt

SEQ ID NO: 6297 - DNA, 112 bp, Homo sapiens
  misc_feature 40, 41, 46, 96: n = A,T,C or G
cgcgcgcctgcaggtcgacactagtggatccaaagaattnngcacnaggtcgcggcgacatggccaaacgtaccaagaaagtcgggatcgtcggtnaatacgggacccgcta

SEQ ID NO: 6298 - DNA, 181 bp, Homo sapiens
cgttgtggctccaagaatttcggccgatgagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcct

SEQ ID NO: 6299 - DNA, 115 bp, Homo sapiens
  misc_feature 24: n = A,T,C or G
cagatgtcgaaacgaggacgtggngggtcctctggtgcgaaattccggatttccttgggtcttccggtaggagctgtaatcaattgtgctgacaacacaggagccaaaaacctgt

SEQ ID NO: 6300 - DNA, 182 bp, Homo sapiens
ccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaag

SEQ ID NO: 6301 - DNA, 180 bp, Homo sapiens
  misc_feature 32, 140, 146: n = A,T,C or G
atccagggcctccggataatgtgaagctgagngagcctccgccatccagcatgacaaactgtggccgaccgcagctgtgccgtggcacgatggcgaggaagccagccccaaggaaacactgaaaacacatatcacgccantgccgngtggttttgtttgaatataaaattggggaaagtg

SEQ ID NO: 6302 - DNA, 141 bp, Homo sapiens
  misc_feature 38, 58, 63, 64, 65, 122, 124: n = A,T,C or G
tgcgcgcgcctgcaggtccgacactagtggacccaaanaattttgcacgaggctgggngctgnnntccagttcaggtgaattagcctcaatcccccgtgttcacttggctcccatagccctntngatggatcacgtgaaac

SEQ ID NO: 6303 - DNA, 201 bp, Homo sapiens
  misc_feature 8, 17, 25, 27, 32, 42, 45, 49, 53, 69, 79, 108, 156, 164,191: n = A,T,C or G
gtgactcnaagaatttngcacgagntnttgcnaaattgaaanagnttcnaaanaatcccgcgatgcatncatagaacanggcgtgagaaattgggaaccctcactctnatttctgctttccttaacctgctgtagcgacctgacatgcaggcgttnaaccattnaccctgtgctacccagaaaggaagccnctggccacag

SEQ ID NO: 6304 - DNA, 231 bp, Homo sapiens
  misc_feature 89, 201, 211: n = A,T,C or G
tgcgcacacgagaacatgcctctcgcaaaggatctccttcatccctctccagaagaggagaagaggaaacacaagaagaaacgcctggngcagagccccaattcctacttcatggatgtgaaatgcccaggatgctataaaatcaccacggtctttagccatgcacaaacggtagttttgtgtgttggctgctccactgtnctgtgccagnctacaggaggaaaagcaagg

SEQ ID NO: 6305 - DNA, 191 bp, Homo sapiens
  misc_feature 125, 136, 142, 161, 175: n = A,T,C or G
acagtgccgacttgcaaacggattggcctaatgaagaagttcaacctggagagatggaaaatcagctctcataactaagttaatttagtataaaaatagaattgatagtgagggtataaagtgtnaccatcaggtnaacctntcctgtcattcctagcttncttgcttgagaatngaaatggaaggggggg

SEQ ID NO: 6306 - DNA, 236 bp, Homo sapiens
  misc_feature 17, 30, 31, 41, 54, 65, 117, 130, 151, 219, 223, 232: n = A,T,C or G
cgcgcgcctgcaggtcnacacttgtggatnnaagaattctncacgaggtaaatngccatggcccngagccactgagtatgttcattgccacccctgtccctcccctgggcacccctnactttccctgatnctgcaattaaagggttaatgngtggcatatggaagggactcccaggaccctgtgcccagcttccatgctgactgatggttaaataatgngatngtctcctgncagg

SEQ ID NO: 6307 - DNA, 181 bp, Homo sapiens
  misc_feature 3, 18, 31, 41: n = A,T,C or G
tcncgcgcctgcaggccnacactagtggatncaaagaattntgcacgaggtgaaaaggaggaaggggttcccatgcgggggaggctctggggctgaggggaacaattctcacgtgtttggtgcttagagacctgcccggggcgttgggcaggccctccgggggctgaattaaaaatgcttt

SEQ ID NO: 6308 - DNA, 231 bp, Homo sapiens
  misc_feature 191, 206: n = A,T,C or G
gaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttanccagttgtatttgcnaaacaaggaaataaaggcttacttg

SEQ ID NO: 6309 - DNA, 124 bp, Homo sapiens
  misc_feature 2, 5, 48, 56, 62, 71, 78, 87, 94, 98, 116: n = A,T,C or G
tncgngcgcctgcaagtccgacactagtggatccaaagaattttggcncgagcttnaatcangccacatanccctcgnaggaacagncattctnatgncaaaccccctgaagctgnaccggcgc

SEQ ID NO: 6310 - DNA, 108 bp, Homo sapiens
  misc_feature 2, 15, 16, 17, 18, 20, 21, 29, 33, 34, 35, 41, 43, 44, 53,63, 68, 71, 80, 82, 90, 91, 96, 97, 100, 102, 103, 107: n = A,T,C or G
gntgagggggggagnnnngnnggaatttngggnnnggaccngnnagcgcgganagggcacccnagggngcnccagggaananccctcacnnatganngancnnacgna

SEQ ID NO: 6311 - DNA, 124 bp, Homo sapiens
  misc_feature 41, 60, 115: n = A,T,C or G
cgcgcgcctgcaggtcgacactagtggatccaaagaatttngcacgagcacaacccaagngggcctgggcagctgggatgggaagcagcccagttacttcatcatcttccatggnggacacatt

SEQ ID NO: 6312 - DNA, 282 bp, Homo sapiens
  misc_feature 5, 12, 74, 97, 142, 147, 233: n = A,T,C or G
aaaancctgganttcgcgcgcctgcaggtcgacactagtggatccaaagaattctgcacgagcggaccctgcanccgcacagatgttgatgcctaanaagaaccggattgccatttatgaactcctttttaaggagggagtnatggnggccaagaaggatgtccacatgcctaagcacccggagctggcagacaagaatgtgcccaaccttcatgtcatgaaggccatgcagnctctcaagtcccgaggctacgtgaaggaacagtttgcctggagacattt

SEQ ID NO: 6313 - DNA, 285 bp, Homo sapiens
  misc_feature 17, 33, 171: n = A,T,C or G
gatgtgaggttcacagntgtattccagtattcnagatagattcctgatttttcaattaggaaaagtaaaatccaaaatgttagcaaaacaaagtgcaatattaaatgtttgctttatagattatattctatggctgtttgtaatttctctttttttccttttttatttggngctgaatatgtccttgtaggctctgttttaagaaaacaatatgtgggaaatgatttaatttttcctattgctcttccttgtggaaaataaagtgttttgtttttttctgttttg

SEQ ID NO: 6314 - DNA, 148 bp, Homo sapiens
  misc_feature 12, 13, 18, 53, 124, 137: n = A,T,C or G
ctctttcttctnnaacantggatgacacaaaactatgagagtgacaaaatggngacaggtagctgggacctaggctatcttaccatgaaggttgttttgcttattgtatatttgtgtatgtagngtaactattttgnacaatagagga

SEQ ID NO: 6315 - DNA, 103 bp, Homo sapiens
  misc_feature 9, 18, 41, 49, 50, 64, 69, 77, 83, 87, 99: n = A,T,C or G
atccaaagnaattcttgnacgagcttttttgtcaactcttncttttatnnggatgatgaactgncgggnttgggggntctttntggnggggggtggggntggg

SEQ ID NO: 6316 - DNA, 155 bp, Homo sapiens
  misc_feature 6, 16, 39, 114, 141: n = A,T,C or G
tggtgngtccaagaanttctgcacgaggcttttaccagnacaaaatcccaattcactttattattttgcttcaggatccaagtgacaaagttatatatttataaaattgctatnaatcgacaaaatctaatgttggctttntaatgtgagtgatc

SEQ ID NO: 6317 - DNA, 149 bp, Homo sapiens
  misc_feature 13, 19, 27, 36, 38: n = A,T,C or G
ccttgaaggcccncacttngtggatcnaagaatttngncgaggccctgacccgcggtaacccgcgtgagctcgcccgccagaagaatatgaaaaagcagagcgactcggttaagggaaagcgccgagatgacgggctttctgctgccgc

SEQ ID NO: 6318 - DNA, 203 bp, Homo sapiens
  misc_feature 13, 20: n = A,T,C or G
cattgttcattgntattggnatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaat

SEQ ID NO: 6319 - DNA, 192 bp, Homo sapiens
  misc_feature 73: n = A,T,C or G
tggccccgccgcctggtactcaagcccgcggggacattgggaaggggacccccgccccctgccctcccctctntgcaccgtactgtggaaaagaaacacgcacttagtctctaaagagtttattttaagacgtgtttgtgtttgtgtgtgtttgttctttttattgaatctatttaagtaaaaaaaaaattg

SEQ ID NO: 6320 - DNA, 340 bp, Homo sapiens
  misc_feature 211, 233, 302, 323: n = A,T,C or G
ctgatctaaaaatgaaagcaaaatatcttatgtagaaatattttgataatatttttacagtgagctttcccatgtttttatgtcttaagtttccttgctgcgtttatgtaggttgcacaagaacttttactcacttgtaattgtgcctcagactttttgaaagtctaccttctaaattgccccgacgatctagattctacatgttaccatnggtttattcttgtgctttctgnatttaaaactttggctgtactaagcaaatgcaaggttataatttagctaatagtagtttacagacaatnctgatgattatgatttcattnggtttaactaagctgca

SEQ ID NO: 6321 - DNA, 190 bp, Homo sapiens
  misc_feature 76: n = A,T,C or G
cccaattggaccaatctatcaccctatagaagaactaatgttacgtataagtaacatgaaaacattctcctccgcntaagcctgcgtcagattaaaacactgaactgacaattaacagcccaatatctacaatcaaccaacaagtcattattaccctcactgtcaacccaacacaggcatgctcataagg

SEQ ID NO: 6322 - DNA, 292 bp, Homo sapiens
  misc_feature 190, 215, 259: n = A,T,C or G
gtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagngtgggacaatgtgaacatggactcnaagacatggccccttttctctgtagttgattttttaaatgtgcnattattgttttttaaaaaaaaagggaaaaaaga

SEQ ID NO: 6323 - DNA, 260 bp, Homo sapiens
  misc_feature 215: n = A,T,C or G
gtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctnaggaaattctacaagggcaagaagtacaagcccctggacctgcgg

SEQ ID NO: 6324 - DNA, 264 bp, Homo sapiens
  misc_feature 248, 250: n = A,T,C or G
aattgttttttattttttttaggatttgactataaggaaagaaattccagtatgcaacatgatagcagaaataaacaagctgtcagattttggaaatgaatatgaatttcattttctttggtcctaatatcacataatgattgtttttatacaaaaataccatatggctaatgtggacccaatctcaacatttgtttgctgccttacacacacatttttatttatatttctttttttatatatggatntnggaagtgggatgcc

SEQ ID NO: 6325 - DNA, 193 bp, Homo sapiens
  misc_feature 40, 180: n = A,T,C or G
gttgacatgtggggcccgatcattcttagttgtggagggncgtcctgtgcattacaggatattaagcagcatctctggactctacccactagttgctggtagcattccccttccccaagtgtgacaacaaaaatgtctccagacatggcaagatgtcccctgtgggtcaagttgacccanttaagaactatag

SEQ ID NO: 6326 - DNA, 340 bp, Homo sapiens
  misc_feature 200, 202, 253, 288: n = A,T,C or G
catgtcagcaagggataaagagttacttacagaagttaaagtgaaattaaataactcttgaatccatttgtaaaagtgcctgtattctcagttgaatggtagtaactactgcgtgaaggaagttggtttgccttatggataaggtttttataagtacttaaaatggaattagcatacaccctttaaccatgctgattttngnttatccctgcaacatattttgaaagctttgctctcctgtataagccagtanaaagcacaggcacttgcacagcatttaaaactcanatataaagcatttctagcacattatggatgcgctatggggtttgaagttaat

SEQ ID NO: 6327 - DNA, 253 bp, Homo sapiens
  misc_feature 29, 154, 196, 207, 239: n = A,T,C or G
cttcagggaagccatgcgcattggagcanaggtttaccacaacctgaagaatgtcatcaaggagaaatatgggaaagatgccaccaatgtgggggatgaaggcgggtttgctcccaacatcctggagaataaagaaggcctggagctgctgaanactgctattgggaaagctggctacactgataaggtggtcatnggcatggacgnagcggcctccgagttcttcaggtctgggaagnatgacctggacttc

SEQ ID NO: 6328 - DNA, 169 bp, Homo sapiens
  misc_feature 11, 93, 125, 156, 164: n = A,T,C or G
gaatttctcanagatctttgtgcataagaggtagctaggcttctgtgtcaacaaatactggagcaagtcagccttagaggggagtggcctgancaccatctagtgtaaatgctctcgtaaatgtncttgaaatgataggtatgtacaactgccatntagtgacnatggg

SEQ ID NO: 6329 - DNA, 249 bp, Homo sapiens
  misc_feature 2, 17, 29, 41, 63, 65, 66, 137, 142, 159, 175, 181, 204, 245: n = A,T,C or G
tncccatttaagctgcnacactagtgganccaaagaatttngcacgagcaattaaacacgttngnnttctgaataaattgaactaaatccaaactatttcctaaaatcacaggacattaaggaccaatagcatctgngccanagatgtactgttattanctgggaagaccaattntaacancaaataacagtctgagactcctnatacctcagggggtaaaagcatgtctctcttgagctacagnagga

SEQ ID NO: 6330 - DNA, 320 bp, Homo sapiens
  misc_feature 16, 42, 314: n = A,T,C or G
tcgcgcgcctgcaggncgacactagtggatccaaagaatttngcacgagcgaaaaaaaggagcctggatttctcaaagacctcaggaaatgttcccttgtctcaatagaaggctgacagagctatcttcgagaacatgttaaactcaaagagtaagtagtaaccccagcctccagaaagttatgatttgagttgacttgtctgatttgacagacatgccattccatgggattatcctatgggcaaatgtcctgagacactgctggagcaatctgctcctttttcattttcaaatccagtcaccaaacctagttnatgata

SEQ ID NO: 6331 - DNA, 101 bp, Homo sapiens
  misc_feature 8, 19, 36, 47, 56, 88: n = A,T,C or G
cttgcacngcgacactagnggattcaaagaattttncacgagggaanagtggagantactggattgaccccaaccaaggctgccaacntggatgccttcaa

SEQ ID NO: 6332 - DNA, 209 bp, Homo sapiens
  misc_feature 122, 167, 180, 182: n = A,T,C or G
agcgaacaaagctgaccctcactggcctggcctcagggttaagcacatacaggacaatggaaccttttatacctccaagagtgacttatcatataactcccatgtgtctatagactaaaaangtctctgtcgctttggggcctttgggagttgtattacaaagggcnccctgcctttgtngngcaaaatcaatacgtatccgcctctac

SEQ ID NO: 6333 - DNA, 104 bp, Homo sapiens
  misc_feature 10, 16, 44, 48, 52, 55, 74, 76, 79, 88, 95: n = A,T,C or G
ggcgcttgcnggtcgncactagtggattcaaagaattcttttcnagcngaangcnaagaaaggaagctcctgcncntcntaaagctgnagccacnagcgaaggc

SEQ ID NO: 6334 - DNA, 140 bp, Homo sapiens
  misc_feature 45, 55, 62, 73, 82, 89, 96, 113, 128: n = A,T,C or G
acaatttcaatccaccctaattctgttactgtgtgcttggttcancaatcactgngatcctnctggccgggancaagatccngagaacnaaactantagtgactgtgtagatnaaaaggcaatgaatnctgcttttaagg

SEQ ID NO: 6335 - DNA, 114 bp, Homo sapiens
  misc_feature 14, 27, 37, 39, 43, 50, 52, 60, 65, 95, 106: n = A,T,C or G
gcgcttgcacgccnacactagtggatncaaagaattntncacnacagtgncngagtgagnttctngggggcccagcttcctccataggtggcagnaatggcccggntactaggg

SEQ ID NO: 6336 - DNA, 140 bp, Homo sapiens
  misc_feature 2, 16, 40, 54, 55, 64, 96, 116, 121, 140: n = A,T,C or G
gnacgagcgcaggagnagcccagaataaactgtgcctganacctaccctatttnngtatttttnccagttttaaggaaataaatcccctttattgnatactcagttagaatcaatnatttntatctctttgggattgggn

SEQ ID NO: 6337 - DNA, 195 bp, Homo sapiens
  misc_feature 2, 5, 31, 34, 50, 51, 54, 90, 114, 130, 133, 166, 169, 173: n = A,T,C or G
cntgnatccacacccccctactgccgttatngcngtttaactggcgactnnggnattgagctctgcccttgtcctgcctccggggagggngagccagtcaaggaggtgagggtnagagccaccctgccanatntggaggactactccccgtgtgcactacccccanagnctgnaccgcagatctttcccatgggg

SEQ ID NO: 6338 - DNA, 110 bp, Homo sapiens
  misc_feature 24, 92, 101: n = A,T,C or G
actagtggattcaaagaattcttnacgagggagcttgaaaaaatgcagactggacaaacgcttacacaaaaaaaaactgggaactggcttangatctgagnttacttttc

SEQ ID NO: 6339 - DNA, 140 bp, Homo sapiens
  misc_feature 5, 25, 30, 42, 44, 56, 70, 92, 104, 109, 118, 127: n = A,T,C or G
cgggngcttgcagggccacactagnggatncaaagaattctntncgagcgcatgtncatttgtatttttntattgaaaatctactcactaanacaaaaggatcngaggntttggacancatactagncctaacagtaaag

SEQ ID NO: 6340 - DNA, 104 bp, Homo sapiens
  misc_feature 15, 24, 35, 38, 41, 53, 63, 75, 76, 79, 85: n = A,T,C or G
aaaagtggggagggncaagggatnctgggaagctnganccncccccaaagcantgtgagtccnagagcccgcttnngtncttccncacaattccattactaaga

SEQ ID NO: 6341 - DNA, 101 bp, Homo sapiens
  misc_feature 7, 21, 39, 48, 65, 75: n = A,T,C or G
cgtcagngaagttcatgaganatgaataacataattggnggttgggtnaatcactaccagtctanactagcccanacgcctcaattagagggggctggctt

SEQ ID NO: 6342 - DNA, 178 bp, Homo sapiens
  misc_feature 26, 33, 52, 55, 80, 82, 85, 108, 130, 151, 152, 171: n = A,T,C or G
tcacgagccactgagccaccctaccnccctaanagatatgagagaaattgtnaangaagtcagcacttacattaagaaantnggntacaaccccgacacagtagcatntgtgccaatttctggttggaanggtgacaacatgctggagccnngtgctaacatgccttggtncaaggga

SEQ ID NO: 6343 - DNA, 141 bp, Homo sapiens
  misc_feature 13, 15, 30, 33, 37, 43, 45, 47, 50, 55, 79, 84, 96, 111,122, 139: n = A,T,C or G
agcctcacgaaananaaaaaaccaggatanaanattntatgcnantnccngggangaagacataaagacatagcacatnacatncacagatggcanaaacacaggaggaanagcaggtttgnagaatacaagaatgaanat

SEQ ID NO: 6344 - DNA, 145 bp, Homo sapiens
  misc_feature 24, 38, 58, 72, 83, 88, 90, 122, 127, 129: n = A,T,C or G
tcgagggctcgagggcccaagaancctctgaagcgggnggcacgctccaaagcattgnatgctggataaatngaccggtgggncggcncntcggccatccaccggtccccacaagttgaganagtgncnccccctcatcattttc

SEQ ID NO: 6345 - DNA, 460 bp, Homo sapiens
  misc_feature 350: n = A,T,C or G
agtggatccaaagaattcggcacgagcgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagcccggaggtggcaattcaccgaattcgaatcaccctaacaagccgcaacgtaaaatccttggaaaaggtgtgtgcctgacttgataagaggcgcaaaagaaaagaatctcaaagtgaaaggaccagttcgaatgcctaccaagactttgagaatcactacaagaaaaactccttgtggnggaaggttctaagacgtgggatcgtttccagatgagaattcacaagcgactcattgacttgcacagtccttctgagattgttaagcagattacttccatcagtattgagc

SEQ ID NO: 6346 - DNA, 328 bp, Homo sapiens
  misc_feature 11, 14, 41, 79, 113, 122, 197, 273, 301: n = A,T,C or G
agcaggcgcanccnagcctcgaaatgcagaacgacgccggngagttcgtggacctgtacgtgccgcggaaatgctccgntagcaatcgcatcatcggtgccaaggaccacgcntccatccanatgaacgtggccgaggttgacaaggtcacaggcaggtttaatggccagtttaaaacttatgctatctgcggggcnattcgtaggatgggtgagtcagatgattccattctccgattggccaaggccgatggcctcgtctcaaagaactttngactggagagaatcacagatgtggaatntttgtcataaataaataatgaaaacct

SEQ ID NO: 6347 - DNA, 178 bp, Homo sapiens
  misc_feature 8, 15, 22, 26, 31, 35, 40, 46, 47, 50, 56, 59, 60, 64, 70,89, 94, 98, 128, 137, 147: n = A,T,C or G
cgcctctnatgctgncatgtgnctgnccgtncacncattnacaganngangcctgnatnncagncataantttatatttaaaagtgtcngattntatncatgcaagacagctgcacttatatcgtttnctaaatcantgccatctanaggttcaaaagttaaaaatacggaaatatac

SEQ ID NO: 6348 - DNA, 439 bp, Homo sapiens
  misc_feature 17, 155, 247: n = A,T,C or G
gtttttaaccttgaccntgtattatgtttataattaaaaacccaaagaaccagctcatgtttggaaaaggaatcttccactgaaacatttggatacccgacgttctccctggacacttggcccggcaatagttggggtctcctgggaagctgagngctggcttctagcctctccagttccctcagactctgtcttcagctcgggcccctccgttctgtctccctcgactccaagtcaggaataccgngggcttcctgccctcaccccacacctcaagaccatcccactgcttgcctgcttgccccctgccatctcgcactcagccctgggtgcctgtgaagcctggccccactgcctgcccggggggttccttgcagcacccccctactccaggctccccatctccctgaagcttccagggtagcagcttggtgggaca

SEQ ID NO: 6349 - DNA, 437 bp, Homo sapiens
  misc_feature 75, 166, 292: n = A,T,C or G
tgacagacgacagctttgataagaatgttctggacagtgaagatgtttggatggttgagttctatgctccttggngtggacactgcaaaaacctagagccagagtgggctgccgcagcttcagaagtaaaagagcagacgaaaggaaaagtgaaactggcagctgnggatgctacagtcaatcaggttctggcctcccgatacgggattagaggatttcctacaatcaagatatttcagaaaggcgagtctcctgtggattatgacggtgggcggacaagatccgacatcgngtcccgggcccttgatttgttttctgataacgccccacctcctgagctgcttgagattatcaacgaggacattgccaagaggacgtgtgaggagcaccagctctgtgttgtggcttgtgctgccccatatccttgatactggagc

SEQ ID NO: 6350 - DNA, 404 bp, Homo sapiens
  misc_feature 207: n = A,T,C or G
gaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatganatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgcttgaaatccggcatgttcttgtcacacttgggtgagaagatgacagagggaaga

SEQ ID NO: 6351 - DNA, 457 bp, Homo sapiens
  misc_feature 424: n = A,T,C or G
tactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggtaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttncagtactaggggtccatcttcattccaccaagc

SEQ ID NO: 6352 - DNA, 264 bp, Homo sapiens
  misc_feature 19, 26, 48, 100, 167, 219, 228, 261, 263: n = A,T,C or G
cggcacgagctcgaacctntgatctnaagtgatccacctgccttaggntcccaaagtgctggaattacaggcataagccgccacacccagctgaaatttntcattgttggattgcatatggaacgataagctggtgggatacaataggtgtcaagggggcggaggtnctataatcctatgagctaaaatacatttagccataaaataatgtttaattgntatcaaatnctttagttccctgacatgttcctatttagcatntnt

SEQ ID NO: 6353 - DNA, 375 bp, Homo sapiens
  misc_feature 200, 291, 322, 335, 371: n = A,T,C or G
ccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccnaccctgccgatgtggccatccagctgaccttcctgcgcctgatgtccaccgaggcctcccagaacatcacctaccactgcaagaacagcgnggcctacatggaccagcagactggcaacctnaagaaggccctgntcctccagggctccaacgagatcgagatccgcgccngagg

SEQ ID NO: 6354 - DNA, 224 bp, Homo sapiens
  misc_feature 155, 205: n = A,T,C or G
agaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtnaaggtgctcctcttttttcttgtcattgctggacaagattactaatattngggaaggctttaaagcacc

SEQ ID NO: 6355 - DNA, 209 bp, Homo sapiens
  misc_feature 8: n = A,T,C or G
cacaagcncaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgccttt

SEQ ID NO: 6356 - DNA, 263 bp, Homo sapiens
  misc_feature 20, 28, 37, 133: n = A,T,C or G
agcccgctgggccaacttcnatcattcnagctagaanagcttccccctgacacccctgtgactgagcctgtgtcctgtctgcctgcccagcccatgctccatcggctgtgagggcagtgcccggagaggccanagggttggagctgcagggacccgtttggacccacagcctctgttctagagatgcttgtataggctgttaattgtgatgaataaacgttcaaccctcggcctgcagccagagtagccaggccgcgcacccc

SEQ ID NO: 6357 - DNA, 182 bp, Homo sapiens
  misc_feature 3, 6, 7, 8, 19, 25, 28, 37, 41, 51, 52, 55, 67, 73, 86, 88,108, 122, 144, 149, 161: n = A,T,C or G
ccnagnnncctctgatganatcttntcnctgtgttgntttnactgataaannagnccactcaatggntgcctngatgaccctgtgncngaagagggcaatgatggtanctgccaggccacantccacccaggactgctcttctnacctnccaccttagggncaccagaagaattcaagaagc

SEQ ID NO: 6358 - DNA, 350 bp, Homo sapiens
  misc_feature 152, 314: n = A,T,C or G
cttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggnagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggntggcttggattcagtaataaatattgtaaggccttt

SEQ ID NO: 6359 - DNA, 397 bp, Homo sapiens
  misc_feature 252, 262: n = A,T,C or G
caaatacataggtatgtagtatgccagtgggccacatgacacagaagaataaaataggctaagtggtcagaatgagagtgagccatggttcttccacagcacggttagagaaggcattctaagatggtaacacttgagcagagataaggatatgagggagaaggttatttaatatttggaaaaatagttatttaatatttgaaaaaagatggaattccagttgcaatggctctcagtcaggagcgtgcttgncttggagcancaggggaggtcgatgtggctaggtcaggaaagcactgctgggctggtctgagtggcccagtagaagagtagtcaaagaccagatcgtaaagagacttatgggccatgataaggttttggcttttattctgtgaga

SEQ ID NO: 6360 - DNA, 418 bp, Homo sapiens
  misc_feature 14, 22, 170, 199, 212: n = A,T,C or G
gtattgttcccagngacacttnggagagctggtagttagtagcatgttgagccaggcctgggtctgtgtctcttttctctttctccttagtcttctcatagcattaactaatctattgggttcattattggaattaacctggtgctggatattttcaaattgtatctagngcagctgattttaacaataactactgtgntcctggcaatagngtgttctgattagaaatgaccaatattatactaagaaaagatacgactttattttctggtagatagaaataaatagctatatccatgtactgtagttcttcttcaacatcaatgttcattgtaatgttactgatcatgcattgttgaggtggtctgaatgttctgacattaacagttttccatgaaaacgttttattgtgttttta

SEQ ID NO: 6361 - DNA, 462 bp, Homo sapiens
  misc_feature 326: n = A,T,C or G
ctgggacaccgtcaagtgaacaaatgttatgtagttaaagaagaaaaggaaatgggaaaagacatagaaaacgtatttaatgaaataataaccaaaaaattccaagccttgggagaaatatggtcatccagattcaaaaagagaatctgtgattcaacccaaaaaggccctctctgaggcaagtcatagtcaaattccaaaaagtcaaagacagaattataaaaacaacaaagaaaagcatcaagtcatatgcaaggaaatatccattagactaacaacagctttctcagcacgacacttacaggtcagtagaaaatgggataatntatttaaagtgctgaaagaaaaaaaactcagccaagaatactatgatcagcaaagctatcattcatatatgaaggagaattaaagttttttagacaagcgaaaactgaggaaattcatcaccactagactagcctt

SEQ ID NO: 6362 - DNA, 320 bp, Homo sapiens
  misc_feature 250, 270: n = A,T,C or G
gaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccanagctctgccaaaggccccgnagtccctctcccaggaggaccctagaggcaattaaatgatgtcctgttcc

SEQ ID NO: 6363 - DNA, 388 bp, Homo sapiens
  misc_feature 103, 373: n = A,T,C or G
tctcaatcaagttgattggaatgcctggctctactctcctggactgcctcccataaagcccaattatgatatgactctgacaaatgcttgtattgccttaagncaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggnagaatggaagtttac

SEQ ID NO: 6364 - DNA, 500 bp, Homo sapiens
  misc_feature 16, 20, 42, 44, 45, 52, 85, 117, 190, 311, 350: n = A,T,C or G
cctggagcctccgggngccntgcaggtcgacacctagtggantnncaaaganttcggcaccgagggcaactactactaagtaacnttctagtagcacttgcctgagagacaaattanttgtttgataattttcattgtgaataggaatccaatagatcatattgcttactttgttctttttatactatanaataatattttgttctctagtatatcaaaataccaaaatattatctcatattttctccctctttctcttactcttaccaagttttcctggtggcttggcttccctgactaaagaattaagnctcatttttactttccatttctattttcttaccacttgnctggctccctttgtctctgtacctttaccaacattaggatctcacctctttcttcctcccttaattcataagcaccactcctatcaaagtcccatctcttaaccctgggatcaaacaaactgtgagttttccagaatctgtttcccagtt

SEQ ID NO: 6365 - DNA, 434 bp, Homo sapiens
  misc_feature 50, 60, 109, 228, 231, 244, 309: n = A,T,C or G
caccgcaaatgcttctaaacggactcagcagatgcgtagcatttgctgcntgggttaatngagaatagaaatttgcccctggcaaatgcacacacctcatgctagcctnacgaaactggaataagccttcgaaaagaaattgtccttgaagcttgtatctgatatcagcactggattgtagaacttgttgctgattttgaccttgtgttgaagttaactgttcccctnggnattaacgtgtcanggctgagtgttctgggatttctctagaggctggcaagaaccagttgttttgtcttgcgggtctgncaagggttggaaagtccaagccgtaagacccagtttcctttcttagctgatgtctttggccagaacaccgggggctgttacttgctttgagttggaagcgggttgcatttacgcctgtaaatgta

SEQ ID NO: 6366 - DNA, 153 bp, Homo sapiens
  misc_feature 108, 130, 136: n = A,T,C or G
ggaaaatggtgaagaaaattgaaatctgccagcacgccaagtacacttgctctttctgtggcaaaaccaagatgaagagacgagctgtggggatctggcacttgtggntcctgcatgaagacagtggctnggcggngccttggacgtacaata

SEQ ID NO: 6367 - DNA, 435 bp, Homo sapiens
  misc_feature 39, 147, 324, 432: n = A,T,C or G
gctgagggcaacagcaggttcacttacactgttcttgtngatggctgctctaaaaagacaaatgaatggggaaagacaatcattgaatacaaaacaaataagccatcacgcctgcccttccttgatattgcacctttggacatcggnggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaatngtgggcaaaagagaaaaagaaggattgatcaggagcattgtgcaatacagtttcattaactccttcccccgctcccccaaaaatttgaatttttttttcaacactctnaca

SEQ ID NO: 6368 - DNA, 233 bp, Homo sapiens
  misc_feature 115: n = A,T,C or G
gagacagagaggggaagggagagagagacagagaggggaagggagagagagacagagaggggaagggagagagagacagggagagagctagaaagataaagagaggggccgggcncggtggctcacacctgtaattccagcactttgagaggatgaggcaggtggatcgcctgaggtcaggagttcgagaccagcctggcccactggtgaagccctgtctctactaaaaatac

SEQ ID NO: 6369 - DNA, 276 bp, Homo sapiens
  misc_feature 20, 84, 114, 132, 153, 165, 173, 204, 219, 233, 273: n = A,T,C or G
ttaggctcttcttgcgttgntacaaaccaacacctgagactgcgtaatttattttttaaaaaagatttaattggccctgcgggntgtataagcctggttccaacatctgctcancttctggggaagcctcanggaatatttactcatgggggnagacgaagtggnaacagacncatcacatggtgaaagcaagaacaagagagngagtgggaggtgccncacacttggaaacnaccaaatctcatgagaactcattcacaattacaaggatancac

SEQ ID NO: 6370 - DNA, 433 bp, Homo sapiens
  misc_feature 56, 167, 224: n = A,T,C or G
caggccccagaggacctgttggacccagtggacctcctggcaaagatggaaccagnggacatccaggtcccattggaccaccagggcctcgaggtaacagaggtgaaagaggatctgagggctccccaggccacccagggcaaccaggccctcctggacctcctggngcccctggtccttgctgtggtggtgttggagccgctgccattgctgggattggaggngaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttga

SEQ ID NO: 6371 - DNA, 234 bp, Homo sapiens
  misc_feature 87: n = A,T,C or G
tgaagacgtcattgcccagggtattggcaagcttgccagtgtacctgctggtggggctgtagccgtctctgctgccccaggctctgnagcccctgctgctggttctgcccctgctgcagcggaggagaagaaagatgagaagaaggaggagtctgaagagtcagatgatgacatgggatttggcctttttgattaaattcctgctcccctgcaaataaagcctttttacacatc

SEQ ID NO: 6372 - DNA, 100 bp, Homo sapiens
  misc_feature 16, 28, 71: n = A,T,C or G
aaaagctggagctcgngcgcttgcgggncgacactagtggattcaaagaattcggcacgagaggtcgcggngacatggccaaacgtaccaagaaagtcgg

SEQ ID NO: 6373 - DNA, 102 bp, Homo sapiens
  misc_feature 42: n = A,T,C or G
gtcgacactagtggattcaaagaattcggcacgagccacccnactcttaatctctggtggaagaacggactaacaactgtttgtttgaattggccatttaag

SEQ ID NO: 6374 - DNA, 179 bp, Homo sapiens
  misc_feature 17, 59, 69, 93, 94, 102, 128: n = A,T,C or G
aaaaagctggagctcgngcgcttgcgggtcgacactagtggattcaaagaattcggcangaggccaagnggaggaagaagcgaatgcgcaggnngaagcgcngaagaagaaagatgaggcaggaggtncaagtgaaccgctagcttgttgcaccgtggaggccacaggagcacaaacat

SEQ ID NO: 6375 - DNA, 104 bp, Homo sapiens
  misc_feature 11, 17, 27, 34: n = A,T,C or G
ctggagctcgngcgccntgcgggtcgncactagnggattcaaagaattcggcacgagctcgcgcccaattcggcacgagtgcacaactacgcatggtctgaagg

SEQ ID NO: 6376 - DNA, 134 bp, Homo sapiens
  misc_feature 6, 10, 28, 48, 64, 70, 77, 81, 95, 99, 102: n = A,T,C or G
gcgccntgcnggtcgacactagtggatncaaagaattcggcacgaggncaaaactggacaaggnagcctntcacctncggnagttgatggatgancctncanccccagggagcccggagctctaactcatcatc

SEQ ID NO: 6377 - DNA, 116 bp, Homo sapiens
  misc_feature 2, 7, 8, 13, 15, 32: n = A,T,C or G
cntattnngcacnanaaatcattgcctgatcnaatataatgaactctgcagatttgacttggtgccttttccaggcatctgggctaggggcctggaagatcaagagggcacagggg

SEQ ID NO: 6378 - DNA, 111 bp, Homo sapiens
  misc_feature 16, 17, 29, 57, 67, 79, 90, 96, 100: n = A,T,C or G
aaaaagctggagctcnngcgcttgcgggncgacactagtggattcaaagaattcggnacgagcgccntgacccgcgganaccagcgtganctcgcncgcnagaagaatatg

SEQ ID NO: 6379 - DNA, 111 bp, Homo sapiens
  misc_feature 6, 13, 51, 58, 61, 65, 98, 104: n = A,T,C or G
gcgccntgcgggncgacactagtggattcaaagaattcggcacgagcttgnctcctgnggnggcntgctgggaacgggacttctaaaaggaactatgnctgganggctggg

SEQ ID NO: 6380 - DNA, 100 bp, Homo sapiens
  misc_feature 17, 22, 29, 44, 67, 69, 71, 80, 84, 85, 90: n = A,T,C or G
aaaaagctggagctcgngcgcntgcgggncgacactagtggatncaaagaattcggcacgagcggcncnanctgacctgntganngcagntatcttacag

SEQ ID NO: 6381 - DNA, 128 bp, Homo sapiens
  misc_feature 15, 19, 38, 46, 48, 51, 55, 57, 75, 84, 86, 114, 118, 121: n = A,T,C or G
cgacactagtggatncaangaattcggcacgaggccantgtgcagngngantttntngatcttcagctacatttncggctttgngngaaaccttaccatctaacacgatggccngcancgntaccaac

SEQ ID NO: 6382 - DNA, 102 bp, Homo sapiens
  misc_feature 3, 28, 30, 31, 34, 37, 47, 48, 55, 73, 79, 86, 88, 91, 93: n = A,T,C or G
cgngatcaagcaggctgactatgtgccnanngancangacctgcttnnctgccgngttctgacttctggaatntttganaccaagntncangnggacaaagg

SEQ ID NO: 6383 - DNA, 336 bp, Homo sapiens
cggacccttgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcgg

SEQ ID NO: 6384 - DNA, 334 bp, Homo sapiens
gccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggc

SEQ ID NO: 6385 - DNA, 339 bp, Homo sapiens
ctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttc

SEQ ID NO: 6386 - DNA, 336 bp, Homo sapiens
aacccggacagtggtgaaatacacgaggtgtttccattacacacacagggaaggccagggcctaatgaaaactccccgccaaggagaagctctgtggggtcccggctgcctctttcatgacaaagacagcctgagaagcacagagggctcaccactggctctgccacttcctggctgaggggccctgaccaagtctttgaagtctctgcacctcagtttccgtgttagtacaacaagcgtgattcatgcacgtgcttggagggctgcagttagaataagaaatcccacacaggaagctctgctgtgtggctgggatcccggaagtaacaggcttgt

SEQ ID NO: 6387 - DNA, 204 bp, Homo sapiens
  misc_feature 171, 172, 201: n = A,T,C or G
ctatgaagcagcccaagaactactggatggaaacttaagcgttgttgatgatattccagaattcaaagacttgggtgagaagagcagacaagccaagctggaggagttggtgtgggcaattggaaagctgaccgacatagcctcgccttgtagaactaaacggagacgggnnggggggccctggacttggaaggggggaanagg

SEQ ID NO: 6388 - DNA, 267 bp, Homo sapiens
  misc_feature 1, 2, 3, 6, 9, 10, 13, 126, 186, 212: n = A,T,C or G
nnntanggnngancccaactataatacttataaccccagctgtggtctctgagagactgaagattcgaggctccctggccagggcagcccttcaggagctccttagtaaaggacttatcaaactgntttcaaagcacagagctcaagtaatttacaccagaaataccaagggtggagatgctccanctgctggtgaagatgcatgaataggnccaaccagctgtacatttggaaaaataaaactttattaaatcaaaaaaaaaaaaa

SEQ ID NO: 6389 - DNA, 340 bp, Homo sapiens
  misc_feature 270: n = A,T,C or G
tttaaaagcatagtctctagacacagagtatcagaatttgcattttggatctaatacaaattaatactaatctaatactaattaatactaatttaccatgagcaaattatttaacctttctgtgcttcactgtcttgacctctaaggtgaggattataatggtaccttttttataatttttgtgaagattaaacgagttgatatctttgacacactgaaaatgcggtaagctctataaatgtttgctactgttattatgatcaatgtggngtgtctagtttatgcttacactaagtagccttttgtggtcccagcattatggatggtcggctattgggtt

SEQ ID NO: 6390 - DNA, 335 bp, Homo sapiens
  misc_feature 64: n = A,T,C or G
gtgaaggggggcaaaaaaaagaagcaagttctgaagttcactcttgattgcacccaccctgtanaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccagga

SEQ ID NO: 6391 - DNA, 314 bp, Homo sapiens
  misc_feature 27: n = A,T,C or G
cccaggttcaagcgattctcctgtctnagccttccgagtagctgggattacaggtgcccgccaccacgcctggctgatttctgtatttttagtagagatgaggtttcaccatgttggccaggctagtctcgaacatctgacctcaggtgatccacccgcctcggtctcccacagtgctaggattacaggcatgagccactgcacccagcctatttttaattctctaataggtaaaatcactgatctgtatttcattggaattgggttctggagatttcttcatcttttgtttggaacgtattttctatttcttg

SEQ ID NO: 6392 - DNA, 350 bp, Homo sapiens
tcgcacttgagcttgttaaagcaggtttggcattagcactctttggaggaagccagaaatacgcagatgacaaaaacagaattccaattcggggagacccccacatccttgttgttggagatccgggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttg

SEQ ID NO: 6393 - DNA, 335 bp, Homo sapiens
cccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcattt

SEQ ID NO: 6394 - DNA, 115 bp, Homo sapiens
  misc_feature 12, 15, 27, 28, 33, 56, 57, 59, 71, 75, 77, 88, 89, 99, 107,110: n = A,T,C or G
atacatattganatntatgtttatganntcatnaaccacatagcccattctcagtnnanaaattcattgtngganantatgatcaggnnagatatggtntacggggnttnaaaca

SEQ ID NO: 6395 - DNA, 286 bp, Homo sapiens
  misc_feature 196, 213, 257, 276: n = A,T,C or G
ccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttagggggtgccccattgcagaaagccactctgggctggnttattgctagcttccgnaacgaccttattctgcaccagctttttactaccaggctctgagnggagacccccagcatccanactttggccc

SEQ ID NO: 6396 - DNA, 117 bp, Homo sapiens
  misc_feature 24, 51: n = A,T,C or G
cacttagctactctcttgctagangctccttgctcagcattactaactacnaaatacactgtaaaaattacactgtatatggctatatttttaatttgctggctacctggaaaaaaa

SEQ ID NO: 6397 - DNA, 190 bp, Homo sapiens
ctttagtgtgctatacctatgtgtcttatcgtgggccactgtgccaataaacaaaaacaactgtttggtttacctcagttgcagtagttattttcatttagaagttgttctcagattattgtttcagttatataggaggattactagactagttatgaagaaaccccactacattcaatggaattggggc

SEQ ID NO: 6398 - DNA, 334 bp, Homo sapiens
ggctgccgtgctgctcggcggcgctgaggccaaatagttgcatcacatgtatctaatccgagagtctcatgcttctggtagctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgcttggagacctacgggaacctagtctcactggctcttgggaccagaactgagtacaaggagttgacttca

SEQ ID NO: 6399 - DNA, 335 bp, Homo sapiens
  misc_feature 303, 305: n = A,T,C or G
gaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagngntaatgtcttagattttcagtatttgaactt

SEQ ID NO: 6400 - DNA, 159 bp, Homo sapiens
  misc_feature 104: n = A,T,C or G
tcaagcccgagatgatcggccactacctgggcgagttctccatcacctacaagcccgtaaagcatggccggcccggcatcggggccacccactcctcccgcttnatccctctcaagtaatggctcagcaatgaaataaatacttgtagaatgttcaaaa

SEQ ID NO: 6401 - DNA, 242 bp, Homo sapiens
gtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttt

SEQ ID NO: 6402 - DNA, 330 bp, Homo sapiens
gaacagaaacgagatctccatgatcaattccagcatcagctcaggtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccgagagaacagacacaatgggacctgggcgggcgttacacagaaggctggctgacatgcccagggctccactctcatctaatgtcacagc

SEQ ID NO: 6403 - DNA, 100 bp, Homo sapiens
  misc_feature 1, 3, 5, 6, 10, 15, 19, 28, 66, 67, 73: n = A,T,C or G
ngntnnaaangggantatnacagtaganctctatgaatgtcatgagccctaactttcaggctttgnnttttgnatatgggaagaaatatgacaatcctag

SEQ ID NO: 6404 - DNA, 211 bp, Homo sapiens
  misc_feature 211: n = A,T,C or G
tttatggttccaaggtcctgatacttatcagctttaaaaaaatcgttttcatttttaggtagttttcttgcttttgggcaccaggtggcgatatggagtgaggtggggagtgcatgggatacacaggttgggttgtcataaagaccaagcatctgtagagccgaactgatgagatttaatattccgtctctctctctctctctctctctcn

SEQ ID NO: 6405 - DNA, 159 bp, Homo sapiens
  misc_feature 5, 50: n = A,T,C or G
gaaanctggagctcgcgcgcctgcaggtcgacactagtggatccaaaganttcgacgagtataaatttactttctcaaattcttgccatgagaggttgatgagttaattaaaggagaagattcctaaaatttgagagacaaaataaatggaacacatga

SEQ ID NO: 6406 - DNA, 329 bp, Homo sapiens
gtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 6407 - DNA, 158 bp, Homo sapiens
  misc_feature 2, 3, 7, 18, 22, 35, 49, 94, 95, 100: n = A,T,C or G
cnnaaanttgtcacagantttngagacccattaanccagttaaatgggnaaatgagaaaaaaaaaaaaaaaaaaaaaaaaaaaaaaaaaaaaannccccnaaaaccaaaaaaaaaaaaaaaaaaaaaaaaaaaaaaaaaaaaaaaaaaaaaaaaaaaa

SEQ ID NO: 6408 - DNA, 334 bp, Homo sapiens
  misc_feature 223: n = A,T,C or G
tcaagacggaggacctgctggcaacgttttctgagttccaagagaaggggttcaggattcagtgggtggatgatactcacgcactcggcatctttccctgccgggcctcagctgcggaagccctgacccgggagttctcggtgctcaagatccggcccctcacgcagggaaccaagcagtcaaagctcaaagccttgcagaggccaaaactcctgcgtctggngaaggagaggccacagacaaatgcgactgtggcccggcggctggtggcccgggccctgggactccaacacaaaaagaaagagcggcctgctgtccggggtccgctgccgcc

SEQ ID NO: 6409 - DNA, 336 bp, Homo sapiens
ggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatg

SEQ ID NO: 6410 - DNA, 275 bp, Homo sapiens
  misc_feature 274: n = A,T,C or G
gcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttggtgng

SEQ ID NO: 6411 - DNA, 100 bp, Homo sapiens
  misc_feature 2, 4, 5, 15, 24, 25, 27, 40, 43, 49, 61, 76, 79, 94, 98: n = A,T,C or G
angnnaactccctgngaccttggnngntggacattcccangtntggctncgacattttagnctgtgacatggcgangtnaaatcattttgtctngatntt

SEQ ID NO: 6412 - DNA, 100 bp, Homo sapiens
  misc_feature 15, 20, 34, 39, 48, 50, 57, 60, 70, 71, 73, 84: n = A,T,C or G
tttgtattacaattnactgnttccactgggggantcaangatctcggntngagcgtnacnagcgctctannanaccttaggtancctgtacaagacgtac

SEQ ID NO: 6413 - DNA, 100 bp, Homo sapiens
  misc_feature 5, 16, 33, 50, 77, 83, 92, 94: n = A,T,C or G
ctgcngaatattgganaacatgtcacttgaagnctacttgtatctacggnggtgctcctaagggaccacaaatacgngatttngagagaggngnggaaat

SEQ ID NO: 6414 - DNA, 336 bp, Homo sapiens
ctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaagggaaaaagaatgccaaaatcagcagtctcctggaggagcagttccagcagggcaagcttcttgcgtgcatcgcttcaaggccgggacagtgtggccgagcagatggctatgtgctagagggcaaagagttgggagtt

SEQ ID NO: 6415 - DNA, 191 bp, Homo sapiens
gttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaa

SEQ ID NO: 6416 - DNA, 339 bp, Homo sapiens
  misc_feature 330: n = A,T,C or G
ctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtangtgatgctg

SEQ ID NO: 6417 - DNA, 337 bp, Homo sapiens
attagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttattaaggggttccctgctttcacagaattattccagggtttatgtgtcaggggtggtgacttcacacgccataatggcactggtggcaagtccatctatggggagaaattttgaaagatgagaacttcatcctaaagcatacggggtcctggcatcttgtccatggcaaatgctggacccaacacaaa

SEQ ID NO: 6418 - DNA, 119 bp, Homo sapiens
  misc_feature 6, 31, 36, 43, 53, 63, 92, 97, 99: n = A,T,C or G
acattngttaataaaccaatactgatatgcngttgngaagagnggaaatattntaataaaaancattaattggtacaaaatttccggggaanatggnantctaggaaaataaaaaatga

SEQ ID NO: 6419 - DNA, 337 bp, Homo sapiens
taaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatc

SEQ ID NO: 6420 - DNA, 331 bp, Homo sapiens
accagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaacta

SEQ ID NO: 6421 - DNA, 338 bp, Homo sapiens
  misc_feature 197, 199, 221: n = A,T,C or G
ggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctacctggaactgtggccatgcattttttttttctttaaagaccagngngatagtaggccatgcatctganatacgatattccttggtaactagagggagaaaaaaaaatcaagtaggttcaggcttatgttgtattttgagagtctggttttatttgaacagaaataactctacagaaagctcttgt

SEQ ID NO: 6422 - DNA, 312 bp, Homo sapiens
  misc_feature 2, 8: n = A,T,C or G
antttggntcccatttaccaagttcatatatgggactcgatctcagtataataaaaaaaattactagtaatagtatgaatatatctctcgttttatgcaggactgattttaaatagtgagatatcctgcgcattaaacatgatttatttgagatttgtgggatgtaatttggtgctttcattctcttaaatttattgagaatctagtgattcactggttcatcctttgcctcaggctcatggtcattggagattccaagaaaatgattgaatcagtccctatggatttatttgtatgtgtttttcttttaac

SEQ ID NO: 6423 - DNA, 102 bp, Homo sapiens
  misc_feature 14, 37, 41, 43, 44, 50, 54, 60, 67, 79, 83: n = A,T,C or G
gcgcttgcaggtcnacactagtggattcaaagaattngganannaggccncaanccctgnctctgtnccaagttggggncagntgccctcacttctggggtg

SEQ ID NO: 6424 - DNA, 356 bp, Homo sapiens
gctttattgatagtgatgagattacaaaataacactacatactttttagtttgttgttccttatatagtaccagaatgttttaagcaaagaaagaaattttttgccaaaatttgctgaataaataaaaagtttttaaagaatatccaggacaaataatttatttcaaattccctgagagggcaaattaaatggtctttacccagtgaatgtgctggagggtaaatctttaatattttagattgtttaattcttataattacgaataaaggactgtttggaaaattattctgtaggttttttggcatgaaaagaaatactgaaaagtatttccttttaatgctgccttgtgctggag

SEQ ID NO: 6425 - DNA, 159 bp, Homo sapiens
  misc_feature 124: n = A,T,C or G
gctttggagtcctcttcctgctgctctgggttggcatctacgtgtgagcacccaagggtaacaaccagatggcttcactgaaacctgcttttgtaaattacttttttttactgttgctggaagngtcccacctgctgctcataataaatgcagatgtat

SEQ ID NO: 6426 - DNA, 339 bp, Homo sapiens
gtgcccagggtttatactgggggcgggtcacataggcaccctgtgcttggcagttgccaaattccacagtcccagcttacaggaaagcagatgttcaccataaatcacattgttaatctaaggaaagcaaaacacctttgtcagtatatggaacttttacgaagcttaattcccaagtgccagccaagggtcaaccttataagcaggttcttttttattttatttcatttttataaatagagacagggtcttgctatattatccaggctggtctcgaactcctgtcctcaagaaatcctcctgcctcggtctcacaaagtgctgggattgcaggcgtga

SEQ ID NO: 6427 - DNA, 332 bp, Homo sapiens
  misc_feature 7, 8, 60, 107, 322: n = A,T,C or G
cctgcannagggggcacctcctgccaggtggggagtgtcccaggccgagggaggagccgngcagtggctcaggggcagaaggaggacacctgctgtccagggctcanggagaagtgtggagcaagctgggagggggctctaagacctcctcctctcacccccagggaacctaatgcccctctctggccctgcacccctctactcaggggaaaccagggctcgcctgctgctccaggtgccccgacccagcgatcgggtgcagagctctgcgtttcaggaatgagaggcaggtcttcatgcaagccatatttttgagaatggntctctgttca

SEQ ID NO: 6428 - DNA, 100 bp, Homo sapiens
  misc_feature 13, 28, 44, 66, 73, 79, 87, 95: n = A,T,C or G
aaaaaggctggantctcgggcgcttgcnggtccgacactagtgngattccaaagaattcggacacnagcccgncgatgnggctcttnagggcctnccagc

SEQ ID NO: 6429 - DNA, 315 bp, Homo sapiens
gtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtatt

SEQ ID NO: 6430 - DNA, 308 bp, Homo sapiens
  misc_feature 239: n = A,T,C or G
ccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggaggggagggtgacaagcacaccctgagcaagaaggagctgaaggagctgatccanaaggagctcaccattggctcgaagctgcaggatgctgaaattgcaaggctgatggaagacttggaccgg

SEQ ID NO: 6431 - DNA, 339 bp, Homo sapiens
  misc_feature 177: n = A,T,C or G
atttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggngctttcaaaggagcttgaaggatattgtcagtctttaggggttgggctggatgccgaggtaaaagttctttttgctctaaaagaagaaggaactaggtcaaaaatctgtccgtgacctatcagttattaatttttaaaggatgttgccactggcaaatgtaa

SEQ ID NO: 6432 - DNA, 340 bp, Homo sapiens
ccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatgg

SEQ ID NO: 6433 - DNA, 352 bp, Homo sapiens
  misc_feature 17, 136: n = A,T,C or G
gacaaagaagagaaganagaaagaagaagagaaaaaagaggtgatgcttcagaatggagagacccccaaggacctgaatgatgagaaacagaagaaaaatattaaacaacgtttcatgtttaacattgcagatggnggttttacctgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttctt

SEQ ID NO: 6434 - DNA, 334 bp, Homo sapiens
cagtgactggttactacctgaaccgtgctggctttgaggcctcagacccacgcataattcggctcatctccttagctgcccagaaattcatctcagatattgccaatgatgccctacagcactgcaaaatgaagggcacagcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtg

SEQ ID NO: 6435 - DNA, 337 bp, Homo sapiens
  misc_feature 298: n = A,T,C or G
cctcgtgccgaattcggcacgaagcacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggttggaagtaccaggcagtgacagccaccctggagggagaagaggaaaganaaaagccaagatccactaccggaagaagaaacagctcat

SEQ ID NO: 6436 - DNA, 106 bp, Homo sapiens
  misc_feature 3, 4, 13, 30, 35, 102: n = A,T,C or G
ttnngcacgaggntggagctcattctgtcnctttnctcttttgctttctggctcttaagggcacacacacgtgcgtgcgagcacacacacacatacgtgcanaggg

SEQ ID NO: 6437 - DNA, 343 bp, Homo sapiens
  misc_feature 103, 105, 111, 153, 190, 196, 225, 263, 265, 289, 315: n = A,T,C or G
cttgaaaagttcgctctgccagaaaccacctagggaccacgttagctgccttccttgagctccccaggagtcggtttccacatctgtgaggtggagggctggngnggaggngctcatggggtgcggtgcttgggagacagccaggcccagggnggctgctgcttcctgctaagtgggggaggtgagacanatctgnaaagccgactccctcacatggtttcattnaatgctttatactgccgagtctgggggcttgatttggntngggggcagccatcctccaccaganagggggagctccttccgctgcggctncagataaatggggatgctgggctccagg

SEQ ID NO: 6438 - DNA, 292 bp, Homo sapiens
ccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgg

SEQ ID NO: 6439 - DNA, 249 bp, Homo sapiens
  misc_feature 186, 202, 234: n = A,T,C or G
atgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttntttgttcctgggaaangttaatctccgggagttcttcctggttcatgngttctggggggttgg

SEQ ID NO: 6440 - DNA, 115 bp, Homo sapiens
  misc_feature 5, 9, 10, 11, 14, 23, 25, 28, 29, 39, 54, 56, 57, 69, 93,112: n = A,T,C or G
ctgtngaannnggnaatcactangnaannacagatgtgnaaagggaatgtgcgnannatgccttcaaanctgaatgtttctccgtcccagagngatgaagtgattcaatggntgg

SEQ ID NO: 6441 - DNA, 338 bp, Homo sapiens
ccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaa

SEQ ID NO: 6442 - DNA, 332 bp, Homo sapiens
ctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtgggtgggaaccaagaagcgggtgctcacccctccgcaagtccttgctggtgcagacgaagcggcgggctctggagaaagattgaccttaagttcattgacaccacctccaagttt

SEQ ID NO: 6443 - DNA, 120 bp, Homo sapiens
  misc_feature 7, 12, 13, 18, 32, 34, 35, 38, 49, 50, 60, 63, 69, 103, 108: n = A,T,C or G
ggctgancctgnntcgancacacacatctaangnncangctggctccgnntggcgatctncgncttgtntgtctgaatgttggcctaaaataaagattactgntgtanagtatgaaaaat

SEQ ID NO: 6444 - DNA, 100 bp, Homo sapiens
  misc_feature 8, 17, 41, 64, 89, 93, 99: n = A,T,C or G
acactagnggattcaangaattcggcaacgagggaccttcnagactgtctttgctgatctcatnaagtgatgaatgcaagaggggtttntatnagaatng

SEQ ID NO: 6445 - DNA, 243 bp, Homo sapiens
ctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatcca

SEQ ID NO: 6446 - DNA, 335 bp, Homo sapiens
  misc_feature 84: n = A,T,C or G
ggtatgcaaaaagcagctaggacatagaataagcagtgcctgaaaagacacaagaaaggagcccagtgtctcccagtgaggtgntttacttgcattttcacacttgaacatcatcacaaccctgcaccatttcccagctgaggcaactgaggttctgggaggtcacctaactcccttggggttacctgcccatctgtagcccagccgggacttcaaacccaggtctgtctcactcaaaagcctgttttctttccaacatacaatgccgtgtctggagctgaaactagaacacagggccatggattcccttgtgcacacagcggccactctgttgc

SEQ ID NO: 6447 - DNA, 338 bp, Homo sapiens
cctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatg

SEQ ID NO: 6448 - DNA, 333 bp, Homo sapiens
tgagtgactacttttcatcatttcatgttgtagttcaaatatcatcttttcagacaagcattgctacctaaccatccttccagaatgacactagcctcatccccctcaatcccattaccttttttacttaaaaatttcttcaaaccatttatcagtatctgaaattatgtttttatattattttataatctccatactcactagaatataagccccgtgatatcaatgatcttgtctctttttgtttttgtttttgagatagaatctcgctcggtcaccccaggctggagtgcagtggtgtgtgtgatcacggctcactgcagcctggaactc

SEQ ID NO: 6449 - DNA, 161 bp, Homo sapiens
  misc_feature 4, 21, 30, 35, 79, 81, 91, 101: n = A,T,C or G
atgncacatgtacttcagttngaggataanagcanaaaagcgaaagatgcaagcatgcaagactcagatacatttgaantntatgatcctnggaatccagngaataaaagaaggagggaagaaagcaaaaagctgatgagagagaaaaaagaaagaagata

SEQ ID NO: 6450 - DNA, 347 bp, Homo sapiens
  misc_feature 118, 267, 271: n = A,T,C or G
ccatttgcaagggaaaagtctcttgtaatccgaatctctttttgctttcgaactgctagtcaagtgcgtccacgagctgtttactagggatccctcatctgtccctccgggacctggngctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgngggngtgtccccctctgtccaggcactgagataccagcgaggaggctccagagggcactctgcttgttattagagattac

SEQ ID NO: 6451 - DNA, 338 bp, Homo sapiens
gccccacagacccctccctggggcagagggacagcagattactgggcccgagacgcattaggtggcacatgctggttccctctgtccagcgagcctctcccccagcatcatccagccctgggcctccagcaggcagaggagatcatgaccaggaagcaattcatcaccatccaaggccttagcagactctggctttcctttgaatttccaagaaaactgctccataatttttatcaagacttatcatttgcccatctcaccctacacactagaattttaagcgatgaagtcatgtggagacttactttgtagtcttttaagataatgaccaaatgaac

SEQ ID NO: 6452 - DNA, 313 bp, Homo sapiens
cttgagggctgtcaaaaatgctattgatgatggctgtgtggttccaggtgctggtgccgtggaagtggcaatggcagaagccctgattaaacataagcccagtgtaaagggcagggcacagctttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataacta

SEQ ID NO: 6453 - DNA, 335 bp, Homo sapiens
aaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtacctttggatctgcatttgctacacccttccttgtagtaagacaccaactgcttaaaacataaggatgttttcagttcctccatttaacagatatgaagagcattttaagaggtgcagcctctggaag

SEQ ID NO: 6454 - DNA, 129 bp, Homo sapiens
cttactacagcctcaaacttctgggctcaagtgatcctcagcctcccagtggtctttgtagactgcctgatggagtctcatggcacaagaagattaaaacagtgtctccaattttaataaatttttgca

SEQ ID NO: 6455 - DNA, 111 bp, Homo sapiens
  misc_feature 12, 28, 38, 58, 62, 67, 71, 77, 78, 84, 95, 99, 103: n = A,T,C or G
aaacgctggagntcgggcgcttgcgggncggcactagnggattcaaagaattcgggangagnggctnagangttggnnctgtgngcttgctgganactngctncatcccta

SEQ ID NO: 6456 - DNA, 101 bp, Homo sapiens
ctgaatctcccctcctcacagttgccatgtagaccccttgaagaggggaggggcctagggagccgcaccttgtcatgtaccatcaataaagtaccctgtgc

SEQ ID NO: 6457 - DNA, 318 bp, Homo sapiens
aaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggcca

SEQ ID NO: 6458 - DNA, 185 bp, Homo sapiens
  misc_feature 8, 12, 29, 40, 88, 94, 103, 115, 121, 124, 135, 137, 145,156, 177: n = A,T,C or G
ttataagnttgnagcaagggagcatgggnttcaaaggaanctccttcctttttttgtgtgtttgtccttttgtcccaatggggaaccnaaatcngttttaatngcacagacacanggacanaangtcattttgtntntgccaagnggggaaccttnctttgtttatttgctattaanctgtttga

SEQ ID NO: 6459 - DNA, 100 bp, Homo sapiens
  misc_feature 10, 17, 53, 56, 66, 67, 71, 78, 91, 92, 98: n = A,T,C or G
tgaaaccagncccagcngtatccagaggactcacaagccttcaatcctgatantcnttatcatctnntggnagggganagcgtgacattcnnccctanac

SEQ ID NO: 6460 - DNA, 103 bp, Homo sapiens
  misc_feature 8, 21, 43, 57, 58, 69, 76, 77, 96: n = A,T,C or G
cgcttgcnggtcgacactagnggattcaaagaattcggacaangagccggcagaggnngttcccggggncacttgnngaccagccccttgcgtccncaggttt

SEQ ID NO: 6461 - DNA, 313 bp, Homo sapiens
  misc_feature 157: n = A,T,C or G
gggaattcctggtcctgctggtcccttaggtccacctggtcctccaggcttaccaggtcctcaaggcccaaagggtaacaaaggctctactggacccgctggccagaaaggtgacagtggtcttccagggcctcctgggcctccaggtccacctggngaagtcattcagcctttaccaatcttgtcctccaaaaaaacgagaagacatactgaaggcatgcaagcagatgcagatgataatatttctttgattactcggatggaatgggaagaaatattttggttccctcaatttcccttgaaacaagacatc

SEQ ID NO: 6462 - DNA, 337 bp, Homo sapiens
  misc_feature 6, 157, 168: n = A,T,C or G
gggagnctaagtctctttgtaggtcactcagaacttgctttatgaatctgggtgctcctgtattgggtgcatatatatttaggatagttagctcttcttgttgaattgatccctttaccattatgtaatggccttctttgtctcttttgatctttgntggtttaaagnctgttttatcagagactaggattgcaacccctgcctttttttattttccatttgcttggtagatcttcctccatccttttattttgagcctatgtgtgtctctgcccgtgagatgggtttcctgaatacagcacactgatgggtcttgactctttatccaatttgccag

SEQ ID NO: 6463 - DNA, 332 bp, Homo sapiens
ataaagttaacatttataacaatactaccatctaatacatagtttactttcagatttccccaggtgttctaataatgagttcttcatagttgtgtttttaaaaaataacagctttattgggatataatttacatactgtacagttcacctcaagtgtacaattcattggtttttactgtatttggagttgtacagccaccatgagaatcaattttagaacacttatatcaccctaaaaagaaaccccatacccattagcaatcacttgccttccctcccaccatcccaactcccacctcctagcccaaagcaagcactcatctactttcagt

SEQ ID NO: 6464 - DNA, 197 bp, Homo sapiens
gtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgg

SEQ ID NO: 6465 - DNA, 333 bp, Homo sapiens
  misc_feature 200: n = A,T,C or G
ctggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaagcttatgtccctgatgccaaaaatgcacctactctttcctctaactctggngaggtcattctggagtgacatgatggactccgcacagagcttcataacctcttcatggactttttatcttcaagccgatgacggaaaaatagttatattccagtctaagccagaaatccagtacgcaccacat

SEQ ID NO: 6466 - DNA, 339 bp, Homo sapiens
tcgagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctatt

SEQ ID NO: 6467 - DNA, 131 bp, Homo sapiens
gtggagaggtcctagagccggcgagcgtttgagaagagggcatggcgctggagtgagatgggatttggcgtctcgtttttggctaattgattgtcattggctttttccataaagtttagaaatcgttaaaa

SEQ ID NO: 6468 - DNA, 127 bp, Homo sapiens
  misc_feature 11, 12, 30, 31, 40, 42, 43, 53, 60, 63, 64, 67, 85, 94, 98,99: n = A,T,C or G
ttaaagtcttnngatgtcactatacagttnnactgtctangnnactacaggantctaggnggnnggngggcgtgtgggccttttnatctgatcngcgnntaaagcagtaatattttaagatggactg

SEQ ID NO: 6469 - DNA, 340 bp, Homo sapiens
tctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaaca

SEQ ID NO: 6470 - DNA, 205 bp, Homo sapiens
  misc_feature 2, 15, 79, 82, 155, 170, 178, 194: n = A,T,C or G
cnacactagtggatncaaagaatttgggacgagagatgccgaaaggaaagaaggccaagggaaagaaggtggctccggnccnagctgtcgtgaagaagcaggaggctaagaaagtggtgaatcccctgtttgagaaaaggcctaagaattttggnattggacaggacatncagttttnaagagacctaacccgntttgtgaaatg

SEQ ID NO: 6471 - DNA, 339 bp, Homo sapiens
cgagcccttccttataggcgtcagcgggggaacagctagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgt

SEQ ID NO: 6472 - DNA, 330 bp, Homo sapiens
  misc_feature 237, 279, 281, 290: n = A,T,C or G
ggcagcccagcatgtgccaggcttttgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccncagtgaactcacagaagcacacagctggaaaaggactcgatngnagagctggnaaagccaaaccaccacccgacccacagccaacctaccagc

SEQ ID NO: 6473 - DNA, 313 bp, Homo sapiens
attttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcag

SEQ ID NO: 6474 - DNA, 253 bp, Homo sapiens
cttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctg

SEQ ID NO: 6475 - DNA, 329 bp, Homo sapiens
gtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagagtc

SEQ ID NO: 6476 - DNA, 130 bp, Homo sapiens
gatctaagagttacctggctacagaaagaagatgccagatgacacttaagacctacttgtgatatttaaatgatgcaataaaagacctattgatttggaccttcttcttaaaaaaaaaaaaaaaaaaaaa

SEQ ID NO: 6477 - DNA, 354 bp, Homo sapiens
cgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcg

SEQ ID NO: 6478 - DNA, 330 bp, Homo sapiens
catttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccca

SEQ ID NO: 6479 - DNA, 100 bp, Homo sapiens
  misc_feature 3, 5, 7, 10, 12, 15, 20, 21, 22, 64, 73, 83, 90, 96, 99: n = A,T,C or G
gcntngnctntnagnccttnnntatgggtttaaaggcttgcagtctagaataagtgaacgtcancccaatagnggggttgccngggcctnaagccnatnc

SEQ ID NO: 6480 - DNA, 107 bp, Homo sapiens
  misc_feature 5, 9, 12, 20, 46, 55, 57, 58, 61, 63, 64, 69, 70, 77, 84,93, 98, 104, 105, 106: n = A,T,C or G
gggcngccntgnaggttccngacactaggtggcattccaaaagganttccggacnannagncnngacgnngaaaggnctataanaactattantatanggctgnnnt

SEQ ID NO: 6481 - DNA, 115 bp, Homo sapiens
  misc_feature 7, 9, 37, 39, 43, 46, 60, 61, 62, 69, 72, 77, 79, 86, 88,90, 95, 100, 105, 107: n = A,T,C or G
tgcgcgncnacactagtggattcaaagaattcggcananagcnganacccactttggcannnagccagntgntgccntnttaaggncnanggganatctncctgntnaggagccg

SEQ ID NO: 6482 - DNA, 146 bp, Homo sapiens
  misc_feature 6, 41, 44, 51, 60, 67, 78, 80, 113, 114, 133: n = A,T,C or G
tcgggngcttgcaggtcgacactagtggattcaaagaattnggnaagagcngcccacggngccgagncctgtatcacncnctttatccttacacgcttttatacaatggcatnnaataaagtgcatcgtgtgnctgggtttctggt

SEQ ID NO: 6483 - DNA, 100 bp, Homo sapiens
  misc_feature 7, 14, 33, 47, 49, 51, 64: n = A,T,C or G
tgcacgnctacacnagtggattcaaagaattcngcactagtgggaantncngatgtgcgcattnacaccttgctcaacagagtctgtctgggccaaagga

SEQ ID NO: 6484 - DNA, 100 bp, Homo sapiens
  misc_feature 4, 11, 18, 19, 21, 39, 41, 42, 55, 64, 86, 87, 88: n = A,T,C or G
tgangttgggntgtcaanntnggatctttcctgctttcncnngtgggcttgtagngctataaanctccctctacacactgcttcgnnngagtcccagaga

SEQ ID NO: 6485 - DNA, 100 bp, Homo sapiens
  misc_feature 2, 4, 28, 30, 32, 33, 42, 48, 50, 55, 58, 67, 70, 84, 86,90, 91, 94: n = A,T,C or G
gncnacactagtggattcaaagaattcngnannagcctcagngctttnantctgncanggtggggcnctntaacccacatagangncagnntgnctggcc

SEQ ID NO: 6486 - DNA, 100 bp, Homo sapiens
  misc_feature 4, 6, 14, 17, 30, 33, 36, 47, 52, 54, 66, 71, 81, 82, 85: n = A,T,C or G
taangntagtaaantanattactcatggcntanggngtaatgcctanagccngncgggtccaactnatgtnccctagtaannttngacagtcattcagtg

SEQ ID NO: 6487 - DNA, 100 bp, Homo sapiens
tctctggcgcttgcagcgtctacactagtggattcaaagaattcagcactagagtggatcagtctgaacgactggaccatcgaagggtacttccggtgtt

SEQ ID NO: 6488 - DNA, 124 bp, Homo sapiens
  misc_feature 1, 3, 4, 6, 7, 8, 10, 11, 14, 25, 33, 37, 41, 43, 47, 56,61, 63, 66, 68, 73, 74, 78, 81, 84, 86, 89, 109, 121: n = A,T,C or G
nannannnanntgnggattcaaagntctcaaantaancctnantaangggattttnttgtnanttntnttatnntgcngtngtntnctnctgttaatctaaaaatttanaatatctttatntgt

SEQ ID NO: 6489 - DNA, 126 bp, Homo sapiens
  misc_feature 1, 18, 30, 43, 44, 48, 59, 89, 100, 102: n = A,T,C or G
nagctttctgccccagtnccctaaagaganggctcacagatgnnggcngctactaccgngctgatgatgccaatgtggctcgggaccgngacctcgaggngnacaccaccctcaagagcctgagac

SEQ ID NO: 6490 - DNA, 121 bp, Homo sapiens
  misc_feature 10, 19, 32, 33, 39, 48, 50, 51, 54, 55, 60, 61, 64, 69, 73,79, 82, 83, 92, 98, 109: n = A,T,C or G
ggtttttctnagtttcttntgaggctgtgagnntgcttnggaggggantnngcnngcttnnatnggcancctnatgtgnttnnccccaacancgaaantacaatttaanaattttattaac

SEQ ID NO: 6491 - DNA, 100 bp, Homo sapiens
  misc_feature 5, 8, 10, 16, 27, 28, 30, 31, 33, 35, 36, 37, 51, 57, 84,86, 88, 98: n = A,T,C or G
attcngananagagcntcgcgagcatnntnncnannnggttaaaagcaggnttctgngcttaagagccccccagacctcctganangngaggctctgntg

SEQ ID NO: 6492 - DNA, 116 bp, Homo sapiens
  misc_feature 7, 11, 36, 38, 42, 49, 84, 93: n = A,T,C or G
cactagnggantcaaagaattcgacacgagcgggantnctgntggcttngtgtgaaagagatctcagaacttgcattacctcancccctctgnctgtacattctggggcaagaagc

SEQ ID NO: 6493 - DNA, 100 bp, Homo sapiens
  misc_feature 17, 18, 28, 30, 32, 56, 65, 68, 69, 70, 72, 80, 81, 91, 93,96: n = A,T,C or G
aaaagggctggagctcnngcgcttgcgngncnacactagtggattcaaagaattcngcactagcngannngngcaaagtnnatgaaacctngnaangtgg

SEQ ID NO: 6494 - DNA, 142 bp, Homo sapiens
  misc_feature 16, 18, 24, 31, 73, 89, 99, 116, 117, 128, 132, 134: n = A,T,C or G
tcccaaagtgctgggntngcgggngtgagcnaccacgcccagcctagaaatgattcttagagctgtaggcctntacttcatcatttttnagtttaaatnaatcagttgcttataanntgcttacatgnatanantaattttt

SEQ ID NO: 6495 - DNA, 100 bp, Homo sapiens
  misc_feature 2, 17, 24, 44, 51, 58: n = A,T,C or G
gncctctgaagccctgnaggctgnccgaatttgtgccaataagnacatggnaaaaagntgtggcagaagatggcttccatatccgggtgcgggtccaccc

SEQ ID NO: 6496 - DNA, 100 bp, Homo sapiens
  misc_feature 2, 6, 8, 15, 20, 36, 40, 79, 91: n = A,T,C or G
gnaagngngttggtnttttnaaaaagaaagtgtatntggnaataaagtcagatggaaaattcattttttaaattcccgntttgccactttntctgataaa

SEQ ID NO: 6497 - DNA, 100 bp, Homo sapiens
  misc_feature 4, 13, 32, 41, 43, 44, 54, 57, 63, 67, 78, 79, 90, 95, 96,99: n = A,T,C or G
ggtncaagatagnctatttcattggcatatcnccccccagncnntgaggctcanggntggaangttnatgccttaatnnctctatggcanacatnnaana

SEQ ID NO: 6498 - DNA, 100 bp, Homo sapiens
  misc_feature 3, 16, 34, 36, 50, 54, 56, 66, 67, 74, 75, 76, 86: n = A,T,C or G
tanaatggccttctgngcctctttggcctttgantnttatattttgaccntaanangccatggagnngaccttnnngccttgtatnctatgtgggtatct

SEQ ID NO: 6499 - DNA, 100 bp, Homo sapiens
  misc_feature 3, 15, 38, 41, 53, 93: n = A,T,C or G
ggngcttgcgggtcnacactagtggattcaaagaattnggnacgagctgaacnctggaggcctacccatcaccccatcccgcaattccgccanagccaag

SEQ ID NO: 6500 - DNA, 113 bp, Homo sapiens
  misc_feature 15, 18, 28, 30, 47, 53, 57, 69, 72, 79, 83, 86, 96, 97, 99,102: n = A,T,C or G
aaaggctggagctcnggngcttgcgcgncnacactagtggattcaangattcngacnagagccccctgnctntgggtgntggnttnctgggattgnngnatngactcaaatgc

SEQ ID NO: 6501 - DNA, 101 bp, Homo sapiens
  misc_feature 5, 13, 18, 21, 32: n = A,T,C or G
aatangaggaagncctgncgntctctaatganaaatatgcatttatggcatctctcaaccgtcctggatgtctgattggtagagttgtaattttgaaacac

SEQ ID NO: 6502 - DNA, 101 bp, Homo sapiens
  misc_feature 33, 38, 39, 61, 74, 82, 98: n = A,T,C or G
aaataataagtttgctacctagatgattgcctnattgnntaggtcactatgaaattccttnaaatgttgatatntgccattnggggaaacgacgtaanttc

SEQ ID NO: 6503 - DNA, 100 bp, Homo sapiens
  misc_feature 20, 23, 28, 30, 33, 40, 44, 49, 55, 58, 62, 77, 83, 89, 96: n = A,T,C or G
aaaagggatggagctcgggngcntgcgngncgncactagnggantcaangtaaangtntaanagaccacaaatatcncatganagactnaaagggnacat

SEQ ID NO: 6504 - DNA, 100 bp, Homo sapiens
  misc_feature 3, 5, 29, 31, 43, 68, 74, 81, 82, 88: n = A,T,C or G
ggncnacactagtggattcaaagaattcngnacgagatgctgncaccgaacaaaagacctgtgaatcngactgnggcatgnnctgctncaccagctcgcc

SEQ ID NO: 6505 - DNA, 100 bp, Homo sapiens
  misc_feature 8, 12, 16, 22, 27, 36, 37, 39, 49, 50, 53, 55, 62, 67, 79: n = A,T,C or G
aactgcancatnccanaggttnttacngagcttctnngntgccctaatnnacnangaccccnaggcngcgttggagganctgactaacgctttggagctt

SEQ ID NO: 6506 - DNA, 100 bp, Homo sapiens
  misc_feature 13, 22, 29, 32, 34, 51, 57, 58, 60, 63, 67, 83, 97: n = A,T,C or G
aaaaaagggatgnagctctggngcttgcncgncnacactagtggattaaangaattnngnaanagcnacctaccaacctcgcngcactgtaccctgnggc

SEQ ID NO: 6507 - DNA, 100 bp, Homo sapiens
  misc_feature 20, 29, 41, 88: n = A,T,C or G
gctacactggtggattcaangaattcagnacgaggtcttancgacccttaaactattaatgctgaaccttttactcatgagatttagncattggtaaaat

SEQ ID NO: 6508 - DNA, 110 bp, Homo sapiens
  misc_feature 9, 10, 14, 23, 40, 41, 47, 63, 75: n = A,T,C or G
ccggatagnnggancccaggaantggagaggctggcacanntgcacnaatgcctgcaagctgncctgattttctncggcttggagatagccaccacttttgagctttatt

SEQ ID NO: 6509 - DNA, 106 bp, Homo sapiens
  misc_feature 2, 10, 21, 24, 27, 29, 30, 36, 37, 38, 42, 46, 47, 50, 52,63, 64, 67, 68, 105: n = A,T,C or G
gntctcaaancaacgcctcantancgngnntctctnnnaatnctgnntanangatgggaacanncgnncagcactgcccctctgcctaagacacatgtgactgtng

SEQ ID NO: 6510 - DNA, 100 bp, Homo sapiens
  misc_feature 3: n = A,T,C or G
ganacagcccaagggaccagacccacacagccttacttcacagtttatggcgtttttggaacagcggcgaatctctcatgaggtagtgcacagattgaag

SEQ ID NO: 6511 - DNA, 101 bp, Homo sapiens
  misc_feature 3, 6, 25, 63, 75, 89, 91: n = A,T,C or G
canaangcgaaaatgacaacagaanaacaatacttattccgagctttccagcaacttttttgngtatgtacttanctgctctataagtngntgggttgtat

SEQ ID NO: 6512 - DNA, 100 bp, Homo sapiens
  misc_feature 13, 19, 32: n = A,T,C or G
acactcatctgancaggtntggaggacatagngacaggctgacatacctttatgccatattggcggagttgcaaggtgcaaggctgatagctccccaagt

SEQ ID NO: 6513 - DNA, 110 bp, Homo sapiens
  misc_feature 3, 18, 75: n = A,T,C or G
tcnggcgcttgcgggccnacactagtggattcaaagaattctgcacgagattttaaggttgtaaaggtgctggcngtgtgtcacatgccatttgaaatccggttgcccga

SEQ ID NO: 6514 - DNA, 122 bp, Homo sapiens
  misc_feature 11, 15, 36, 40, 45, 55, 63, 65, 73, 97: n = A,T,C or G
aagcttgtaancttnatcttttataaagttagaagngcanatgtngaaatgtacntaagcaananatcatttnacagttcatcaaaatgtatagctnatttgccaaggaaaagtggaactga

SEQ ID NO: 6515 - DNA, 111 bp, Homo sapiens
  misc_feature 8, 26, 29, 47, 48, 49, 53, 59, 62, 64, 66, 71, 77, 79, 82,86, 91: n = A,T,C or G
gaagcccnaaatcccaaggtactggnagnggggcgggggcacgtggnnnaacnagccgnccngnangatcngcagangnaangacnggaangccaaggagcgccaggatcg

SEQ ID NO: 6516 - DNA, 199 bp, Homo sapiens
  misc_feature 11, 13, 15, 31, 33, 127, 132, 148, 153, 155: n = A,T,C or G
actacctaaanantnccaaacatataactgnantcctgacacccaattggaccaatgtatcaccctatagaagaactaatgatcgtatgagtaacatgaaaacattctcctccgcttaagcctgcgngagantaaaacactgaactgncgatnancagcccaatatctacaatcaaccaacaagtcattattaccctca

SEQ ID NO: 6517 - DNA, 106 bp, Homo sapiens
  misc_feature 2, 22, 28, 54, 61, 75, 78: n = A,T,C or G
gngagtgacagagggaaagggnccaatngccactgaggacaccaggcaataaancatcctnccctggcatcaggnggntggacgaatccccacttcctgagtaagt

SEQ ID NO: 6518 - DNA, 100 bp, Homo sapiens
  misc_feature 9, 21, 40, 63, 65, 90: n = A,T,C or G
cgatccgcntcatgtggtctnagagggatccatgtttganaaaatctggagagggaaacgggnanatcaagaacctggacaaatgtatanataacaaggc

SEQ ID NO: 6519 - DNA, 100 bp, Homo sapiens
  misc_feature 12, 32, 41, 51, 58, 72, 76, 85: n = A,T,C or G
caaagaattctnttcgagtcaaggagaatganaccattcanattgatttanagactgncaagaattactganttcntcaagttcnacactggtaacctgt

SEQ ID NO: 6520 - DNA, 100 bp, Homo sapiens
  misc_feature 10, 12, 28, 32, 41: n = A,T,C or G
acactatatntntttctaaattcaactngaanatgtgtatntcccctgaccttcaaaaaatgttccaaggtaagcctggtaaaggtcatcccaccatcac

SEQ ID NO: 6521 - DNA, 100 bp, Homo sapiens
  misc_feature 11, 18, 32, 35, 36, 42, 49, 54, 67, 69, 73, 80, 84, 89, 98,99: n = A,T,C or G
gacgagtaggncagttcntttccttgggtccnggnnactatngagctgnagcanaagatcagagcananatgnggctaancagntgcanggcaattgnng

SEQ ID NO: 6522 - DNA, 113 bp, Homo sapiens
  misc_feature 1, 6, 27, 38, 49, 50, 72, 75, 82, 94, 96: n = A,T,C or G
ntatcnttcgggcgccttgcaggcccncactagtggantcaaagaattnnttacgagtggacatgagagccnctnggcgccncaggagggctgngngttactagaaacaacgc

SEQ ID NO: 6523 - DNA, 107 bp, Homo sapiens
  misc_feature 12, 18, 25, 29, 41, 55, 56, 65, 66, 67, 71, 76, 79, 86: n = A,T,C or G
gggcgcttgcangacccncactagnggantcaaagaatttnttcgagggcaaatnnagattatgnnnctcnaattntgntacttgnttggctgttcatgtggtcacg

SEQ ID NO: 6524 - DNA, 150 bp, Homo sapiens
  misc_feature 6, 24, 46, 120: n = A,T,C or G
actctncctctttcctggtatacnaagatggaagtaggagagcttnttttctaactaccatctgaccagacaaggaatgaagcaatgactgtgggccgggaaactggacctacctctctncccactgcaaatttgtgggatagaccaaaa

SEQ ID NO: 6525 - DNA, 100 bp, Homo sapiens
  misc_feature 16, 20, 35, 44, 67: n = A,T,C or G
ccggaaaacttgaatnggcnaaacggtctaatatnccattaaanctttaaaaagactagcccactancttagcaatttaaagaaaggatactacgcacta

SEQ ID NO: 6526 - DNA, 100 bp, Homo sapiens
  misc_feature 15, 24, 31, 36, 49, 57, 63, 73, 84: n = A,T,C or G
tatagagtaccgggnacagaaganctcacgnctccncatcattgacatngcagcccntggacntaggagggcncgagcgggaantcggggaggacatagg

SEQ ID NO: 6527 - DNA, 114 bp, Homo sapiens
  misc_feature 10, 17, 31, 35, 71, 80, 81, 87, 94: n = A,T,C or G
cttaacttancacttcnccagtggcacaatnagcnctcaggcaatgtttattggagtgaagaccaattccngatttgaanntagggntggaganatgccaaacaccgggctgat

SEQ ID NO: 6528 - DNA, 110 bp, Homo sapiens
  misc_feature 14, 18, 20, 21, 38, 41, 45, 50, 59, 69, 70, 82, 85: n = A,T,C or G
tactatcccactgncccnannatctagttgagaaaacngangctnagagncttacgacntggccaaagnnacatagcttctnagnggcaaagtgggattgtatgccaggc

SEQ ID NO: 6529 - DNA, 120 bp, Homo sapiens
  misc_feature 9, 13, 15, 27, 58, 89, 95: n = A,T,C or G
cgaggggcnaagntnttacggccgctnggtcaggagctgccctctcatggggtacccnggataaaccatctatagagaggacatacccngctggnctgctgggcagaggataagattttg

SEQ ID NO: 6530 - DNA, 149 bp, Homo sapiens
  misc_feature 9, 10, 33, 35, 39, 53, 60, 65, 70, 77, 85, 86, 87, 91, 120,138: n = A,T,C or G
caacagctnntaaaattcatgcctagcagcggntntctnaatgaaatgcatgngggggantgggnaaacntgcaaanggaaactnnnccantaagagccccagcacaaaggaggacgggngaatcggtcccatgaaanccaaggagggg

SEQ ID NO: 6531 - DNA, 135 bp, Homo sapiens
  misc_feature 16, 17, 30, 39, 41, 47, 52, 58, 70, 75, 77, 78, 80, 90, 99,101, 102, 119: n = A,T,C or G
aaactcctgggccgcnngaaggccttaaanaggcactgnancatggngctgnagaacntgaaagagatgnggacngnngnacccaagagnggcaagggnannaagaagtccaagccagncaacaaagaccgctac

SEQ ID NO: 6532 - DNA, 113 bp, Homo sapiens
  misc_feature 3, 20, 30, 32, 33, 35, 36, 39, 56, 62, 65, 84, 85, 110: n = A,T,C or G
cancgggatattaagttggnctaaatgctntnncnncanaggattatcacggggcntctacncantgaaaaaccgtgataattnnttgtttctaaaataaacatttgaanatt

SEQ ID NO: 6533 - DNA, 118 bp, Homo sapiens
  misc_feature 6, 12, 17, 21, 30, 34, 42, 49, 56, 66, 67, 68, 69, 74, 99,105, 110, 114, 116: n = A,T,C or G
tacagngacaancagancatnctgccttanaggngctagatncccgaanttagaanaccctttctnnnncagtnatgaagttataaatatcagcttgtncatccnagccnctgncnga

SEQ ID NO: 6534 - DNA, 100 bp, Homo sapiens
  misc_feature 14, 18, 39, 55, 73: n = A,T,C or G
aagccgacactagnggantcaaagaattttggacgaggncaactgtgcctctcanaacatcacctaccactgnacgcaacaggcatagcatacatggatg

SEQ ID NO: 6535 - DNA, 103 bp, Homo sapiens
  misc_feature 2, 5, 37, 44, 48, 55, 61, 62, 67, 82, 86, 92: n = A,T,C or G
gnacnagcctcctagagttttcctcggaaacactctngaatgtntgantgagggncctgcnnacctntttggcctgtgagangctnagaaantttttattttt

SEQ ID NO: 6536 - DNA, 129 bp, Homo sapiens
  misc_feature 13, 21, 34, 41, 50, 58, 61, 76, 78, 79, 82: n = A,T,C or G
caaggacgggaancctgacantgagacctacctncaccggntcgggcgcncgggccgnttnggcaagaggggcctngnngcnaacatgggggacagcaagcacagcatgaacatcctgaacagaatcca

SEQ ID NO: 6537 - DNA, 101 bp, Homo sapiens
  misc_feature 12, 39, 97, 98: n = A,T,C or G
ggaattcggggnggacgtggggccggacggcttgttggnaaaacctgaacccagaaacaacacaatccgtagcaaacccgaaggacccaaggacttnncaa

SEQ ID NO: 6538 - DNA, 141 bp, Homo sapiens
  misc_feature 8, 13, 17, 33, 37, 40, 50, 53, 66, 67, 80, 89, 92: n = A,T,C or G
cacgagtnttgcngatntaatggcctagaggantcanaanacctgaagtnacnaaaggctcaacgnnaacaagctatcanggctgctanggnagcaaaaaaggctaagcagggcatctaaaaagactgcaaatggctgctg

SEQ ID NO: 6539 - DNA, 101 bp, Homo sapiens
  misc_feature 2, 4, 6, 22, 25, 36, 38, 39, 42, 45, 64, 70, 77, 91: n = A,T,C or G
cncntnacaagcaatgcagatnatntgcccaaaggngnnctnttnttcagattcagcatttganctttgncagtctnattttcatcttctnccatggttcc

SEQ ID NO: 6540 - DNA, 114 bp, Homo sapiens
  misc_feature 1, 12, 38, 62, 68, 87, 96, 102: n = A,T,C or G
naatttgagganatcccaattgcacacattaaagcatnccacaacaacacacagatccaggnagtctntgctagtaatgagcccctngcctttgcntcctgnggcacatgaggg

SEQ ID NO: 6541 - DNA, 246 bp, Homo sapiens
  misc_feature 15, 30, 33, 35, 37, 52, 78, 96, 97, 98, 106, 150, 152, 178,197, 207, 212, 236, 242: n = A,T,C or G
tctgcaatggatggncgggcggaactgctncantntnctgatcaagaggaanaagcggacctacagccctgagcccantaacttgaaggcccgaannnccttccgntacaacggactgattcaccgaaagactgtgggagtggagccggnanccgacggcaaaggtgtcagaggtggncattaagcggatatccggncagcggaagnctgcnaccttctatgtgcggaccaccatnaacaanaatg

SEQ ID NO: 6542 - DNA, 200 bp, Homo sapiens
  misc_feature 1, 8, 24, 30, 45, 49, 60, 61, 63, 82, 98, 125, 154, 156, 177: n = A,T,C or G
nacgaggnaacattgaactcccangagcanatccacattcctctngagntctgcagcttnngngtaaataggggcagctggngactatgccgtaaaancacatgatctgaggaccattcatggangctggtaaatagcctaatctggggagttntncataaagttttgcatggagcnaacaaacaggattaaactaggtt

SEQ ID NO: 6543 - DNA, 101 bp, Homo sapiens
  misc_feature 17, 21, 25, 40, 42, 53, 55, 66, 67, 72: n = A,T,C or G
tgggggtcggacggtgngggnagancgcaaggcctacacnanaaaacgctgancngcggtatggtnncttgnaacttcatgtaccagcgtaaagatgaaag

SEQ ID NO: 6544 - DNA, 100 bp, Homo sapiens
  misc_feature 2, 9, 31, 38, 40, 59, 64: n = A,T,C or G
cnctacganagtacaaggaatgcggggcagntgggtgncnacccgcaaatgccacacgncgacnctctaccgcatgcgaatctgtgagcctaagcatgta

SEQ ID NO: 6545 - DNA, 100 bp, Homo sapiens
  misc_feature 28, 46, 52: n = A,T,C or G
taaggagttagcttttcatgattacccnattccattacaagcatangaatgnatgtgagttcaagcctactgagtgggcctttggcctattcaaggagca

SEQ ID NO: 6546 - DNA, 100 bp, Homo sapiens
  misc_feature 11, 20, 27, 49, 69, 85, 95: n = A,T,C or G
gccacactagnggattcaangaattcntttcgagatttaaattgctgangggctggcggtgttgcttcntagacacagtatcatnacattccctngagtt

SEQ ID NO: 6547 - DNA, 100 bp, Homo sapiens
  misc_feature 59: n = A,T,C or G
gccccactgggggattcaaagaatctcttttcgagcctaaaaagcggaggtgggtccgnaaccttaagacattagcaagaaatcacaacttcatgacaag

SEQ ID NO: 6548 - DNA, 112 bp, Homo sapiens
  misc_feature 3, 14, 29, 42, 43, 44, 47, 48, 58, 65, 67, 84, 88, 103: n = A,T,C or G
aanactccgatggnagacaggactctccngctggggaactgnnnaanncggtccaacngcccacngngcaacacagatatctgnttgnagaagacaatctttnacggtctac

SEQ ID NO: 6549 - DNA, 104 bp, Homo sapiens
  misc_feature 13, 15, 17, 41: n = A,T,C or G
cgggcgcttgcangncnacactagtggattcaaagaattcntttcgagccttgtaggcctaactgccctgatccaagtgccaatggatggcaggaatgcctaca

SEQ ID NO: 6550 - DNA, 426 bp, Homo sapiens
  misc_feature 325, 357: n = A,T,C or G
aacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgntaactgtgaacatacttgtttttaagtggttntgggttcaaagccaatttggagacctagacattcagctcactgcttaactcaacattaaattttatgat

SEQ ID NO: 6551 - DNA, 100 bp, Homo sapiens
  misc_feature 2, 12, 46, 80: n = A,T,C or G
cnggcgcttgcnggcccacactagtggattcaaagaattcggttcnagctcatgtctgttttcacctgcctgtctgagtntctgaaccacatgttaagga

SEQ ID NO: 6552 - DNA, 122 bp, Homo sapiens
  misc_feature 3, 15, 30, 41, 44: n = A,T,C or G
cgngcgcttgcaggncgacactagtggatncaaagaattcnttncgagagaaagatcgattgagcccaggagtttgagaccagcctgggtaatatagcgagaccccgcctctacaaataatt

SEQ ID NO: 6553 - DNA, 101 bp, Homo sapiens
  misc_feature 16, 31, 80, 91, 96: n = A,T,C or G
ggattcaaggaattcntttcgagcagaaaanggagatttaatcctaaaactgtgactcggggaggtgaggcgtttacagntagacctgtgnctctngactt

SEQ ID NO: 6554 - DNA, 100 bp, Homo sapiens
  misc_feature 99: n = A,T,C or G
ggcccactagtggattcaaagattcggtagagcttgctagcttacttgttcctgagaacctaatattttctcatagttatggagctataatatcatatnt

SEQ ID NO: 6555 - DNA, 100 bp, Homo sapiens
  misc_feature 3, 11, 68, 75, 81, 95, 99: n = A,T,C or G
ggngcttgcgngtcgacactagtggattcaaagaattcggcgagcgcgaatcttacagaccggacaanaagcacngaacangagccggagccggngcang

SEQ ID NO: 6556 - DNA, 100 bp, Homo sapiens
  misc_feature 29, 34, 43, 48, 52, 59, 68, 73, 79, 88, 92, 95: n = A,T,C or G
caaaaagtattcaaaatttgatatgctgnttagncgctacggngcccncaangggcacnaaggtgcanccttntttatnttgcctgcnagantgngaagt

SEQ ID NO: 6557 - DNA, 154 bp, Homo sapiens
  misc_feature 7, 23, 25, 39, 41, 59, 66, 67, 72, 107, 153: n = A,T,C or G
ttcgagngcacacctatagtccnanctataaggctgganantcacttgaacctgggagnctgaggnngaggngagccgagatcgcgccactgcgctccaacctgggngacagagtgagactccatctcaaagaatatccatttcaactatggnc

SEQ ID NO: 6558 - DNA, 100 bp, Homo sapiens
  misc_feature 3, 21, 28, 33, 73: n = A,T,C or G
ggnatcacacagctagaaagnggggggnccgtnccacacctaaggctttctgactccagaactcccctttcancctcttctctagtacgtaaggagccga

SEQ ID NO: 6559 - DNA, 101 bp, Homo sapiens
  misc_feature 13, 19, 26, 30, 31, 42, 45, 50, 56, 57, 60, 66, 69, 79: n = A,T,C or G
cgggcgcttgagngtccgncactagngganncaaagaatacnttncgagngagctnnggntctccngantgtaagaaancaaaatctaaaacaacaatctg

SEQ ID NO: 6560 - DNA, 100 bp, Homo sapiens
  misc_feature 8, 13, 31, 38, 54, 84: n = A,T,C or G
tacgaggntcagncagccaatattccgttanccaaagntaccaaatgtgacttngtgcccacacactgtacaatatgatgtgtnaatgctgcgtgccgga

SEQ ID NO: 6561 - DNA, 140 bp, Homo sapiens
  misc_feature 42, 60, 64, 77, 80, 82, 91, 101, 110, 129: n = A,T,C or G
atgatgttagctggttatttggcttgttagctgatgcagttnctccctagcatctatggncttnaccatttggcatnttntngcagtggcngggatcaggngttcctttncatgtttagagcttccttnaggagctcttt

SEQ ID NO: 6562 - DNA, 101 bp, Homo sapiens
  misc_feature 17, 25, 40, 42, 50, 61, 63, 68, 72: n = A,T,C or G
cgggcgcttgcaggccnacactagnggattcaaagaattntntacgagcnctactgagcancngagcnctgncggacactgctggcgggggctcagggagc

SEQ ID NO: 6563 - DNA, 102 bp, Homo sapiens
  misc_feature 57, 67, 93: n = A,T,C or G
ccgcaggctcctcaataggttaggcatggacaaaatctatgaaggcctaaaggccgngactggggangaatacaatgaggaaagcattgatgntcagccagg

SEQ ID NO: 6564 - DNA, 100 bp, Homo sapiens
  misc_feature 9, 39, 51, 66, 80, 84: n = A,T,C or G
ctgtgtttntaagaagaaataattaggttccagatgtgnaaaaggatcttntgtactgaggttctnaacactttacttgngttnaccaagcctcaactgg

SEQ ID NO: 6565 - DNA, 186 bp, Homo sapiens
  misc_feature 15, 17, 30, 44, 55, 73, 78, 81, 82, 83, 84, 87, 91, 95, 116,164: n = A,T,C or G
cgggcgcttgcaggncnacactagtggatncaaagaattctttncgaggctgccnggaaaattctcggatatnaccgntgnnnngcnggcnggcnggcggatggcagcgtccgctnccccatctctaggcctagaaggcgctgaggccctactgaggctgcggngcgcttcgggggtttcccagat

SEQ ID NO: 6566 - DNA, 100 bp, Homo sapiens
  misc_feature 17, 25, 44, 55, 89: n = A,T,C or G
cgggcgcttgcgggtcnacactagnggattcaaagaattcgttncgagctgccgntcttttcagtttttgcttatacagcaattcactnctttgctgctt

SEQ ID NO: 6567 - DNA, 104 bp, Homo sapiens
  misc_feature 8, 23, 36, 40, 43, 51, 76, 82, 93: n = A,T,C or G
acactagnggattcaaagaattntttacgaggcgantggngangatgtacnatttcgggctgacaacttgaacaanctgaanaacctatgcanctagacaatcg

SEQ ID NO: 6568 - DNA, 113 bp, Homo sapiens
  misc_feature 15, 17, 29, 30, 41, 43, 54, 70, 72: n = A,T,C or G
cgggcgcttgcaggncnacactagtgganncaaagaattcntnacgagatcgcntgagtgtgtgtgactntnattttttctttctttgtctataagaaggaaacataccatag

SEQ ID NO: 6569 - DNA, 100 bp, Homo sapiens
  misc_feature 12, 15, 80, 83: n = A,T,C or G
cgggcgcttgcnggncgacactagtggattcaaagaattctgcacgagctgaatacttcttccctgccaggccgcgctgnganctggcttcactgcctcc

SEQ ID NO: 6570 - DNA, 104 bp, Homo sapiens
  misc_feature 11, 12, 34, 41, 43, 50, 69, 72, 92, 95, 96, 97: n = A,T,C or G
cgggcgcttgnnggccgacactagtggattcaangaatttngnacgaganttattataactttgttccnganaacactggacacactgaagnggnnnacagcgt

SEQ ID NO: 6571 - DNA, 100 bp, Homo sapiens
  misc_feature 2, 4, 28, 30, 43, 45, 56, 63, 66, 73, 77, 79, 97: n = A,T,C or G
gncnacactagtggattcaaagaattcntncacgagggcaccngngatccccgctnctcgggnggntgaggcnctanantcatttgaaccctggagncct

SEQ ID NO: 6572 - DNA, 100 bp, Homo sapiens
  misc_feature 28, 31, 55, 56, 73: n = A,T,C or G
ggccgacactagtggattcaaggaattntgnacgagtgtaattagaaaacacagnntataagaacagtcaatnttttaaattttccaaattaaaaaattg

SEQ ID NO: 6573 - DNA, 100 bp, Homo sapiens
  misc_feature 5, 14, 55, 63, 65, 67, 87, 98: n = A,T,C or G
gcgcntgcacgccnacactagctggattcaaagaattctgcacgaggcgatgggnatatgtgngnanatctggcacaatcgccgaanaaccgggggcnag

SEQ ID NO: 6574 - DNA, 102 bp, Homo sapiens
  misc_feature 2, 4, 62: n = A,T,C or G
gncnacactagtggattcaaagaattcttcactacaagccaagacgggaactgaaggtgtgngtgtcgagccctctggcccagggttaacactgggtcaaat

SEQ ID NO: 6575 - DNA, 100 bp, Homo sapiens
  misc_feature 2, 40, 71, 94, 97: n = A,T,C or G
gnccacactagtggattcaaagaattcggttctagggctncaaggctgtggtgtctgggaaactccgaggncagagggctaaatccatgaagtntgngga

SEQ ID NO: 6576 - DNA, 100 bp, Homo sapiens
  misc_feature 6, 13, 39, 41, 61, 98: n = A,T,C or G
ggcgcntgcaggncgacactagtggattcaaagaattcntnacgagcccgacactgcgggntggcacaacggcaccctcccgctttctctctgcctcnga

SEQ ID NO: 6577 - DNA, 145 bp, Homo sapiens
  misc_feature 11, 13, 27, 33, 36, 39, 54, 56, 63, 66, 67, 72, 76, 80, 84,90, 127, 132, 137: n = A,T,C or G
gacatggccanangtaccaagaaagtngggatngtnggntaatacgggacccgntntggggcnttnntgcgnaaantggngaanaaaatngaaatcatgccagcacgccaagtacacttgctctttntgtgncaaanccaagatg

SEQ ID NO: 6578 - DNA, 100 bp, Homo sapiens
  misc_feature 53, 93, 99: n = A,T,C or G
gtcatataggtacattgaggcgatggcttacttaatacttctgaaaaatgganaaagggagaaacggaaatgctgcaatgtgaacctcccatngggccnt

SEQ ID NO: 6579 - DNA, 100 bp, Homo sapiens
  misc_feature 12, 46, 55, 70, 74, 84, 98: n = A,T,C or G
tggcgcttgcangacccacactagtggattcaaagaattcttttcnagctcttgntttgaggggacctanaggngacttggganaaaagggggagcgngg

SEQ ID NO: 6580 - DNA, 100 bp, Homo sapiens
  misc_feature 4, 28, 31, 35, 45, 48, 58, 64, 68, 75, 80, 89, 91, 92, 98: n = A,T,C or G
aacngttccccacatccttactggctgnctnattntatggatgtntgnacgtggtctntaccgnttgncggaganaaagngaaagaaangnnggtaantg

SEQ ID NO: 6581 - DNA, 100 bp, Homo sapiens
  misc_feature 2, 40, 45, 55, 59, 62: n = A,T,C or G
cnggagcttgcaaggcgacactagtggattcaaagaattntttangagtgacctncacntcnccgccctgcgtgcaagtgaagcggaatgactacgtgcc

SEQ ID NO: 6582 - DNA, 126 bp, Homo sapiens
  misc_feature 7, 10, 13, 30, 38, 40, 56, 73, 90, 92, 97, 112, 123: n = A,T,C or G
gcttgcnggnccnacactaggggattcaangaattctntncgagggcaaaagaggnatgcatgtgtgcccatnccttctgtctgtctgananaatcnataatgcctctaaanccttgagcgcncgt

SEQ ID NO: 6583 - DNA, 100 bp, Homo sapiens
  misc_feature 2, 4, 26, 28, 41, 50, 76, 82: n = A,T,C or G
ananccactcctcaaccttgtgctgnanggcaccattgagnacatgcganaccctgacgaccagtacaagctcacngagganacccggaaactgggcctc

SEQ ID NO: 6584 - DNA, 169 bp, Homo sapiens
  misc_feature 7, 14, 29, 30, 55, 65, 71, 80, 83, 89, 112, 156, 158: n = A,T,C or G
gggcgcntgcaggncccacactagtgganncaaagaattttttacgagaacgggnacaaacgagncctggncttgtgtgnggngacggnttacaccttcccacttgctgaanaggtcaaggccttcttggctgatccatctgcctttgtggctgcngnccctgtggctg

SEQ ID NO: 6585 - DNA, 101 bp, Homo sapiens
  misc_feature 2, 8, 18, 44, 47, 48, 55, 59, 64, 67, 70, 76: n = A,T,C or G
cnggcgcntgcaggcccnacactagtggattcaaagaatttttncannagggaangagngaggnacnggngacgtnaagctcctgaagcacaaggagaaag

SEQ ID NO: 6586 - DNA, 106 bp, Homo sapiens
  misc_feature 12, 30, 41, 44, 49, 56, 58, 66, 70, 92, 94: n = A,T,C or G
gggcgcttgcangacccacactagtggatncaaagaatttntangagcnggatagntntatgcggntctnacagcacatcacctctttgccncngacggctgtgac

SEQ ID NO: 6587 - DNA, 100 bp, Homo sapiens
  misc_feature 92: n = A,T,C or G
tccatcgttcaccggaaatgcttctaaacggactcaccggatgcgtagattctgctgcttgggtgaatggagaatagaaatttgcccctggnaaatgcgc

SEQ ID NO: 6588 - DNA, 140 bp, Homo sapiens
  misc_feature 2, 9, 11, 23, 28, 30, 37, 43, 48, 68, 73, 75, 84, 89, 95,98, 116, 121, 129: n = A,T,C or G
anttgacananaggggaaacccngaaangnggttggntgcagntgtgnagtatgttaaggactatggnacggngnctcaggccnaggangtcatngangagtatttcaaatgcaanaaatnaagaaatnaatctttggct

SEQ ID NO: 6589 - DNA, 100 bp, Homo sapiens
  misc_feature 6, 13, 28, 53, 56, 65, 78, 82: n = A,T,C or G
ggcgcntgcaagnccacactagtggatncaaagaattcttttacgagccttgnagnattcttggncttttgctgcctncctnactctcacggtaattaat

SEQ ID NO: 6590 - DNA, 120 bp, Homo sapiens
  misc_feature 16, 33, 38, 46, 48, 62, 71, 84, 92, 101: n = A,T,C or G
cactagtggattcaangaattctttttcgagcngaaangctgcatncntgtccaagtgcctnggagaactnacagacactcacnccttaatnaaaggtttnaccaggcccttggacacta

SEQ ID NO: 6591 - DNA, 100 bp, Homo sapiens
  misc_feature 1, 14, 33, 36, 37, 52: n = A,T,C or G
ncatcttcttaccntggcttccacagaagctcnganncttgggcaagcgganaaactaaattgtacctatgttgcttatgtgagatggtgaaataaattg

SEQ ID NO: 6592 - DNA, 170 bp, Homo sapiens
  misc_feature 1, 12, 14, 41, 44, 45, 54, 55, 58, 68, 79, 82, 83, 107, 118,120, 128, 131, 135, 151, 161, 168: n = A,T,C or G
nggcgcttgcangnccacactagtggattcaaagaattcgntannaggacctgnntgnctaagtggcngaggccagcgngcnntgagctggcctgcctggaccttgntccctgggggngngggcgctngcncacnagagggaccaaagggngcacccacancctgctnca

SEQ ID NO: 6593 - DNA, 100 bp, Homo sapiens
  misc_feature 2, 17, 32, 37, 41, 60, 90: n = A,T,C or G
gnttcccctttgaactnccagaagggatgccntaccntgcncccttaggacccggactgnccgagtgcacaaactttacgagccaaaatnctaaaagaat

SEQ ID NO: 6594 - DNA, 199 bp, Homo sapiens
  misc_feature 18, 41, 65, 68, 108, 129, 135, 142, 154, 160, 177: n = A,T,C or G
acgagtccattgaaagantgggtggcatgatataaggcccnaaggccttttcttttagagtttanatntaatatgacagattagcccttatttctcgatgctgggaancactgacagaaaccaagctangacgcngggaaanggccaataaganatagtntaaatctctctctgctntgtggcaaataaaaagtaaata

SEQ ID NO: 6595 - DNA, 101 bp, Homo sapiens
  misc_feature 16, 17, 39, 40, 67, 70: n = A,T,C or G
ggcgggagaaaaagtnnaaaagccgaatactaaagagannaaacccgaagccccgaaggttgatgcnggnggcctggtgaaaaagggtaacctgaaagctt

SEQ ID NO: 6596 - DNA, 100 bp, Homo sapiens
  misc_feature 3, 19, 31, 35, 38, 40, 45: n = A,T,C or G
cgncactagtggattcaangaattcttttcnaggntangngttgnaagatggttagacgtacctatggcgcttgggcacaaggtgccaatgggattctgc

SEQ ID NO: 6597 - DNA, 100 bp, Homo sapiens
  misc_feature 11, 15, 42, 45, 67, 82: n = A,T,C or G
ggcgcttgcangccnacactatgtggattcaaagaattttgnacnagaaagccttacccactacccntcccactctcctgtnatccaggtggtccaggag

SEQ ID NO: 6598 - DNA, 101 bp, Homo sapiens
  misc_feature 41, 63, 65, 81: n = A,T,C or G
gatgaggcttccaagaatgaggcaaaactggattgaggcancttctgaagataaaacctgaanangtgctgggagcctggnattctatattatgactgctt

SEQ ID NO: 6599 - DNA, 116 bp, Homo sapiens
  misc_feature 79, 108: n = A,T,C or G
acgaggccaggatgagatgtgcagagatgcgtaagagatgtccaaggcatataggcaactcttcatcctactttatctnacttcaattacttcatcctactatgctanaaggaagg

SEQ ID NO: 6600 - DNA, 122 bp, Homo sapiens
  misc_feature 3, 10, 36, 39, 46, 52, 63, 70, 71, 81, 85, 99: n = A,T,C or G
tgnacgagcntcaaagctacacagacatgggcctangtntgtacanctgtantaatttataanttactgnntggctggaangtanaagtacagaaaatntgttaaagggaattaagatggag

SEQ ID NO: 6601 - DNA, 105 bp, Homo sapiens
  misc_feature 2, 7, 16, 31, 34, 44, 48, 55, 67, 71, 75: n = A,T,C or G
tnctccnaccgttcgnctgcttggcaaggcngtncaggacgtgnactnccccaantcggcactgagnggcncagnaccgcatagccctgcaaccctactgcccta

SEQ ID NO: 6602 - DNA, 100 bp, Homo sapiens
  misc_feature 9, 27, 28, 83: n = A,T,C or G
aaacagccnccgaaaacgctacgtganntgggccctgggccccaggcccaaaacggacggaagaaaaggtctggccgatgggnctcactctgtcacccag

SEQ ID NO: 6603 - DNA, 100 bp, Homo sapiens
  misc_feature 2, 19, 46, 52, 92: n = A,T,C or G
cnacactagtggattcaangaattcttttcgaggctacaacgtggnggcctnctggagacaggctgaactcatctacatccgatactcccanatttgtgc

SEQ ID NO: 6604 - DNA, 100 bp, Homo sapiens
  misc_feature 2, 14, 31, 52, 61, 63, 70, 82, 92: n = A,T,C or G
gngcttgcacggcnacactagtggattcaangaattcggcacgagctcactntctgcgtgnangccatcnacttctactctnaagacctgcnagctgggg

SEQ ID NO: 6605 - DNA, 100 bp, Homo sapiens
  misc_feature 3, 4, 48, 65, 71: n = A,T,C or G
ganngaaaggcagaacaggagaaagggagttcccagacagcgctaccncccagccaggaaatggngattgntttctcaacaagaaaatgagaggcaggta

SEQ ID NO: 6606 - DNA, 100 bp, Homo sapiens
  misc_feature 8, 11, 29, 43, 46, 47, 54, 61, 65, 69, 76, 78, 82: n = A,T,C or G
gctgcagnganctatgattgcaccactgnaccccagcctgggnganngatcganaccctgnctcnctgntacccancngccnctacgaagtttccaaatg

SEQ ID NO: 6607 - DNA, 140 bp, Homo sapiens
  misc_feature 3, 5, 20, 100: n = A,T,C or G
aancntgaacccctaaacancacaatccgttgctaacccgaaggacccaaggactttccaatctcagacactctaggactctgcgctgaatggctgaccngacctgatgtccattcatcccaccctctcacagtttggac

SEQ ID NO: 6608 - DNA, 100 bp, Homo sapiens
  misc_feature 4, 11, 47, 52, 57: n = A,T,C or G
catnccacccnctacctccatatgggaccttgcaagccatcccacangctgnactgncaggaagaggaccctgggccccagcactgggcttcagctataa

SEQ ID NO: 6609 - DNA, 100 bp, Homo sapiens
  misc_feature 11, 15, 29, 31, 36, 45, 54, 57, 60, 75, 76, 92, 96: n = A,T,C or G
accccatgggnactnagcacatcaaggangngaggnagtggggancaaggaagnctngcnggggccaggcaccannggctcatgcctgtaangctngcac

SEQ ID NO: 6610 - DNA, 106 bp, Homo sapiens
  misc_feature 37, 42, 86, 98: n = A,T,C or G
ctcgcgacgtgagattatccacatcctctcttctccnctacnggtggagagggggagaggcagccatgttgatatggactgataangctcagacaggngtgtcccc

SEQ ID NO: 6611 - DNA, 103 bp, Homo sapiens
  misc_feature 25, 26, 42, 51, 52, 55, 57: n = A,T,C or G
gacactagtggattcaaagaattcnntacgagcttcttactnctgaaggcnntananagaacccagactagcacatgccgagatttgagacttagccacccag

SEQ ID NO: 6612 - DNA, 100 bp, Homo sapiens
  misc_feature 2, 4, 62, 66, 75, 81, 84: n = A,T,C or G
gncnacactagtggattcaaagaattctgcactagcgaggctggtggatcacttgaggcctngagnctgggaccntcctgnccnacatggcaaaacccca

SEQ ID NO: 6613 - DNA, 101 bp, Homo sapiens
  misc_feature 30, 81: n = A,T,C or G
gtctatgtgtgtgcgcgtgcgcctgagggngggcatgagtcttgccatattgtgagtgtgagagtgataatgcgggggtgngtgtgagagggactgcgttt

SEQ ID NO: 6614 - DNA, 100 bp, Homo sapiens
  misc_feature 13, 20, 21, 24, 39, 59, 66, 72, 86: n = A,T,C or G
atttaaaggaacngcggtanngcntcctctgtagagctntgaaaaggttgactatatanaggtctngagtgnttgtacttggtcangtgtttctcacatc

SEQ ID NO: 6615 - DNA, 100 bp, Homo sapiens
  misc_feature 2, 4, 53, 63, 68, 72, 77, 91: n = A,T,C or G
gncnacactagtggattcaaagaattcttttcgaggctcccagctgccctganctcggggggntggcnttcngcccngggaaaagcggaanaggtctgca

SEQ ID NO: 6616 - DNA, 100 bp, Homo sapiens
  misc_feature 18, 24, 33, 45, 47, 57, 62, 70, 74: n = A,T,C or G
aagagctccttaccatcnctgccncaggcgganatgaaattcacncnctttcctggncactnaggacctnaatnctttttcatttgagaagtaaacaaaa

SEQ ID NO: 6617 - DNA, 171 bp, Homo sapiens
  misc_feature 71, 130, 151: n = A,T,C or G
gacaaacagagatatcatttgtcagattgcttatgcccgtatagagggggatatgatagtctgcgcagcgnatgcacacgaactgccaaaatatggtgtgaaggttggcctgacaaattatgctgcagcntattggactggcctgcctgcngggcccgcaggcttctaaat

SEQ ID NO: 6618 - DNA, 264 bp, Homo sapiens
  misc_feature 15, 92, 221, 224: n = A,T,C or G
tccatacggcgttgntctggattcccgtcgtaacttaaagggaaattttcacaatgtccggagcccttgatgtcctgcaaatgaaggaggangatgtccttaagttccttgcagcaggaacccacttaggtggcaccaatcttgacttccagatggaacagtacatctataaaaggaaaagtgatggcatctatatcataaatctcaagaggacctggganaancttctgctggcagctcgtgcaattgttgccattgaaaacc

SEQ ID NO: 6619 - DNA, 176 bp, Homo sapiens
ggtgtgcaccaccatgcctggctaattttttttgtatttttagtagagacagggtttcaccatgctggccaggctggtcttgaactcctgacctcatgatctgcccatctcagcctcccaaaatgctgggatgacaggcgtgagccactgcacccagctccttcagatttttttgg

SEQ ID NO: 6620 - DNA, 294 bp, Homo sapiens
  misc_feature 70, 185, 188, 258: n = A,T,C or G
gttttgtcagttcccagcttcttcgtttagaataaattagaccaaaagaagaaacgtgcttgtctctgtntacccgcagaatgaagttactgttgttaaaactggattttttcattttactaggttccgaagagtccagatgcttggtagatgttcaatacgtgattttttttttaattgaatgngtncatttaaaatcctccttaacatttctagaaagacttctttcaataaataatggaatcttagaggaaaagnggttttttaaaagctagggaactcctccactaaaag

SEQ ID NO: 6621 - DNA, 125 bp, Homo sapiens
  misc_feature 33: n = A,T,C or G
cctacaagaatctggtatgtggctgggcatggntgctcacacctgtaatcccagcactttgggatgctgaaacgggcagagcccaggagctcgagaccagcctgagcaacatggcaaaatcctgt

SEQ ID NO: 6622 - DNA, 227 bp, Homo sapiens
  misc_feature 60, 198: n = A,T,C or G
gtctccctggcctcagggctctgactctgccagggtggggctctctaacccacaggtgtnggctgcctggcccatgtgcccactgtctcttccacttggtctgggtttggcaggcactgcctgctacttgagggccaggatgctcccccagggaagaaacggaatagtgtggggtgtgtgcagggctgcatcccgcanatggctggaatattaaaattcttctatat

SEQ ID NO: 6623 - DNA, 373 bp, Homo sapiens
  misc_feature 69, 303: n = A,T,C or G
ccaaccttcaccatgttctcgtgacaggcaggggcctggagcgcctgagtggggtggggaagggcgtgnagaggacaacaatgagcgccctctccgggatcggtgggtgcagccacctactgactggtggaacactgaaagctctgctgcaggtggggttataggtgggaaactgagtcacagaaaggttgagtgacgggcccaagctcacacaggaagtaaaacagggctgtgggccggaagcagtggctcatgcctgtaatcctggtactttgggaggccgaggcgggcagattgcctganctcatgagtttcaaaccagcctgggtaacatggtgaaaccccgtctctactaaaaatacaaacaaattag

SEQ ID NO: 6624 - DNA, 375 bp, Homo sapiens
  misc_feature 37, 113, 188, 306, 362: n = A,T,C or G
gagggccaggtggtggcggaggggaatgacggtgganggggagcaggaaggccaagcctgggcagcgagaagaagaaagaggacccaaggagagcacaagtcccaccaaccanagagagtcgggtgaaggtcctgagaaaactggccgccactgcaccagcttttccccaacctccctcaacccccanagccaccacccttcctcctgccccagccacaacagtgactcggtccacgtcccgggcggtaacagttgctgcaagacctatgaccaccactgcctttcccaccacgcaaaggccctgnaccccctcaccctcccacaggccccctacaaccactgaggtgatcactgccagganaccctcagtttca

SEQ ID NO: 6625 - DNA, 228 bp, Homo sapiens
  misc_feature 27, 72: n = A,T,C or G
ggcattttaccaagtccggctgaaagngcttcttaccacatctggcatgtagaatggcagaagactattttngctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattac

SEQ ID NO: 6626 - DNA, 292 bp, Homo sapiens
  misc_feature 257: n = A,T,C or G
cggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcntgcaactaattcaataaaactgtcttgtgagctga

SEQ ID NO: 6627 - DNA, 133 bp, Homo sapiens
  misc_feature 34, 78, 82, 104, 132: n = A,T,C or G
gcctaccaaaagtcacgcacgaccatctttcaanacaagaagagggtcctgctgggagaaactggcaaggagaagctnccgnggtactacaagaacatcggacngggcttcaagacacccaaggaggctatng

SEQ ID NO: 6628 - DNA, 351 bp, Homo sapiens
  misc_feature 199, 220, 223, 240, 339: n = A,T,C or G
gccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgnggatggagtcgggtatcctgnacntggttgggacccctggnccaggtgatcccgaccctcaccagtcccatttgcctccctccagctctgcttaggcattttgcccctcaccccaatgttccacaccatcgacaaccaangggtgaaggggg

SEQ ID NO: 6629 - DNA, 404 bp, Homo sapiens
  misc_feature 12, 32, 55, 325: n = A,T,C or G
gcgcaacagccntggcttttaaggataccggnaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcantattgagccaggagttgaggtgggaagtcaccattgcagatgcttaagtcaactattttaataaattgatgaccagttg

SEQ ID NO: 6630 - DNA, 365 bp, Homo sapiens
  misc_feature 52, 262, 321: n = A,T,C or G
gtcatcattgagagcgacctggaacgtgcagaggagcgggctgagctctcanaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttanaagagaaagtggctcatgccaaagaagaaaaccttagtatgcatcagatgctggatcanactttactggagttaaacaacatgtgaaaacctccttagctgcg

SEQ ID NO: 6631 - DNA, 465 bp, Homo sapiens
  misc_feature 349: n = A,T,C or G
gaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcancaggctgcttgagtgggagctgactccaacatgccctgccctggctgggactaggcatgcttccagcccttcccgtgctctccctgctgtcaacacttgcgtacaaacctgcctag

SEQ ID NO: 6632 - DNA, 347 bp, Homo sapiens
  misc_feature 100, 143, 220, 274, 314: n = A,T,C or G
catctgccaccctctccgatatttcatacatcatgacctggaaagtctgcatcactctggccatcacttcctggacatgtggctccctcctggctatggnccatgtgagcctcatcctaagactgcccttttgtgggcctcgngaaatcaaccacttcttctgtgaaatcctgtctgtcctcaggctggcctgtgctgatacctggctcaaccaggtggncatctttgcagcctgcatgttcatcctggtgggaccactctgcctggtgctggnctcctactcacacatcctggcggccatcctgaggatccantctgggggagggccgcagaaaggccttctccac

SEQ ID NO: 6633 - DNA, 469 bp, Homo sapiens
  misc_feature 15, 218, 423, 444: n = A,T,C or G
agtggatccaaaganttcggcacgagggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgngtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatctnctttataattctactttgagngctggctccatgtttgatgtatctg

SEQ ID NO: 6634 - DNA, 108 bp, Homo sapiens
  misc_feature 4, 18, 23, 32, 46, 53, 64, 75, 81: n = A,T,C or G
accntgcgtggctgtccntgacncaccgacgngatgcccagggaanacagggngacctggaaanccaactacttncttaanatcttccaactattggatgattatccg

SEQ ID NO: 6635 - DNA, 100 bp, Homo sapiens
  misc_feature 3, 5, 31, 58, 61, 81, 99: n = A,T,C or G
gtnantgaaggatgggatgaaggaatcgagntgattcaatgaaaagtatcacaagaanagngattgatcaacaaggagaantaaaaaagcccaagaggna

SEQ ID NO: 6636 - DNA, 404 bp, Homo sapiens
  misc_feature 7, 155, 242, 256, 314, 322, 324, 391, 395: n = A,T,C or G
gtcgcgnggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctancacgtggaattcgcgaagctgccaaagccttaaacaagcgccaagcccatctttgtgtgcttgcatccaactgtgatgagcctatgnatgtcaagttgggnggaggcccttttgtgctgaacaccaaatcaacctaattaaggttgatgacaacaaganactagganantggggtaggccttttgtaaaattgacagagaggggaaaccccgtaaagtggttggttgcagttgtgnagtngtttaagga

SEQ ID NO: 6637 - DNA, 436 bp, Homo sapiens
  misc_feature 228, 325: n = A,T,C or G
caaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagnccaccaggagacgcaatccaccaccacgaactcttcatccgatcagcacgagccattcatgtgctgaaacaccaagatctgtggaagaaatcctcanaggagcccgagtcccagtggcacccgactcgctctcctctccctcaccgacgcccctgagtcgaaataatctgctaccacctattggcacagctgaagtggaacatgtgag

SEQ ID NO: 6638 - DNA, 126 bp, Homo sapiens
  misc_feature 89: n = A,T,C or G
cctcgtgccgtgaaagcaaagaaataattttaatactctggcattcataaattttattgatgagattatttattttaaaggtttgaggnaacatctctggttgtaccaaagaagaaataaatatgg

SEQ ID NO: 6639 - DNA, 104 bp, Homo sapiens
  misc_feature 2, 13, 17, 23, 71, 82, 90: n = A,T,C or G
anatgatccttgntgantatctnaaggttttttggttgaaagaagaaaaaccgacaaacaaagcttatttnctcattaaaangaaacctnttttgctacttaag

SEQ ID NO: 6640 - DNA, 100 bp, Homo sapiens
  misc_feature 2, 5, 7, 28, 29, 43, 45, 63, 75, 81: n = A,T,C or G
cnttnangatttaatgcttgcttgctcnntttatacgctaatngngaaatctacaaaccatanacaacgcaactnttaaanctgggatttaaattaaaga

SEQ ID NO: 6641 - DNA, 373 bp, Homo sapiens
  misc_feature 303: n = A,T,C or G
ggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggggtactattttttacaggctggcggattatcatagatgcagctgttatttatcccaccatgaaagatttcaaccactcataccatgcctgtggngttatagcaaccatagccttcctaatgattaatgcagtatcgaatggacaagtccgaggtgatagttaca

SEQ ID NO: 6642 - DNA, 162 bp, Homo sapiens
  misc_feature 5, 11, 12, 24, 27, 50, 61, 69, 84, 101, 139, 143: n = A,T,C or G
cctcnaactgnngctgttcaccantgnatataattgtattccctaggagnaaccctaaaanactcattncagaaaagctcctanaatctttattaaaaagnaatttcagttaaattttttcaaaatttctggaaaaacntttngggactttttttgggttgg

SEQ ID NO: 6643 - DNA, 167 bp, Homo sapiens
caaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 6644 - DNA, 455 bp, Homo sapiens
  misc_feature 204, 326, 423, 432: n = A,T,C or G
cattgtttctaagttcttctatgtttgtaatttccaaacagagcaccggtctttttctcttcctttaagaaaaaaacaataaaaacgaaattcactggctgagtcaatagactccgtgggtcatggaagcaaattacaaagctagtacaatggatttgagaaattgctaatgtaatcagattttgaacaaactttggaaatggnccctatttcacagcaccaagggtatttttataaactgttcattgctttcaacaaccccattataagaccaactaaaagtgagaaaagcaaattcagcagcaacctatcttgtcaagacaaanaaaccttcctcactgttttcagagaaatattcaataccgaataatcctatttgaattttgccactcatagaagtttagaaagagggacttacataanaaattgcancagggcagggaatgaagagtgca

SEQ ID NO: 6645 - DNA, 117 bp, Homo sapiens
  misc_feature 27, 38, 69, 73, 86, 93, 95: n = A,T,C or G
tgatattcactacactgccctctttgnagaatgctttnttgcactttttactgagtctcccagactagnaaantctcaacttctgngctcaantncattaagtgttcaaagaaatag

SEQ ID NO: 6646 - DNA, 364 bp, Homo sapiens
  misc_feature 40, 294, 340: n = A,T,C or G
ggccaggaggcggaagagaggagcacagaagggcagtggntccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagangctgtcccaagagctagatgaagccattatggcggaagagagtggngacattcgtctctctcattcatga

SEQ ID NO: 6647 - DNA, 400 bp, Homo sapiens
  misc_feature 336, 351: n = A,T,C or G
cagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgangagatgactcgctgnggcttctcgttggccttgggcgcccttccaggcttccttctgaaaggcc

SEQ ID NO: 6648 - DNA, 262 bp, Homo sapiens
  misc_feature 190: n = A,T,C or G
cccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgnggccgcaccgtgggtgtgtccaagaagaaataagtctgtaggccttgtctgttaataaatagtttatatacc

SEQ ID NO: 6649 - DNA, 361 bp, Homo sapiens
ctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatg

SEQ ID NO: 6650 - DNA, 357 bp, Homo sapiens
  misc_feature 153, 252, 307, 314, 347: n = A,T,C or G
cagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctnctatgtgcggaccaccatcaacaagaatgctcgcgccacgctcagcagcatcagacacatgatccgcaagaacaagtaccgccccgacctgcgcatggnagccatccgcagggccagcgccatcctgcgcagccagaagcctgtgatggtgaanaggaaancggacccgccccaccaagagctcctgagccccntgcccccaga

SEQ ID NO: 6651 - DNA, 373 bp, Homo sapiens
  misc_feature 117, 245, 251, 258, 292: n = A,T,C or G
gagggacagtctgcccatcgacggctggaggagtccctggacgccctgccccgcatctttgggcctggcagcatggccagcacagcattctaaactattcacccatgggttcctggngcccctttccccccactttcagggctcaccaggcactggcagggagggtaagggctggctccatatacccctcccccacagattcctagcaatgaaaatctaatatattcttctgttgcccctggggntggagnagtcagngcctgcagtcaagtgcctcccagcctcggctcancacatcccttgccacaaatcagtgtctggggcttggccaccctgccgctgcccagccacatcccttggttttgtattttat

SEQ ID NO: 6652 - DNA, 436 bp, Homo sapiens
  misc_feature 13, 219, 303, 384, 399, 412, 434: n = A,T,C or G
catacggcgttgntctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctggganaagcttctgctggcagctcgtgcaattgttgccattgaaaaccctgctgatgtcagtgttatatcctccaggaatactggccanagggctgtgctgaagtttgctgctgccactggagccactccaattgctggccgcttcactcctggaaccttcactaaccanatccaggcagccttncgggagccacggnttcttgtggttactgaccccangg

SEQ ID NO: 6653 - DNA, 255 bp, Homo sapiens
ggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcat

SEQ ID NO: 6654 - DNA, 366 bp, Homo sapiens
  misc_feature 188, 353: n = A,T,C or G
ggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttncacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggnaaaaggaccaaga

SEQ ID NO: 6655 - DNA, 419 bp, Homo sapiens
  misc_feature 208: n = A,T,C or G
caaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagngttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggcttggctttggg

SEQ ID NO: 6656 - DNA, 369 bp, Homo sapiens
  misc_feature 109, 206, 231, 312: n = A,T,C or G
ctagttcttacttcaaaagaaaaataaacataataaaataagttgctggttcctaacaggaaaaattttaataattgtactgagagaaactgcttacgtacacattgcngatcaaatatttggagttaaaatgttagtctacatagatgggtgattgtaactttattgccattaaaagatttcaaattgcattcatgcttctgtgnacacataatgaaaaatgggcaaatnatgaagatctctccttcagtctgctctgtttaattctgctgtctgctcttctctaatgctgcgtccctaattgtacacagnttagtgatatctaggagtataaaagttgtccgcccatcaataaaaatcacaaagttg

SEQ ID NO: 6657 - DNA, 403 bp, Homo sapiens
  misc_feature 7, 60, 62, 312, 329, 337: n = A,T,C or G
ctcctgngggcctggcctcagggctatggacagactcctgtcccatcccagagacccctngngatcgtgccctggtgggtgttgcccccgcctgcctttgcctccgccgtggccctgagagtcctgggctctgccccgcccggtcccttgcttcccactcagctctggatttggggctgcccctaacccagcccgttgctgctttgcaccttttcctgtcattgggcatcccccagtagtcaccccactccaccgaaaagtaaactgcaggcacgtgggccgtggcccggctgggtcggctgaagaactgcngatggaagctgcggaanaggccctngatggggcccaccatcccggacccaagtcttcttcctggcgggcctctcgtctccttcctggtttg

SEQ ID NO: 6658 - DNA, 353 bp, Homo sapiens
  misc_feature 251: n = A,T,C or G
gaccagagatgtctttggaatgcacagaggtgtagtgacacgcagggagggagttttgtttttgaactctttggaataagattccttccaacataaaaatctcaagagattaagcaggaagtgattctggccttggcatgagttcagaggaacatgaaccgagtgtgggtaaatgtaaaatcacactgtggggagaggctggggtatttgagggcttctaccaggagaagagttctcagatgcctgatggnagttgagcaggggtggaattaaacctttttcctgtggcacttggaggtagaacaaggaggcatattggactctgtataaggaaggctttttgaatggtaaga

SEQ ID NO: 6659 - DNA, 320 bp, Homo sapiens
  misc_feature 34, 41, 111, 160, 166, 184, 274, 287: n = A,T,C or G
ggatccccaggcctaccaggtaaactgggttctntgggtanccctggcctccctggcttgcctgggccccctggacttcctggaatgaaaggtgacaggggtgtagtcggngaaccgggtccaaagggtgaacagggtgcctctggtgaagaaggtgaancagganaaaggggggaacttgganatataggattacctggcccaaagggatctgcaggtaatcctggggaacctggcttgagagggcctgagggaagtcgggggcttcctggantggaaggaccaanaggaccacctggaccccggggtgtgcagggaga

SEQ ID NO: 6660 - DNA, 440 bp, Homo sapiens
  misc_feature 5, 6, 7, 8, 10, 12, 16, 17, 27, 29, 33, 38, 112, 279, 306,399: n = A,T,C or G
cctcnnnngngnttcnntacgatatcngntcancccangagttcaagacctgcctggacaacatggagaaaccctgtctctacaaaacatataaaacttagatgagtgaagngccatgtgcctgtagtcccagcttctcaggaggttgaggcgggaggattgcttaaacccaggaagttgtggctgcagtgagctaagactgcaccactacactacaacctgggctatagagccagaccctgtctcaaaaaacaacaaaaatgttcgtcagcatatggngactcaaaaagcctggttgctcttggnaagaatcttcaaggaaagatgcgaaagagacgtgttgggagttctgagctgttttctttcagggagcaccctgtgtctcagaagacagcagantgggctccaaggtgaagttctgaaataggcaacagtgcttg

SEQ ID NO: 6661 - DNA, 299 bp, Homo sapiens
cggcacgagcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagagggg

SEQ ID NO: 6662 - DNA, 336 bp, Homo sapiens
  misc_feature 94, 114, 140: n = A,T,C or G
agtggatccaaagaattcggcacgagtgtgagttctgatcacttttgagctctgaagctttgaatcattcagtggtggagatggccttctggtnactgaatattaccttctgtnggaaaaggtggaaaataagcatctanaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaataagtctgtttcaatcttaaaaagaatcaataaaaacaaacaaggg

SEQ ID NO: 6663 - DNA, 354 bp, Homo sapiens
  misc_feature 7, 138, 179: n = A,T,C or G
tgttggncaggatggtcttgatctcttgatctcatgatctgcctaccttggcttcccaaagtgctgggattacaggtgtgagccaccacgcctagcctgagactttcaagtaaagccacaatggaccacagagcttanacatcagggctaacatggaatctctgtcattaaatcttganatcttattatctttgctcaaagaaaaaaataatcacaattgacattttggggacaagacatctgaatgtaaacttgatcttacaggatattaaggaattactggtaattttattaagggtatgacagtgatcatataaaaaatgccctcatgtttttagagggaaagtaaattac

SEQ ID NO: 6664 - DNA, 100 bp, Homo sapiens
  misc_feature 17, 24, 36, 99: n = A,T,C or G
acactagtggattcaangaattcngcactaggtgangaggcctggagtggtggctcacgcctgtaatcccaggactttgggaggccgaggcagcgcagnt

SEQ ID NO: 6665 - DNA, 249 bp, Homo sapiens
  misc_feature 144, 170, 187, 206: n = A,T,C or G
atcacaagctctcaataaacagttgtagtattgttattcaaattggtacacaggcctatcacttctccttccttttagatctttttttccctctgttctcgcctctgagtgccccaacccaatctctcttcctctgtcaccttnttaggaaatccatgcccacccaactnaccccaccactcctaanattccttaattcctttctntcctacccctggcctccaccacagctcctccattccccacctg

SEQ ID NO: 6666 - DNA, 299 bp, Homo sapiens
  misc_feature 44, 80, 157, 173, 255, 257: n = A,T,C or G
gggccttactggggaccctgcccccttccacccaggactctgtntgcctcctgctgccattcatggccctggggcttggncccaaccccactccaagatcagagagcaggcaactctgagcctgcagggacagggggtctttcctgggacacccganggtgctgactgcaganacgcccaggtgctgcatgcctaggagggcagccacagctgcaccccagagctcccaccccaccaactcagaagaggcagggntnccccttttcccgtcccctgcctgctttgtggaacgggaggcc

SEQ ID NO: 6667 - DNA, 353 bp, Homo sapiens
  misc_feature 77, 351: n = A,T,C or G
ctaggtcgcggcgacatggccaaacgtaccaagaaagtcgggatcgtcggtaaatacgggacccgctatggggcctncctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtncc

SEQ ID NO: 6668 - DNA, 434 bp, Homo sapiens
  misc_feature 180, 277, 325, 382, 389, 402: n = A,T,C or G
cctgactgaccctctgcttgtccacaaaggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgancaggcctcctcgtcggagagtgaccccgagggacccattgctgcacaaatgctgtccttcgtcatggatgaccccgactttgagagcgagggatcanacacacagcgcagggcggatgactttcccgtgcgagatgacccctccnatgtgactgacgaggatgagggccctgccgagccgcccccaccccccaagctccctntccccgncttcagactgaanaatgactcggacctcttcgggctggggctgga

SEQ ID NO: 6669 - DNA, 438 bp, Homo sapiens
  misc_feature 75, 120, 165, 232, 395: n = A,T,C or G
ggcatctctcgggacaactggcacaagcgccgcaaaaccgggggcaagagaaagccctaccacaagaagcggaantatgagttggggcgcccagctgccaacaccaagattggcccccgncgcatccacacagtccgtgtgcggggaggtaacaagaaataccgngccctgaggttggacgtggggaatttctcctggggctcagagtgttgtactcgtaaaacaaggatcntcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggnataagagattttaaacaaaaaacgatctaaaaaaattcagaag

SEQ ID NO: 6670 - DNA, 366 bp, Homo sapiens
  misc_feature 16, 23, 30, 139, 143, 270, 339: n = A,T,C or G
cctcactgttacctgntttgggnttctggnctactttgactttcaaagtacctccagcctcctcatacgcacagcttttggatgacctcagcttgagtttctccatatgtgcatgtacatctagcattctgcctacagntcanacagaagtcacaaaaaggccttcaactcaccaaaggtaaatatctgtatctattaggacattttttacatagacttcagttgagatgtatacttagcaaaattatttttaaattgaaacagcacagnaaatacttaatataaaatgtcccttggattttgcttcccatgtaaatctattgtattattacacttgtnataattttaactataaaggtccaattg

SEQ ID NO: 6671 - DNA, 365 bp, Homo sapiens
  misc_feature 157, 357, 365: n = A,T,C or G
gtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagngatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggctttttttttttttanaaagttan

SEQ ID NO: 6672 - DNA, 356 bp, Homo sapiens
  misc_feature 144, 160, 355: n = A,T,C or G
cggcacgagtgttggccgagtggagactggtgttctcaaacccggtatggtggtcacctttgctccagtcaacgttacaacggaagtaaaatctgtcgaaatgcaccatgaagctttgagtgaagctcttcctggggacaatgngggcttcaatgtcaanaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaana

SEQ ID NO: 6673 - DNA, 251 bp, Homo sapiens
  misc_feature 178, 195, 205, 215: n = A,T,C or G
gcgtggaaagcttggtcggggcttctcacagccgcgcgcacagactggttctccccccgcgtctcccgggagcgtcgccgccacctgcacgcgtgcggcacacaaacgtcggtctcaccccttagtttctggaagagaaaaaaggaaaaagccaccgagaggcctgaccctgaggggncgggggggagatgcggncccgtagtanaagggaagcnactgaggagccggggactggggcagcattttgaatg

SEQ ID NO: 6674 - DNA, 427 bp, Homo sapiens
gctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatatt

SEQ ID NO: 6675 - DNA, 439 bp, Homo sapiens
  misc_feature 414: n = A,T,C or G
tcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtgtgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgnctttgcctgcactcctcttgcaggg

SEQ ID NO: 6676 - DNA, 354 bp, Homo sapiens
  misc_feature 105, 168, 169: n = A,T,C or G
gtgagaagccatgagcagcaaagtctctcgcgacaccctgtacgaggcggtgcgggaagtcctgcacgggaaccagcgcaagcgccgaaagttcctggagacggnggagttgcagatcagcttgaagaactatgatccccagaaggacaagcgcttctcgggcaccgnnaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgttttttggcctcagagt

SEQ ID NO: 6677 - DNA, 222 bp, Homo sapiens
  misc_feature 145, 149, 175, 200, 209, 210: n = A,T,C or G
ggaatgcttataacctagtgaatatttctgctgagccttagttgtcttgtctaaaggaaaaaagagggaattgtggaataaaagtatttgttagtggaaattattgacctgaaaccctatcatattgttagtgtaactgaatgtntcanaaattgttcctatgtaggtattctgngaaactggtttctaaaatgttacangaaactgtnncctttttttttg

SEQ ID NO: 6678 - DNA, 131 bp, Homo sapiens
  misc_feature 12, 14, 38, 53, 59, 60, 71, 75, 90, 96, 100, 127: n = A,T,C or G
gcgcttgcacgncnacactagtggattaaaagaattcngcactagcagggagngaaggnnataacacgganccanctccacccttcctcncttgangcanaaaggactcaagattgccaaaggcctnttgt

SEQ ID NO: 6679 - DNA, 258 bp, Homo sapiens
  misc_feature 17: n = A,T,C or G
ggcttctgggtcctggngacggggctggcatgaccccgggggtcgtccatgccagtccgcctcagtcgcagagggtccctcggcaagcgccctgtgagtgggccattcggaacattggacagaagcccaaagagccaaattgtcacaatttgtggaacccacattggcctgagatccaaaacgcttcgaggcaccccaaattacctgcccattcgtcaggacacccacccacccagtgttatattctgcctcgccgga

SEQ ID NO: 6680 - DNA, 289 bp, Homo sapiens
  misc_feature 132, 222, 244: n = A,T,C or G
cagaacaggggcttccccaagttgcccagaaagactgtctgggtgagaagccatggccagagcttctcccaggcacaggtgttgcaccagggacttctgcttcaagttttggggtaaagacacctggatcanactccaagggctgccctgagtctgggacttctgcctccatggctggtcatgagagcaaaccgtagtcccctggagacagcgactccaganaacctcttgggagacagaagangcatctgtgcacagctcgatcttctacttgcctgtggggagggga

SEQ ID NO: 6681 - DNA, 402 bp, Homo sapiens
  misc_feature 112: n = A,T,C or G
cagcctcctgagtagctgagactacaggtgagtgccaccacactcagctaatttttaaattttttgtagacagggtctccctatgttgcccaggctggtcttgaactcctanactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttg

SEQ ID NO: 6682 - DNA, 295 bp, Homo sapiens
  misc_feature 2, 30, 164, 179: n = A,T,C or G
anagagtcaccatctggggctgggcatggnggctcacacctgtaatctcagcactttgggaggccaaggtgggtggatcacaaggtcaggagatcgagaccatcctggctaacacagtgaaaccccatctctactaaaaatacaaaaaattagctgggcgtggnggcacatgcctgtantcccagctactcgggaggctgaggcaggggaatcacttgaacccaggaggcggaggttgcagtgagctgacatcgtgtgccactgtactccagcctgggtgacagagcgagactcc

SEQ ID NO: 6683 - DNA, 100 bp, Homo sapiens
  misc_feature 2, 8, 17, 21, 24, 26, 28, 54, 79, 85: n = A,T,C or G
gnacgatnctctggtcnttgngcntntncaagtgaacaaagcacctaagatgcnccgacggacctacagagctcatggncggatnaacccatacatgagc

SEQ ID NO: 6684 - DNA, 207 bp, Homo sapiens
  misc_feature 40, 177: n = A,T,C or G
tcagcctgtctcccccaacaccccgcctgcctcctggctnaggcccagcttattgtgtgcgctgcctggccaggccctgggtcttgccatgtgctgggtggtagatttcctcctcccagtgccttctgggaagggagagggcctctgcctgggacactgcgggacagagggtggctnggagtgaattaaagcctttgttttttaagg

SEQ ID NO: 6685 - DNA, 427 bp, Homo sapiens
  misc_feature 230, 275, 284, 336, 370, 396, 406, 416: n = A,T,C or G
cggcacgagccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcanaacagagatggcttcatcgacaaggaagatttgcatgatatgctngcttctctngggaagaatcccactgatgcataccttgatgccatgatgaatgaggccccanggcccatcaatttcaccatgttcctgaccatgtntggtggagaagttaaaatggcacaanatcctgaaanatgtcatcanaaacgcctttg

SEQ ID NO: 6686 - DNA, 437 bp, Homo sapiens
  misc_feature 358: n = A,T,C or G
ggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccantctgtttcaaataaatgaactcaatctaaattaaaaaagaaagaaatttgaaaaaactttctctttgccatttcttctt

SEQ ID NO: 6687 - DNA, 230 bp, Homo sapiens
  misc_feature 88, 145, 160, 199, 203, 222: n = A,T,C or G
gcaggagccgcagggccgtaggcagccatggcgcccagccggaatggcatggtcttgaagccccacttccacaaggactggcagcggngcgtggccacgtggttcaaccagccggcccggaagatccgcagacgtaaggcccggnaagccaaggcgcgcngaatcgctccgcgccccgggtcgggtcccatccggccantcgngcgctgccccacggttcgntaccacac

SEQ ID NO: 6688 - DNA, 219 bp, Homo sapiens
  misc_feature 212: n = A,T,C or G
cggcacgaggtcacatttgggaccgtgcgggcctgtggctccttcaagctgcccgtgagagccatctgtgccggctgggaaagtcctttccttgctagacgtttttccgtggcagcgtcgagctgggtgctgttcatgtgtccccggggaacgggtgctgtgcggaacaggaggagagcgaggtcctggtgcttgctgcggggaggcccggngctggga

SEQ ID NO: 6689 - DNA, 441 bp, Homo sapiens
  misc_feature 3, 7, 11, 18, 25, 80, 156, 204: n = A,T,C or G
cgnacanactnaggagtngcagtanagggtgggaagggcatgccgggtggaggacacagtttgaaccaaggcaaggtggntggaaaatactaaactgtataaactgtaagaaagtcaatttggctagagcaggaaaatgtgtttgagggcacagtnggaggtataaagggcagagagtgtaagcgtttacattccaaatgatanaatttgcacaatatttagtaataatctgaagcctctgggaaagctatttttcttctgatttaaatactgaagttcaaagaggatagtgggtgggctttgcatcttggaaaagtctatcagaaactgcctagctcgctcagcccactttcctttccaaggtaagaaacacacattcatgcatggaaataaagcagggaggcccttggcaactgtccagttccattgaagttctcattt

SEQ ID NO: 6690 - DNA, 456 bp, Homo sapiens
  misc_feature 82: n = A,T,C or G
agtggatccaaagaattcggcacgagctggattcagacctctgaggagagttcctggttgttacaggaacatgctgcctgtngtcctggtgccaaggaaacttgctgaagggtacccgctgttaaactgcatagggcagcctgccactgctgtaaaccctgaccgggataaccgcgtgccgatctgcctgccactatatgggaaaacagaaaactagatgaagaagaaaaaggcctctgtcttccagccatgcattgttccttccacactccttattgtcaaagcctaacatggagccagctggcaaaggaaaagtgtggcctgtagagttcagccccagtattacaaagcaggatgaagaaatcgggattggagcttgaaagacaataaattaataactgatacagatggaaagtacatttttcaacccaaggatagaaagaagccccaaacatc

SEQ ID NO: 6691 - DNA, 381 bp, Homo sapiens
  misc_feature 15, 31, 65, 146, 224, 244, 345: n = A,T,C or G
agtggatccaaaganttcggcacgagagagnccttaattctggagaagctgtcaagattcatggngctgattacaaggtttctagaattttagtttgtaacttgaaagcttgaattttatcattggcaacaagtactgtcagttgntttccttgaaatgacagggtcactttgttcatgttcacgtgtatctgttgaatatctaagtctgaataaccatagttngtcagttaatactttccagnaaaagtgtttagtgaaaaaaagtgtctaggtctgcttggaactaaaacagtcacaggagtgctttcctttgcgacaaccattgtactttgggatggagcangagtgctttgtgggcatttccattttatcatgtaga

SEQ ID NO: 6692 - DNA, 136 bp, Homo sapiens
  misc_feature 14, 25, 29: n = A,T,C or G
aaacaggagaagangctggattaanagangtcacctgtggaacataaaaaggacatcagcaaacaggatcagttaactattgcatttatatgtaccgtaggctttgtattcaaaaattatctatagctaagtacac

SEQ ID NO: 6693 - DNA, 151 bp, Homo sapiens
  misc_feature 27, 78, 84: n = A,T,C or G
cggcacgagaaaaactaccctcagaantatttttaaaagaagtagcaaattatcttcagtataatccatggtaatgtntgcagnaattcaaattgatctctctctcaataggtttcttaacaatctaaacttgaaacatcaatgttaattt

SEQ ID NO: 6694 - DNA, 454 bp, Homo sapiens
  misc_feature 396, 407, 412, 432: n = A,T,C or G
gtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgaagaagttcttgaatgaatttnttcttaaatgngaaanatatccttcgcgctcctgtngacatcactggtcagtttgaga

SEQ ID NO: 6695 - DNA, 138 bp, Homo sapiens
  misc_feature 11, 15, 20, 32, 47, 57, 69, 79, 82, 85, 88, 113, 125: n = A,T,C or G
aagtgaccagnggangaagnctacagcccaanaagaagagggaagancctactgccnagactaaagaancgggcactgntantcnaantatagttgatgatgggaaatctcanaaacttactcangatgacataaaag

SEQ ID NO: 6696 - DNA, 111 bp, Homo sapiens
  misc_feature 3, 6, 12, 17, 20, 37, 51, 58, 80, 83: n = A,T,C or G
ggnganatgganggcgnggngggatttgctcctgggntccctaggccctantgagggnggaagagaaaccatcctctccnttnttacaccgtgaggccaagatcccctcat

SEQ ID NO: 6697 - DNA, 120 bp, Homo sapiens
  misc_feature 27, 34, 48, 61: n = A,T,C or G
cggcacgaggtaaccaatagtccacantgtcccnggcattctgttcanaagcagtgtgcanaatgtaatgctcttttgtaagaaacgttttatgatttttaaaataaatttagtgaacct

SEQ ID NO: 6698 - DNA, 386 bp, Homo sapiens
  misc_feature 8, 9, 15, 35, 36, 119, 197, 233, 251, 296, 317, 332: n = A,T,C or G
agtggatnnaaaganttcggcacgagattttgtcnnagttcacagtagagtagggtagaaggaaagcatgtctctgcttccatggcttcctgagaaagcccacctgggctgggcgcggnggctcacgcctgtaatcccagcactttgggaggccaaggtgggcggatcacaaggtcaggagttcgagaccaacctanccaacatggtgaaaccccgtctctactaaaaataanaaattagccgggtgtggnggcacgcacctgtagtcccagctacttgggagcctgaggcagganaatcgcttgaacctgggaagnggaaggttgagtgancccgggaccgtgccattgtactccagcctgggtgacagagcgagattccgtctc

SEQ ID NO: 6699 - DNA, 389 bp, Homo sapiens
  misc_feature 8, 11, 15, 35, 73, 93, 126, 151, 215, 340, 346: n = A,T,C or G
agtggatncanaganttcggcacgaggccagaagntctgtgaacccctggggggctattacccatggccttantaattatctaggctgccgtncggcctgcagagtcatcatgccatgtagctggngggtggcccgtatcttgggcatggngtgaaatcacttcatatatcatgtgctgtaaaataagaactagctgaagagacaaccaaagaancattaaggcaggttgatgctgatgggaccataaaatatttttacactcaacctgagcggttattcttgacactcttaacagaattttttcaattgttttccagaactttagtatatgcaaatgtnctgaanggggtagttcaagtctaaaatgccataacccctttattatttg

SEQ ID NO: 6700 - DNA, 168 bp, Homo sapiens
  misc_feature 2, 34, 46, 76, 124, 161: n = A,T,C or G
gncttggcgaacggtcttcggaagcggcggcggngcgatgaccacnctacgggcctttacctgcgacgacctgttncgcttcaacaacattaacttggatccacttacagaaacttatgggatncctttctacctacaatacctcgcccactggccagagnatttcat

SEQ ID NO: 6701 - DNA, 396 bp, Homo sapiens
  misc_feature 8, 138, 232, 334, 340: n = A,T,C or G
agtggatncaaagaattcggcacgagcacgaaggagcccattgtggcctaagaggctgccctcctgtgctcagccctgaggacagatgcctccttcctcttttccttcccaaagcaagcaagaggccgtggctgctgngggaaatggtactgtacagctggctctacttccccatggccctgagcgagtggagtctgccacccaggatccccaaggcacttgaggggggaangattctgctggcctctgcgagtggtttcttgtgcactggcaccaagtgcgggtccggcagcttctgccccctgcagaaccggagagccagctaaggggtggngctgcngggggttccggtgtccacccccatacatttatttctgtaaataatgtgcactgaat

SEQ ID NO: 6702 - DNA, 405 bp, Homo sapiens
  misc_feature 32, 338, 379, 389: n = A,T,C or G
cttggctaaaatgtttggctttaagcttgtanaattattttaaaaagcatgtcttttataaccaactagtgaagcagtgaggatgcctctttgatttaaatagggttaatacttttccaagtctaaccttctactatgaaaggccaacatcaggccaggtgcagtggcgcacgcctgtaatcccagcactttgggaggcggaggcgggtggatcacgaggtcaggagatggagaccatcctggctaaccccgtctctactaaaaatacaaaaataaaattagctgggcgttgtggcggccacctgtagtcccagctacttgggaggctgaggcggganaattgtgtgaactcgggaggcggagcttgcagtgagctganatggcaatanagcaagactccatctc

SEQ ID NO: 6703 - DNA, 146 bp, Homo sapiens
tcaattcttgctctgtggtgttaaacatataatgaacagtcattaagaattaagtcactgtttgccataaacaaggttgatgttctttttgttgttgttaaggaaaccctagggctcggctttactcttgattaataaaggctgac

SEQ ID NO: 6704 - DNA, 449 bp, Homo sapiens
  misc_feature 17, 45, 48, 66, 144, 235, 327: n = A,T,C or G
ctgagctctccgcgtcncctctgtcgcccgcgcctggcctaccgnggnactcccggctgcacgctntgcttggcctcgccatgccggtggacctcagcaagtggtccgggcccttgagcctgcaagaagtggacgagcagccgnagcacccgctgcatgtcacctacgccggggcggcggtggacgagctgggcaaagtgctgacgcccacccaggttaagaatagacccaccancatttcgtgggatggtcttgattcagggaagctctacaccttggtcctgacagacccggatgctcccagcaggaaggatcccaaatacaganaatggcatcatttccttggtggtcaacatgaagggcaatgacatcagcagtggcacagtcctctccgattatgtgggcttcggggcctcccaagggcacaggcctccaccgctatgtctggc

SEQ ID NO: 6705 - DNA, 317 bp, Homo sapiens
catttggattcagaactcattttggtggtggcaagacaactggctttggcatgatttatgattccctggattatgcaaagaaaaatgaacccaaacatagacttgcaagacatggcctgtttgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaacta

SEQ ID NO: 6706 - DNA, 350 bp, Homo sapiens
  misc_feature 4, 10, 24, 26, 27, 75, 86, 335: n = A,T,C or G
attngccaancattcattcaccanannaccatggatacgaaggctttctctggaataattctagactgaaatttntggattctggncttaaggctgtcttattgtagtacaaccagtgaacagattaagactgattattattagcagctgttttctgaataaggccttaagatattttccctgactgaaagcctacagaggccccactttactcatcctactaggtttcttctttccattcctggaaacttgaaaattataatttattgtgtaggacaatttaatcctctatttcatagattctctttttaatcatgccttgagaactatattgncagagccaaatgtcc

SEQ ID NO: 6707 - DNA, 431 bp, Homo sapiens
  misc_feature 262, 296, 310, 406: n = A,T,C or G
cattttgcacctgcagccaagcaaatgcctgccaaattttagatttaccttgttagaagaggtggccccatattaacaaattgcctttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagngaagaatttatctctttagttagtgattatattncacccatctctcangaatcatctcctttgcagaatgatgcaggttcaggtcccctttcagagatataataagcccaacaagttgaagaagctggcggatctagtgaccanatatataagaaaggactgcagccac

SEQ ID NO: 6708 - DNA, 323 bp, Homo sapiens
  misc_feature 56, 117, 167, 272, 315, 317: n = A,T,C or G
cctcgaggactggccgggaaccgaggcgtgccaggacagcccgggagacagggcgnggagggccgggatgccactgaccagcacatcgtggatgtggcgctgaagatgctgcaagancaactggcagaggtcgccgtgagtgccaagcgggaagccctgggtgcggngggcattgatgggtcctccaggacctcctgggccccctgggtacccaggcaagcagggcccccatgggcaccctggccctcggggcgttcctggcatcgtggganccgtgggtcagatcggcaacacggggcccaagggaaaacgtgnanagaagg

SEQ ID NO: 6709 - DNA, 159 bp, Homo sapiens
tgggattacaggcacccgctaccaagcccagctaatttttgtatttttagtagagacagggtttcaccagcctgggcaacatggtgaaaccccatctctaccaaaaatataaaacttagccaggcatggtggcttgctcctgtactcccagctacttgg

SEQ ID NO: 6710 - DNA, 237 bp, Homo sapiens
  misc_feature 9, 123: n = A,T,C or G
cggtctcanaactgtttgtttcaattggccatttaagtcttagtagtaaaagactggttaatgataacaatgcatcgtaaaaccttcagaaggaaaggagaatgttttgtggaccactttggntttcttttttgcgtgtggcagttttaagttattagtttttaaaatcagtactttttaatggaaacaacttgaccaaaaatttgtcacagaattttgagacccattaaaaaagtt

SEQ ID NO: 6711 - DNA, 212 bp, Homo sapiens
  misc_feature 206, 208, 211: n = A,T,C or G
cggcacgagaggagatctatctcttctccctgcccattaaggaatcagagatcattgatttcttcctgggggcctctctcaaggatgaggttttgaagattatgccagagtacttctagagcggccgagggcccatcgattttccacccgggtggggtaccgggtaagtgtacccaattcgccctatagtgagtcgtatacatttncnccng

SEQ ID NO: 6712 - DNA, 338 bp, Homo sapiens
  misc_feature 313: n = A,T,C or G
gtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctncctgaaataaagaacagcttgacag

SEQ ID NO: 6713 - DNA, 432 bp, Homo sapiens
  misc_feature 78: n = A,T,C or G
gcagaaaatagtgttttgtagttcaacaactcaagacgaagcttatttctgaggataagctctttaaaggcaaagctntattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagaagatgctatatgatacaactgtggccatgactgaggaaaggagctcacgcccagagactgggctgctctcccggaggcc

SEQ ID NO: 6714 - DNA, 322 bp, Homo sapiens
  misc_feature 35, 115, 126, 159, 255, 300: n = A,T,C or G
ccttggggctctcagccctcctcctggatcctggncaggccgaaccaccgctgcctctccttcctccgcatgagcctctggcatggtccttcctccagctggccccaggctgggnagagcctcctnctgccggggcccctgcccaccccctcctttgcntggagtgagggtgttcataccaaagacggaaccatttcgcctttaaagaaaatatatccagaagcagccgctgcctcggagccctggcccgtgggnccccctctcgcctggttggttcggtctaacgccccggagagtcangggcttcccaggaccctgggga

SEQ ID NO: 6715 - DNA, 317 bp, Homo sapiens
  misc_feature 7, 53, 96, 112, 302: n = A,T,C or G
agctggngcgcctgcccgggaacatcctcctggactcaatcatggcttgtggnctggtcgccagcaacctgaatctcaaacctggagagtgccttngagtgcgaggcgaggnggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggccttgggggaccgagcagcgggaaggctgtctttcccttccagcctggaagtgttgcanaaggtgtgcaatcac

SEQ ID NO: 6716 - DNA, 347 bp, Homo sapiens
  misc_feature 52, 62, 124, 154, 189, 243: n = A,T,C or G
gctgggatcactggagcacggggtcttgcaggaccaccaggcatgccaggtnctaggggaanccctggccctcagggtgtcaagggtgaaagtgggaaaccaggagctaacggtctcagtgganaacgtggtccccctggaccccagggtcttnctggtctggctggtacagcttggtgaacctggaanagatggaaaccctggatcagatggtcttccaggccgagatggatctcctggtgncaagggtgatcgtggtgaaaatggctctcctggtgcccctggcgctcctggtcatccaggcccacctggtcctgtcggccagctggaaagagtggtgacagagg

SEQ ID NO: 6717 - DNA, 418 bp, Homo sapiens
catagcttaagaaagaaattgagtccctatctcattatcaatttgaaaaatgctcagtgaggaatattggcccagttgctgatacttagagcaattaactctgcctaagaagacagggttaaagtaagcaaatgacttccaattagagtcacatatttggagtagtggtaggagtagcccccatagaaggatgggggcaacagtaggtgtctacttactgcaagatctaatggaaatttactagattttggtaaaaatggcaaactggcatacacacacctcactggtgacagaatgaactgtgcaaatcttattgaaaacaatttggaaagttatttcaacagtcagaaggatgttcacactttctttgactcatcaatgcatcttgataatgaatatgaatattattcatcttatg

SEQ ID NO: 6718 - DNA, 417 bp, Homo sapiens
  misc_feature 2, 5, 48, 267, 307, 377: n = A,T,C or G
gnggntttcctgaagcagctggctagtggcttattacttgtgactggncctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcanaaagctgtggactcacaaattttaccaaaaatcaaagctnttcctcagctccagggctacctgcgatctgtgtttgctctgacgaatggaatttatcctcacaaattggngttctaaatgtcttaagaacctaattaaatagctgactac

SEQ ID NO: 6719 - DNA, 437 bp, Homo sapiens
  misc_feature 323, 419: n = A,T,C or G
ccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcanaggcttcatcatcacagaatttactcttgctccatgaaaaaaaattaaataccttcagaggaatatttaagttggtaaactatgaaacttgagaantcctcttgagataaaagg

SEQ ID NO: 6720 - DNA, 435 bp, Homo sapiens
  misc_feature 334: n = A,T,C or G
gacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggngcttctttctgatctctagaggagatctctttgactgctgtagtactaaagtgtacttaatgttactaagtttaatgcctggccattttccatttatatat

SEQ ID NO: 6721 - DNA, 264 bp, Homo sapiens
  misc_feature 156, 173: n = A,T,C or G
aaacagttaacaaaacaagactcacgaggtggccctgttattggaactatcgaggcaaaacagttaacaaaacaaggctcagaggtggccctgttattggaactatcagacaaagatttgaaaatagctctggctaagatattgaaaggatctagngggaaacatagcatgcntgaattaatggggaatttagctgatagatggaaataatgagtcaagttgaaatggtagtaataaaaaaaaaacagaggtaaataattcctt

SEQ ID NO: 6722 - DNA, 247 bp, Homo sapiens
caaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttcccca

SEQ ID NO: 6723 - DNA, 439 bp, Homo sapiens
  misc_feature 116, 120, 182, 198, 248, 358: n = A,T,C or G
ggacttgataacctggctacagcgttttctatgaaatctacttggatcccatgcctgaaatttggaagcatatgtacaaaaatcatttttacgttttatttttaataaatcattgngttngaccgtacatgtctaacattttttttctaggatccattcgtaccgttttttaagggatattngtttaagactttacgngttaattctttattcttgatgtgtacttagagaaacttaagaggtcctgnggtttttttcccctctcctgttgccctgctagttgcgtgttgaattatatcccttacaggcaaaacttttgaagtggtggatgtggctttttaaactcttaagtttctgngcatccatctcttgtactaagcgaattgtttatcatcttgacatggttggtcatttctatgacaatttacttcaaactgtg

SEQ ID NO: 6724 - DNA, 247 bp, Homo sapiens
  misc_feature 92, 123: n = A,T,C or G
gtttgcaaaggccctggccaacgtcaacattgggagcctcatctgcaatgtaggggccggtggacctgctccagcagctggtgctgcaccancaggaggtcctgccccctccactgctgctgntccagctgaggagaagaaagtggaagcaaagaaagaagaatccgaggagtctgatgatgacatgggctttggtctttttgactaaacctcttttataacatgttcaataaaaagctgaacttta

SEQ ID NO: 6725 - DNA, 246 bp, Homo sapiens
  misc_feature 90: n = A,T,C or G
ggcttaccaacattgaacacgtatattgacttcccaatacagacactgaggatttaactactagctttctgataggatttacactacagnagtgagtattcacactactttgtttttcccatttcctctggtgtttattggtatattattatttgttattctcttggttacccttttgagacctggaccgaaatctttattacttgttatattactttgttcctagaggtgtgttcttaaagtctc

SEQ ID NO: 6726 - DNA, 366 bp, Homo sapiens
  misc_feature 15, 102, 125, 197, 203, 246: n = A,T,C or G
tatacatacgaggtnattaacaatacagatgcccagtgctacagaatgtgaaagaaggaagaaccccttgtgaattggagtcaataaagaagactccatggntgagcgaggaggagcagtattanataaatggagagaaaagaaggaaagacatagtgtgactgggtgaggtttggcacagagttcttgggaatggnctttgntgtgctagagtttatcatccattgctgaggggtgagtgtgtcntcccctctaggacctttagccagcccagctggtggctgacattggagggctgtgctgtgaaaagtgacactgggtttagagcaggagtcacaaacttatagggctccagaagccagagtg

SEQ ID NO: 6727 - DNA, 402 bp, Homo sapiens
  misc_feature 74, 223, 332, 352: n = A,T,C or G
tggaacctttgtgaagctcaacaaggcttcgattaacatgctgaggtttgtagagccatatattgcatgggggnaccccaatctgaagtcagtaaatgaactaatctacaagcgtggttatggcaaaatcaataagaagcgaattgctttgacagataacgctttgattgctcgatctcttggtaaatacggcatcatctgcttggaggatttgattcatganatctatactgttggaaaacgcttcaaagaggcaaataacttcctgtggcccttcaaattgtcttctccacgaggtggaatgaagaaaaagaccacccattttgtagaangtggaaaatgctggcaacanggaggaccagatcaacaggcttattagaagaatgaacttaaggtgcctac

SEQ ID NO: 6728 - DNA, 416 bp, Homo sapiens
  misc_feature 8, 9, 290: n = A,T,C or G
atcaaatnncatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgnggaggaattgcgtctgggttaacagatcagcttatgagacagacattctcaccatttggacaaattatggaaataaggagttttcccagaaaagggctattcatttgtcagattttcaacccatga

SEQ ID NO: 6729 - DNA, 329 bp, Homo sapiens
  misc_feature 9, 14, 50: n = A,T,C or G
gttttgttntgttntgtttttgtatttttaatagagatggggtttcgctnggttacccaggctgatctcgaactcctgacctcagatgatccacctgcttcggcctcccaaagtgctgggattacaggcttgagccaccacaccagtccgagattgacccaatttttaactctcctgataataataatgtcaaacaccatcttccaaaagaatgttttaccacttaattaattttcctcctttagaaaataatttttctctctcttcaaaggctggccatggggcgggggtgagggatcaaacctacaggacttcaaattggatggaga

SEQ ID NO: 6730 - DNA, 430 bp, Homo sapiens
  misc_feature 148, 189, 260, 315, 403, 417: n = A,T,C or G
tcaccgcactgagatcaacaagaagatttataagattggccagggctaccttatcaaggacggcaagctgatcaagaacaatgcctccactgactatgacctatctgacaagagcatcaaccctctgggtggctttgtccactatggngaagtgaccaatgactttgtcatgctgaaaggctgtgtggngggaaccaagaagcgggtgctcaccctccgcaagtccttgctggtgcagacgaagcggcgggctctggagnaagattgacccttaagttcattgacaccacctccaagtttggccatggccgcttncagaccatggaggagaaagaaagcattcatgggaccactgaagaaagaccgaattgcaaaggaagaaggagcttaatgccaggaacanattttgcagttggngggggtctcaata

SEQ ID NO: 6731 - DNA, 351 bp, Homo sapiens
  misc_feature 59, 188, 206, 343: n = A,T,C or G
cataaaacaatggtctctaacttttaataattcatattccagtaagagcatataaggcntataaaaatgaactctaattcagtttctagtatataataaattccatagagctatatagataaaatattatgggaatttactagatagaaaaattacttctgccttggaagccattggaaggttctgtngggaaatgggtcttagtnggtcttggagaatgaaaggatttatatagacagaaattgagaggagaaacatttcaggcagaaagaataggcagaggactttaaaacggccaatagttcaggttctaaattaaaaaaagaagatgcgtatgggattntaagactg

SEQ ID NO: 6732 - DNA, 398 bp, Homo sapiens
  misc_feature 32, 93, 232, 261, 360, 363: n = A,T,C or G
ctggtctgccttgtgggtcctggacggagccnctacctctgcaaagatgacttggagacaggccgtcctgctgtcttgcttctccgccgtggngctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggnaagcggtcccccaagtcccgagatgaggncaatgatggagtctcactctgtcgcccaggctggagtgcagtggcaggatcttggctcattgcaacctccacctcccaggttcagtggaaaacaggcanaancttcgggttgatgagctgcggagagaattttacga

SEQ ID NO: 6733 - DNA, 296 bp, Homo sapiens
  misc_feature 37, 234: n = A,T,C or G
ctcagtctggtcaagttgtttcttatttgtgagcagntcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgntgaagcaaatgaattatttttaaatgttaagtaagtaaataaaccttagcccgtctactgtt

SEQ ID NO: 6734 - DNA, 439 bp, Homo sapiens
  misc_feature 29, 38, 131, 232, 323, 387, 420, 430: n = A,T,C or G
gtgatcctgaaatgctgaagatcgtgtangtgggttgnggggtcagcagagctgccatctgcccacgtctggaaaacaacacacggtgagtcaccggttggccatgagatctccccacttaaaggtgctgngagcttgtctctaagatatatacctcttccttttgtcttttgctgtaagctttgaccttttgcagatctgatgaaaatacaacctcttattgtattagttngccttgattataagccatagtaaatcgagctgttcgcatttttgcaggccttgcattttctactgggaggttcatcaaaccttccacttancaatagccctgactcaggcagaatgcctcataaattagccttcgaaagaaaagtgcacgctcanacagtgtgtaggaggggcaggagcgtgatgcanacaaggactnagtcatgac

SEQ ID NO: 6735 - DNA, 103 bp, Homo sapiens
  misc_feature 46, 78, 88: n = A,T,C or G
ctggaactgcacaaactggccactgacaaaaatgacccccatttgngtgacttcattgagacacattacctgaatgancaggtgaaanccatcaaagaattgg

SEQ ID NO: 6736 - DNA, 123 bp, Homo sapiens
tcgtaggatgggtgagtcagatgattccattctccgattggccaaggccgatggcatcgtctcaaagaacttttgactggagagaatcacagatgtggaatatttgtcataaataaataatga

SEQ ID NO: 6737 - DNA, 444 bp, Homo sapiens
ggaaggagtgttgctgtaattagagaccattaggcattgcttgagccatttgtctattactttttgatatattggattttctggtaactcccaggttagagaagtggtccctccttctactctaatttctttgtaatcacagaatcagcatcttgtctctagagagttttgctagataattgggctgctccatgcctagcctagaggctttgggagtagaacccagacttatctaagctttgtcttccaaatgttgcatcactcaattactgtatgaattcttgccttgttgatgtgtcatttaagaaacagcttatatacaaatgatgaagtgtatatataaatcttcctagttgccaatttcataagattgaagaaactgcaagttttgagaacacttttaagcaatttatttaacctctaattggctaccttattcggtat

SEQ ID NO: 6738 - DNA, 225 bp, Homo sapiens
  misc_feature 142: n = A,T,C or G
ggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcntgaacccaggaggcagagcttgcagtgagccgagatcgcgccactgccctccagcttgggcaacagagcgagactccgtctcc

SEQ ID NO: 6739 - DNA, 204 bp, Homo sapiens
acttgggcttaggagttgctaagtatgagcaataatctggaatcagcatcatcataattcatcataagtttagaatatcttagggcaagccaaggttgatgttagaatatgtggtgttatgggtcaggttgcttttcttatgcattttacccagtggaataaatttattttaaacagacactatggcagataggaataatggag

SEQ ID NO: 6740 - DNA, 234 bp, Homo sapiens
gcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatg

SEQ ID NO: 6741 - DNA, 312 bp, Homo sapiens
caaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagc

SEQ ID NO: 6742 - DNA, 180 bp, Homo sapiens
attcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtccctt

SEQ ID NO: 6743 - DNA, 274 bp, Homo sapiens
cccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatatttttatttttttgtcctggatatttggggattatttttgattgttgatattctcttttggttttattgttgtggttcattg

SEQ ID NO: 6744 - DNA, 291 bp, Homo sapiens
ccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatt

SEQ ID NO: 6745 - DNA, 350 bp, Homo sapiens
ctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtgggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 6746 - DNA, 385 bp, Homo sapiens
acagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtgggggggtctcagcaggagcctggggggctccccatctgtgtccaaataaaaagcggtgggcaagggctggccgcagctcctgtgccctgtcaggacgactgagggctcaaacacaccac

SEQ ID NO: 6747 - DNA, 442 bp, Homo sapiens
  misc_feature 96: n = A,T,C or G
ctggagtcttacattaatgctcatttgagctaattagtaatctgtttaaacagatttggcaatactttaaagatactgtagactatttatgtatangatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaagg

SEQ ID NO: 6748 - DNA, 303 bp, Homo sapiens
cggacctggtacctcttttgtgaagcggcagctgaggagactccggcgctcgccatggccgacgaaaagcccaagggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatac

SEQ ID NO: 6749 - DNA, 346 bp, Homo sapiens
ccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggagggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattc

SEQ ID NO: 6750 - DNA, 319 bp, Homo sapiens
  misc_feature 295: n = A,T,C or G
taggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtcttggagggtcaaatttaccctggccaagatccgcaaggccgcccgggaactgctgacgcttgatgagaaggacccacggcgtctgttcgaaggcaacgccctgctgcggcggctggtccgattggggtgctggatganggcaagatgaagcttggattacat

SEQ ID NO: 6751 - DNA, 232 bp, Homo sapiens
ggatgttgaaatctttgcctcctcagtcgggaagagtcctgctaaaaatcaggctaaaaatcaggccaaaaatcaggccaaatgacttggcaaataattgacaaagtggttttcacagtgtgtctatctttgctagcagcttgtatacctcaggccaggtgagctccccaaatttcttttttcatttactccagtgagtttctgctgtctttttcaagtatgtaccatagga

SEQ ID NO: 6752 - DNA, 439 bp, Homo sapiens
aaagagtaagtcctattatcagttggagaaagcagaatggagtccagccagctaacaatggaaataacatgggatctggtgcagtaatgggaaacggagaaggaaaaaaataaatcccaggcacttaaataagaagtgaaccctgggttatttggcaaaaacaagagaaaatgatagtgtagggtgatagaataaatgtttattacatttcacagtattttcgtaaagtgatttgcagtggacgtgagtctgaaaagtgggagcaaattctaaaacctctgtccttgggactaaaggaaggtaatgtcacagtagttactgaagaggatctaattgagtgtgcataattatatttctgaacaccatatctgaattttacataggagtttcactttggtgatttcagctagtgattttcagtctgtcctgcagaggtgga

SEQ ID NO: 6753 - DNA, 408 bp, Homo sapiens
  misc_feature 286: n = A,T,C or G
gaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtngggtgaagcccgaggctgctcctgtggaagtggctctgggcaccagcctgtggggctaaagacttgacagctagctctggagcagccggcttcctggaaaacctccaggtttcgcataccag

SEQ ID NO: 6754 - DNA, 499 bp, Homo sapiens
  misc_feature 19: n = A,T,C or G
cgactagtggatccaaagnaattccgcacgaggctagaggtatttcatttgatatttagcttctgaaagccctttgttataaagggaagtgattttctaaatttggtagcagcttgaaaacaagcaccacaaatgtaaaattgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctag

SEQ ID NO: 6755 - DNA, 417 bp, Homo sapiens
actttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatgggaaagtcacccgtaaggatggcaatgccagtggaaccacgctgcttgaggctctggactgcatc

SEQ ID NO: 6756 - DNA, 443 bp, Homo sapiens
  misc_feature 372: n = A,T,C or G
gatggtcgaggccatctcctgggccgcctggcggccatcgtggctaaacaggtactgctgggccggaagggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccatctcaaggtgtttgacggcatcccaccgccctacgacaagaaaaagcggatggtggttcctgctgccctcaaggtcgtgcgtctgaagcctacaanaaagtttgcctatctggggcgcctggctcacgaggttggcttggaagtaccaggcagtgacagccaccctg

SEQ ID NO: 6757 - DNA, 404 bp, Homo sapiens
gaaaacatcccagccaagaactggtataggagctccaaggacaagaaacacgtctggctaggagaaactatcaatgctggcagccagtttgaatataatggtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttg

SEQ ID NO: 6758 - DNA, 408 bp, Homo sapiens
caaaaggaacccctctcccaccgcttcaacgagttcatgacctccaaacccaaaatccactgcttcaggagcctaaagcgtgggctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggtttgaaggccggctcccagcacgcagcgagcaggcgcgccggcagagcgg

SEQ ID NO: 6759 - DNA, 268 bp, Homo sapiens
  misc_feature 267, 268: n = A,T,C or G
gatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttcnn

SEQ ID NO: 6760 - DNA, 435 bp, Homo sapiens
  misc_feature 421: n = A,T,C or G
gtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatattagatgttaagctaaaaagcttgaatttattctgagatgttgtttgaggttttatcaatgtgagttcttaattttccattttgtagctcactcataacttcattgaatgtaattgnatgtgtctaataaa

SEQ ID NO: 6761 - DNA, 462 bp, Homo sapiens
ccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttg

SEQ ID NO: 6762 - DNA, 419 bp, Homo sapiens
tccacaaggaacatactccaagattaaccacatgctgaatcataaagcaagtctcaataaattttaaaaatttgaaatcataccaccaatacactcagaccacagtggaatgagaataaaaataaataccaagaaaatccccccaaactacaaaattatatagaaattaaacaacttgcttctaaatgacttttggatagacaacaaaattaagtcagaaataaaaggattctttgaaattaataaaaacagagacacaatataccaaaatctctcaggtggagcaaaagtagtgtaaggagggaaagtttatagtgccaaatacctacctcaaaaagttgaaaagttttaaatttgtgatctagcatcacatctagaagaactacaaaaacaagaacagtatagtcccaaagctaata

SEQ ID NO: 6763 - DNA, 440 bp, Homo sapiens
ctcgtgccgaactgagactttcagaagaaaaaatttcattctgaatatggaaaaatgggaaaccaaatggtgcagaagtagagacaattcttgcgattgaataaaataactggtcagaaatattcatccaactaacaaatggtttccagggacccttcactgcagcttactgtgtagaatttaaactaagtaacttaacaattgagaacataacctgtatgtaccctttgtcccctgcccccactccaaatattactgctaattagaagcacatgttgaaggaaaaactctaataagacattccagtataagatctgggtttgctttaaatcccccaagcagcctaaagcccaacagaaggtatttagccttttgccttttgtttaaatggagattattttggagttatcaatagtgcaatactcccatcctgctgtcct

SEQ ID NO: 6764 - DNA, 183 bp, Homo sapiens
  misc_feature 92: n = A,T,C or G
cacctgtgttggtgacttccaaatttgtatttctagtcctgggctagagatcctctttgtcttctggccatcagcattttgatgtttatcangctcttgcaaagtctgcacccgcaaagtaaactcattaccttcccttcaaaatcttggctctgtccaaatttcctagtttggtgaatagcc

SEQ ID NO: 6765 - DNA, 421 bp, Homo sapiens
cagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctgg

SEQ ID NO: 6766 - DNA, 415 bp, Homo sapiens
gttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaagacgc

SEQ ID NO: 6767 - DNA, 239 bp, Homo sapiens
ggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtgagccatggtcacaccactgcaccccaacctgggccacctagcaagatcctgt

SEQ ID NO: 6768 - DNA, 241 bp, Homo sapiens
gtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaaagttggactaaatgctcttccttcagaggattatccggggcatctactcaatgaaaaaccatgataattctttgtatataaaat

SEQ ID NO: 6769 - DNA, 171 bp, Homo sapiens
taacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaag

SEQ ID NO: 6770 - DNA, 383 bp, Homo sapiens
  misc_feature 23: n = A,T,C or G
cagactaccacctttcgagatcnggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaaagca

SEQ ID NO: 6771 - DNA, 423 bp, Homo sapiens
cacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttgaaactaggcggctatggtataatacgcctcacactcattctcaaccccctgacaaaacacatagcctaccccttccttgtactatccctatgaggcataattataacaagctccatctgcctacgacaaacagacctaaaatcgctcattgc

SEQ ID NO: 6772 - DNA, 328 bp, Homo sapiens
cgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagt

SEQ ID NO: 6773 - DNA, 100 bp, Homo sapiens
  misc_feature 5, 12, 30, 35, 42, 46, 47, 59, 62, 63, 66, 67, 68, 73, 76,78, 79, 80, 82, 87, 91, 93, 94: n = A,T,C or G
actangggggtnccaaagaaattttgggcnagagnctcgcgnacanncacagcaagaanggnntgnnngcctnccntnnncnccgcncganannctgatc

SEQ ID NO: 6774 - DNA, 387 bp, Homo sapiens
ggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagacagaagaggagctacaaggtgatgatggagtcaatgtagaagaagatgggaaaacaaagaaaagtcagaaggatgatgaagaacaaattgctaaatacaggcagct

SEQ ID NO: 6775 - DNA, 414 bp, Homo sapiens
aaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcata

SEQ ID NO: 6776 - DNA, 100 bp, Homo sapiens
ctgaaaactcgctctttataaacgaggcaaaagcatttaattcccacccccccaccccccgctcccttctgctccttcaataaaccgaaagatgggtttt

SEQ ID NO: 6777 - DNA, 112 bp, Homo sapiens
aagtacttctagagcggccgcgggcccatcgattttccacccgggtggggtaccaggtaagtgtacccaattcgccctatagtgagtcgtattacaattcactgggccgtca

SEQ ID NO: 6778 - DNA, 461 bp, Homo sapiens
  misc_feature 1, 430, 460: n = A,T,C or G
naccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgaanggagccctgtctgcgtttttggatgtgagnt

SEQ ID NO: 6779 - DNA, 437 bp, Homo sapiens
  misc_feature 426: n = A,T,C or G
gtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcangattgaaaatg

SEQ ID NO: 6780 - DNA, 443 bp, Homo sapiens
tgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaag

SEQ ID NO: 6781 - DNA, 450 bp, Homo sapiens
ccagactgaggaagacccggaaacttaggggccacgtgagccacggccacggccgcataggcaagcaccggaagcaccccggcggccgcggtaatgcctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagagattaagagtggttggggggggggccctgggtccctggggggcttggaag

SEQ ID NO: 6782 - DNA, 391 bp, Homo sapiens
gaaagtgttggactttgtcaattaccatgcctgatatcaatgtgtcttacctgactatatcactcctaaaaatttcactgcgggccgtggtccctggatttcctgagggttgattgcccatccccattcctgtagacgagcacacaatggtataagactttcctgtaacacattacagtcttcagaggttaacgtgatgtcatcaatataatgaaaccagggccaggtcagatggctcatgcctgtagtcccagtgactcaagaggctgatgcatgagaatcacttcagcccaggtgttcaaggctgtagcgaggtatgactgcatcactgcactctagcctgagtgacacagcaagacccaccctgtcaaaataaattagatagatagat

SEQ ID NO: 6783 - DNA, 399 bp, Homo sapiens
tgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatc

SEQ ID NO: 6784 - DNA, 359 bp, Homo sapiens
  misc_feature 296: n = A,T,C or G
gctgttgtaggtactaaggattcaaaactgaacagattgagtccctggcctcacattttcttgggggagaaagacagtgaacaagacagatagaatgtctggtcacgcaggggtggtgtgggaagacatgcagaaggggccgcctgctggagggagcatggccagaggatggtgtttctcagtctgtaataagagccataaaggtgctcctgcttgattctgcactaagaatctcctcttgccaggcgtggtggctcacacctataatcccagcacttagggaggcagaagcaggnaggattgctggaacccaggagttggagaccagcctggttaacatagtgagaccccatctctgc

SEQ ID NO: 6785 - DNA, 410 bp, Homo sapiens
gttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtggagaagccatggccagagcttctcccaggcacaggtgttgcaccagggacttctgcttcaagttttgggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgggg

SEQ ID NO: 6786 - DNA, 409 bp, Homo sapiens
  misc_feature 245: n = A,T,C or G
caaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagngttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtag

SEQ ID NO: 6787 - DNA, 346 bp, Homo sapiens
ctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtt

SEQ ID NO: 6788 - DNA, 101 bp, Homo sapiens
gaaaaatatctgtaaagtgagatgaagcaaagtgaagtaacatgaggtatgtctgtagctgttgctgtagtggtttccaaatggtggttttcttttccttt

SEQ ID NO: 6789 - DNA, 393 bp, Homo sapiens
  misc_feature 392: n = A,T,C or G
ggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattattng

SEQ ID NO: 6790 - DNA, 450 bp, Homo sapiens
cagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgaatattttcacactggtaaatg

SEQ ID NO: 6791 - DNA, 441 bp, Homo sapiens
ctcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtac

SEQ ID NO: 6792 - DNA, 443 bp, Homo sapiens
tgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattac

SEQ ID NO: 6793 - DNA, 309 bp, Homo sapiens
gttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttg

SEQ ID NO: 6794 - DNA, 255 bp, Homo sapiens
  misc_feature 75: n = A,T,C or G
gaaaaatcaggaggctggtattctggaagccatcagaagaaaatgtttcacaaaaggaaggtagtattgaatggngtgaaatgttacctatatacctggaaaaaagcaacttcagctgctttttaagtaaatgtgatagtttgtactgcaaataactttccatattgcttttcagatcatgatattttggtccttaagatcatgtagaactttccattgtgagaagggagttgattattttatcattaaagaaac

SEQ ID NO: 6795 - DNA, 156 bp, Homo sapiens
  misc_feature 8, 18, 24, 42, 81, 96, 128: n = A,T,C or G
ctccgtangacaccgttntatganttccacctggcccacggngggaaaatggtggcgtttgcagggttggagtctgccaangcacctccgggacantcacactgactcgcacctgcacacacgccagnactgctcggtctttgacgtgtctcatat

SEQ ID NO: 6796 - DNA, 438 bp, Homo sapiens
  misc_feature 335: n = A,T,C or G
ccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaaagaagtcttacaccactcccaagaagaataagcacaagagaaagaaggttaagctggctgtcctgaaatattataaggnggatggagaatggcaaaattagtcgccttcgtcgagagtgcccttctgatgaatgtggtgctgggggtggtttattggcaagtcactttgacagacattattg

SEQ ID NO: 6797 - DNA, 420 bp, Homo sapiens
gacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagta

SEQ ID NO: 6798 - DNA, 218 bp, Homo sapiens
caaactccgggccacaggaggaaataggaccaagacccctggacctggggcccagtcggccctcagagcccttgcccgctcgggtatgaagatcgggcggattggaggatgtcacccccatcccctctgacagcactcgcaggaaggggggtcgccgtggtcgccgtctgtgaacaagattcctcaaaatattttctgttaataaattgccttcatgt

SEQ ID NO: 6799 - DNA, 435 bp, Homo sapiens
  misc_feature 415: n = A,T,C or G
ctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatgggggtgagacttgagcagaacaggggcttccccaagttgcccagaaagactgtctgggtgagaagccatggccagagcttctcccaggcacaggtgttgcaccanggacttctgcttcaagtttt

SEQ ID NO: 6800 - DNA, 458 bp, Homo sapiens
  misc_feature 455: n = A,T,C or G
gttaggctgcagatggaatcaaggctgataatcagctgacctcaaatgagggagattgtctccgattatctggttgggcccaatatcatcacaagcgtcctcaaaagtggaaaagggaggcagaggaaatcagagtggtgtgatgtgagaggacttgagcatccttgtttgctagctttgaaaatagacgaaggggccacaagccaaggaatgcaggcagcctctggaagctgcaaaaggcaaggaaactgattttcccttaaagcttccagaaagaaccatggtctgctgataccttaatttttatctcagtaagacctgtgttggacttctaacctccagaactgtaagataaaaaaacttgtgttgatgtaagccactaagtttgtggtaagtttgttatagcagcattggaagataaatacagccttctactccttagtgtggcatttgangcc

SEQ ID NO: 6801 - DNA, 441 bp, Homo sapiens
cttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaagg

SEQ ID NO: 6802 - DNA, 463 bp, Homo sapiens
  misc_feature 383: n = A,T,C or G
ggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccangcgtttcctttcattccctcagtgcttctcttctgacctgcatgttgagttctgtattgctggggcttccaacaaaaacc

SEQ ID NO: 6803 - DNA, 405 bp, Homo sapiens
  misc_feature 259, 282, 314, 327, 338, 359: n = A,T,C or G
gccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtggggaagacgctgacctctgggggccacgctgagcacgaaggcaaaccctactgcaaccacccctgctacgtagccatgtttgggcctaaaggctttgggcggggcggagccganagccacactttcaagtaaaccangtggtggagaccccatccttggctgcttgcanggccactgtccangcaaatgccangccttgtccccagatgcccanggctcccttgttgcccctaatgctctcagtaaacctgaacacttgg

SEQ ID NO: 6804 - DNA, 228 bp, Homo sapiens
  misc_feature 21, 39, 92: n = A,T,C or G
cttccccttccctcaagccanggctcctcctcctgtcgngggctcattgtgaccactggcctctctacagcacggcctgtggcctgttcaangcagaaccacgacccttgactcccgggtgggggaggtggccaaggatgctggagctgaatcagacgctgacagttcttcaggcatttctatttcacaatcgaattgaacacattggccaaataaagttgaaatttt

SEQ ID NO: 6805 - DNA, 375 bp, Homo sapiens
  misc_feature 18, 61, 357: n = A,T,C or G
gtaaatttaactgttagnccaaagaggaacagctctttggacactaggaaaaaaccttgtngagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcntgctcataaggaaaggtt

SEQ ID NO: 6806 - DNA, 128 bp, Homo sapiens
gttgggagccccctgatgggcttgtctgtgtttgcaccttgtcctgtgtctgaggtcctgtgactgtaccctcctttgccctgggacatctgtatctcttggctttgtaataaatgctgcatactttc

SEQ ID NO: 6807 - DNA, 260 bp, Homo sapiens
tggaacaaaatctcctccacaccttgtctgtctttgataataaagatgacattgccagttttgtcaaagggaaggtaaaggtaggtcccctgagtttcatgtttctccccatctttccatctttcttccttaagacattccgaacactgtagcacactaacagtttttcctactaactgaacttttggctcaatacgtaatgccaaataagtttcatttatcacctgtcttaactttgtagtcagtctagcaaaatacac

SEQ ID NO: 6808 - DNA, 301 bp, Homo sapiens
atttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtg

SEQ ID NO: 6809 - DNA, 257 bp, Homo sapiens
  misc_feature 222: n = A,T,C or G
gtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaanagaagttattttctacagtggttttatactgaagg

SEQ ID NO: 6810 - DNA, 429 bp, Homo sapiens
  misc_feature 356: n = A,T,C or G
cttttcctgaggaaaaaagttgacctgaccagtgtatgaaattcaaacactgtataggaacaaggtaaaagcacaggtaggaattgctgaataattacctttagaccagcctgaacaggagacttcccacgagggtgagctcatttaatggttcctaaaactcaatcttgtggatgtcagtggtcatgcttgattatttgcagcagtgttttatgaaaagcagtagaaatgcattgggaggctgcagagaaagaggacaataacgggttttacttttgtaaatgaaatcccttcggtatgagacaagtatgttttttgctgctctgcctaagccactgaaaagggagatgtatgtnggatgttagtgtgtgagttttgtgtgtactgttcatgtaggcacatctaaaaactgctgtgcactatggctga

SEQ ID NO: 6811 - DNA, 440 bp, Homo sapiens
cttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggc

SEQ ID NO: 6812 - DNA, 462 bp, Homo sapiens
gtaaattagtgattgccagtgctgggggcttgggggtggatatggggttcctgggaggtgatgaaaaggttctggaattagtggtaacagttgcacaacctggtgatacactaaaatccactgaatcacacgttttaaaaaggtggattttagagtatgtgaattagatttcaataaaaaagaaacaaaaaaatgagttagagataaattttattttgtaaagtttactcattctttgtaattttcaaaaaatgtaatacaacacaagtagtcaatttctacttaattttatggttgttttccctcctaaaggagataacgataagcctaaaacaaagagcaatgagctcatgctaatcagctttgccagttctggtcataaattaggaatactgtaaaagtgaggtgacacctactaacgtcattttgctaagactgctggaagctctaccatcgctaata

SEQ ID NO: 6813 - DNA, 391 bp, Homo sapiens
ggcatacccagctcggcagactccccttagtatgaaactgcttccatcagtaaaatattcaatgtccaggtccccgaggggccaatctgttaaatctttccagcttgagaacactttatctaccacgtccacacagcaatgaaggggacttcctgtgtagggtccagccctacgggggcttagcgggtgttctccccgtgtgcagagacaagacatcgtaagaaataaagacacaagacaaacagataaagagaaaacagctgggcccaggggaccactaccaccaagacatggagaccgctagtggctccgaacggctggctgcgctgatatttattgaatacaagacaaggggggcagggtccggacggtggagtcgtccaagtaattg

SEQ ID NO: 6814 - DNA, 351 bp, Homo sapiens
gacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtttggtagactgttaaagacaattttatgactatttatgcacattataatggttacatctgctttttgtcttt

SEQ ID NO: 6815 - DNA, 128 bp, Homo sapiens
gacttatgaaaaatcatgtaatattatctcagataataatgttatctcattaataatttttatattatttacatgtttatgataacattttggatatattgggttaaataaaatattttgttaaaatt

SEQ ID NO: 6816 - DNA, 204 bp, Homo sapiens
  misc_feature 203, 204: n = A,T,C or G
cttcaacccgttctcatctttgggattgaggcgcctgcagaattacaagagaggatttgtcctcctcttctccagagagctaccttgattttccccacccctgccaagatagacattcatgaatgcagtcatccacacctccacaagtgcacaaaaaccagccatctgcctaaaaaataaaagagcaaaaatgaatcagtgcnn

SEQ ID NO: 6817 - DNA, 183 bp, Homo sapiens
  misc_feature 86: n = A,T,C or G
caactacctgcagaacgtgctggctgagctggctgcccagggggtgaccgaggactgcctggagcagcagtgacctcgcaccccancacgcccgcctctggtggccaccccgctgccccatggctggcctgggtggccaggcaggaagtgcccagcccgagaggctgggaggttttgttgagg

SEQ ID NO: 6818 - DNA, 291 bp, Homo sapiens
ggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgttt

SEQ ID NO: 6819 - DNA, 368 bp, Homo sapiens
atcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattgggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatattggtaaaggcctttcttt

SEQ ID NO: 6820 - DNA, 247 bp, Homo sapiens
gaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatacttttt

SEQ ID NO: 6821 - DNA, 441 bp, Homo sapiens
  misc_feature 394: n = A,T,C or G
aaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtggngtgtgcaggccacagcagcatgcccttggtgtagtcagtgccgaaag

SEQ ID NO: 6822 - DNA, 468 bp, Homo sapiens
  misc_feature 11, 180, 187, 285, 315, 347, 356, 423, 425, 459: n = A,T,C or G
gaaagaatggnatatttttttcccctttgagaaagtgctctcattttctttcgagcttttgtttatttttattttagtcttttaaatttagattttagtttttaactacttaatactaacaatttgagagttgagatgaaggagaaataaggcttctacttccagatttacaggttgggntttttanggataatttttatagatgtatttttataccctttcatctgtttcctcatttgtaacatgaagtaataaaatatgcctcatttgccttggaaattttgnggatgaatgaatgacagtttattgtagtgncctgctagttgaaaggtgacccttaaaatttngatggattntaacaacagattttatggtaatagtttttctattatttgtcacatttgacacttttaaaatttgttnangctcgaaaggacacagaagcgggagaaacgtttncatctgtcc

SEQ ID NO: 6823 - DNA, 269 bp, Homo sapiens
gtacgcccagggaaagcggcgttatgacaggaagcagagtggttatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 6824 - DNA, 497 bp, Homo sapiens
aaaaacacctttttttggaagctcgcgcgcctgcaggtcgacactagtggatccaaagtttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgc

SEQ ID NO: 6825 - DNA, 138 bp, Homo sapiens
gataaatgtatacaatatttctaagggaaactatgtactgtgatgtaaaagtctgggcaaaatgtatataatcctgtatataattatgtatttgattataattactgattgtaaagatttaataaaatatgtaaatat

SEQ ID NO: 6826 - DNA, 143 bp, Homo sapiens
  misc_feature 4, 5, 10, 12, 15, 38, 51, 67, 108: n = A,T,C or G
ctcnngccgntnggnctggtgaacgataactgcacggnttgttttaagaanatggcagacaaaccanacatgggggaaatcgccagcttctataaggccaagctgaanaaaacggagacgcaggagaagaacaccctgccgac

SEQ ID NO: 6827 - DNA, 400 bp, Homo sapiens
  misc_feature 357: n = A,T,C or G
ggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactgggtgcgaccccccacccccgcccctgggctaccatctgatggggcttnggggtccttcctgtgctatttgtacaaataaacctgaggcagg

SEQ ID NO: 6828 - DNA, 461 bp, Homo sapiens
  misc_feature 1: n = A,T,C or G
nagaaatgtggcagagcataactgggcaaagtcttgtaataattttgcaatcctgtattaaaaattaatgtaattgaagtctattggaattattttcattttttcctcctccagggtaaatattaataactcaaattcctttaaccacttttattcaagctctgtgaatcccaaactccattaacttaaatgaagaaacatggttaaacaattttaggctattttattaatgagacacaattccatagctgaaaaggggaagctaaaatcagttgaaacttggaatgaatcaataaggaaaagaaactttcctgaacaaaataaggttaaaatcattcaagtctgctacaacagaatggctagcaactgctctgccgcacatgtacacaaagtgcttttttgcctcatgaagtttctttgcttctcaaagatgattctttaaggaggaaaaaaaaatcaga

SEQ ID NO: 6829 - DNA, 103 bp, Homo sapiens
cttttctagaattatttttcactctaagtcatgtatgtttctctttgattatttgcatgttatgtttaataagctactagcaaaataaaacatagcaaatggc

SEQ ID NO: 6830 - DNA, 411 bp, Homo sapiens
  misc_feature 409: n = A,T,C or G
aaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatcctagntt

SEQ ID NO: 6831 - DNA, 189 bp, Homo sapiens
aagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 6832 - DNA, 436 bp, Homo sapiens
ctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatggggggcttgtcttttgcagggcacagatgaccaaagtcc

SEQ ID NO: 6833 - DNA, 362 bp, Homo sapiens
  misc_feature 226: n = A,T,C or G
aaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgnaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 6834 - DNA, 389 bp, Homo sapiens
  misc_feature 358: n = A,T,C or G
gaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgngggatgttcctcatctgaaattttgagaatg

SEQ ID NO: 6835 - DNA, 421 bp, Homo sapiens
atccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaaccctggctccctcccacccaaccaactttccccccaacccggaaacagacaagcaac

SEQ ID NO: 6836 - DNA, 432 bp, Homo sapiens
gaaatgtacacattaaaaggccttgctgacaacttgcacaatgttgaacatagcctttaagcatcatttaaattttaaaggaatgggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttat

SEQ ID NO: 6837 - DNA, 127 bp, Homo sapiens
ctggcgcaggcctatagttccagctacccaggaggctgaggtgtgaggatcgcttgtgcctaggagattgaggctgcagtgagctgagattgggccactgcactccagcctgggagacagcaagacc

SEQ ID NO: 6838 - DNA, 374 bp, Homo sapiens
aaagagtcaaagacaaaggacatttatcagccaagagtgtgacgcattcttcgcatctagtctgtagtagtgtctgtgctctgggatggataccgtctgatgtctgtttgttattgatggcgcacccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttg

SEQ ID NO: 6839 - DNA, 389 bp, Homo sapiens
  misc_feature 389: n = A,T,C or G
gtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaggattatttgggn

SEQ ID NO: 6840 - DNA, 286 bp, Homo sapiens
ctgaccaccgcaggcgctgtcacccagtgctaccgagacatgggtgcccggcaccgcgcccgagcccactccattcagatcatgaaggtgggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccgg

SEQ ID NO: 6841 - DNA, 295 bp, Homo sapiens
tcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatattttttttcctttgcattcatctctcaaacttagtttttatctttgaccaaccgaacatgaccaaaaaccaaaagtgcattca

SEQ ID NO: 6842 - DNA, 216 bp, Homo sapiens
caagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcattggggtgctctggggaaatattggagggtcatccattccacattaaaagagcaag

SEQ ID NO: 6843 - DNA, 441 bp, Homo sapiens
gatctatctcatgaagttgcattacataactaaaatatttagtttcagctgtattagggaactcttaattctctttcagatgaaattatgataaagctacactttactcaataagtaagagtgatgatgatgaaaataacaatagcataagctacaagctaactcattgctaccactaatacatcagatctcacactaggcattttacatatagcgtgggtaatttggtaacagccgggaataagtatttttataatactcattttatggttaaaggcactatatctaaggaatttaaattgattgctcaggtttatttaacttgcatgagcagatattcacatctatttaactcaatttaacagcaatttttgtcatgtagcatgcaaaatgaacagtactaatatttgtaaacaataaagtatatttaaaataagcata

SEQ ID NO: 6844 - DNA, 413 bp, Homo sapiens
caggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtgggggtgtgtgcagggctgcatcccgcagatggctggaatattaaaattcttctatattggctggtaaattgccatggccctgagccactgagtatgttcattgccacccctgtccctcccctgggcaccc

SEQ ID NO: 6845 - DNA, 424 bp, Homo sapiens
atggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacg

SEQ ID NO: 6846 - DNA, 151 bp, Homo sapiens
gttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgag

SEQ ID NO: 6847 - DNA, 379 bp, Homo sapiens
gtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatggggtaggcctttgtaaaattgacagagaggggaaaccccgtaaagtggttggttg

SEQ ID NO: 6848 - DNA, 440 bp, Homo sapiens
  misc_feature 397, 404: n = A,T,C or G
gcagagcatagaaaaaagatgagtgaatccggaatcaagtaccatacacccctgttctcccgcttcctagctttgtctccttagacaagaaactatgttgcctctttgtcttcacctgtaaaatggtaatatttacagctcacataagattttgtgaatcttaaaccagtgccactcatcaaacattattcaagtgggaattcctattattaacttttagtagcaaaaactagaagcaataaattatcaactcatcactatttttacattcaaatgactggtactgtaagctcctggaaggcagagaccataccacacatttacatagcagctagacagacatcatatacagatatgtgctcaattcaagtttagatggtggataaagggaaaaagntttcctnaattttaaaaaaattagctcaagggctgggcactgt

SEQ ID NO: 6849 - DNA, 404 bp, Homo sapiens
  misc_feature 244, 255, 296, 350, 359, 362: n = A,T,C or G
atacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagngcttaatttgngttttttaattttgattcagaagtagtcccagctcataggngttcatactgttacatccagaacatttgtcaggctctctgtcagctttcatgtncatatggtntanaaaccatgggagttaggcacttcctggattttttttttatgg

SEQ ID NO: 6850 - DNA, 384 bp, Homo sapiens
  misc_feature 368: n = A,T,C or G
gtccgacctccacggcctcacggagctcatcctgctgccccctccgtgccctgccagtttcaatgcggatgaggacgattcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcagttccagctacttgggaggctgacatgggaagatcacttgagcctgggagttcgaggctgcagcgagcaatgattgcgccactccactccagcctgggtgaganaagtgagaccccgttt

SEQ ID NO: 6851 - DNA, 423 bp, Homo sapiens
gttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaaca

SEQ ID NO: 6852 - DNA, 295 bp, Homo sapiens
gttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtccc

SEQ ID NO: 6853 - DNA, 110 bp, Homo sapiens
ctttttaaagagtctaatggacttataacagccttattagcacattaagttctaagagcatcatcactgtaactcagactgaaaatgtttttcctctccctttcagaaac

SEQ ID NO: 6854 - DNA, 435 bp, Homo sapiens
  misc_feature 13: n = A,T,C or G
ggaacatggcggnggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgc

SEQ ID NO: 6855 - DNA, 261 bp, Homo sapiens
gttaaatgttaggaaaaaaattctgaagtttactgatacattgcttggaccccaaagtccctgcactccttagacaagtgttggagggaaacggccacatcaggggtgaagtggcatttatccactagtatactccaagatgtcgcgagtccctgaatcccccacatctctgatttggtcttccagcaactattggaataaggctatatgatttgtgcaacaacaatgaaaagaaggcaggaaagagggaaggaaggatag

SEQ ID NO: 6856 - DNA, 138 bp, Homo sapiens
caggaacaggctccgacgagatcttcctggcaccctgagggtcgtcctccagcaggggcttcttggacccctgtctgaggggtcgcgtcttagtagggcgggattcttttccctttgaataaaaatggattcaaaccc

SEQ ID NO: 6857 - DNA, 390 bp, Homo sapiens
  misc_feature 27: n = A,T,C or G
attgcatgcaagtttgctgagctgaangaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaaaga

SEQ ID NO: 6858 - DNA, 399 bp, Homo sapiens
  misc_feature 378, 389, 398: n = A,T,C or G
gaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttnccaataaaaanaccttttcnt

SEQ ID NO: 6859 - DNA, 424 bp, Homo sapiens
cttccctcccaggctccttaccttggtcttttccctgttcatctcccaacatgctgtgctccatagctggtaggagaagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtagggagcagagccactatctccattgaagctgaaatggtagacctgtaattgtggggaaaactataaactctcttgttacagccccgcc

SEQ ID NO: 6860 - DNA, 433 bp, Homo sapiens
  misc_feature 327: n = A,T,C or G
gtcgggtccgcggcctgcgctgtagcggtcgccgccgttccctggaagtagcaacttccctaccccaccccagtcctggtccccgtccagccgctgacgtgaagatgagcagctcagagggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcangcagccgagatgctttatggattgatccacgcccgctacatccttaccaaccgtggcatcgcccagatgttggaaaagtaccagcaaggagactttggttactgtc

SEQ ID NO: 6861 - DNA, 336 bp, Homo sapiens
ccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggc

SEQ ID NO: 6862 - DNA, 440 bp, Homo sapiens
gtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattggaatgtgaaacatcccgttttcattgttcacttctaaaccaaaaat

SEQ ID NO: 6863 - DNA, 333 bp, Homo sapiens
ggttcactgttctataggctgtgcaggaagcatagtggcttctggggaggcctcaggaaacttacaatcatggcagaaggggatgtgagatgtcttacatggtggagcaggagcaagagagagagcagggaggtgccacacacctttaaacagtcagatctcctgaggactctatcgtgagaaaaatactagcagggtgttaagccatttgtgaaaaacggccctcatgatccagtcacctttcaccaggccccacctccagcactggggattgcatttcaacttgagatttgggtggggacacagatccaaaccagatcactgtaattcctg

SEQ ID NO: 6864 - DNA, 418 bp, Homo sapiens
  misc_feature 392: n = A,T,C or G
gcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccctgatttgtggattaaaagcaacatttgagcgatgatgcacaacagtccaggaaaatgggcggtggacacttgangctgaagatggggagttgacatgagc

SEQ ID NO: 6865 - DNA, 435 bp, Homo sapiens
gctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcag

SEQ ID NO: 6866 - DNA, 438 bp, Homo sapiens
  misc_feature 396: n = A,T,C or G
gtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaaaagtttgctctgcatttttgatgatgggnttgggaacattatctacaattttactctcaaatagtcaaaat

SEQ ID NO: 6867 - DNA, 421 bp, Homo sapiens
tctccaaaagcaattttagtggagtaatagaactgcaaatcaaataccagtattttgagaagcagcaattaagaataattgtagaattgagagcaacaaatatagccactctcaaaaaattcacctgagtggaagacggtggtaatagctaggagaggatgctatgttgaaggccagttttaattactttttaaaatttgttaaaaatatgtgatagacttgaacacaaagataggttgaggacaaaaaggcagcagagaggaagaccaatacggggaaatggggtggtaattgatgaggcaagtgtcctgagaatttgagaagggatctttgagaaccacaacttctagccctgataactgtgaatatatatcgagataatgataaccctttaggtgcaaagataggtcgtcagtggtag

SEQ ID NO: 6868 - DNA, 331 bp, Homo sapiens
  misc_feature 146: n = A,T,C or G
cgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccnggtggacctgctccagcagctggtgctgcaccagcaggaggtcctgccccctccactgctgctgctccagctgaggagaagaaagtggaagcaaagaaagaagaatccgaggagtctgatgatgacatgggcttttggtcttttttgactaaacctcttttataacatgttcaataaaaagctga

SEQ ID NO: 6869 - DNA, 402 bp, Homo sapiens
ccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtgggaga

SEQ ID NO: 6870 - DNA, 440 bp, Homo sapiens
  misc_feature 409: n = A,T,C or G
ccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataangacggctggtcccttgtggtactcagagtat

SEQ ID NO: 6871 - DNA, 217 bp, Homo sapiens
gaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaa

SEQ ID NO: 6872 - DNA, 410 bp, Homo sapiens
ctgtctcaccacaaaattgtcttaataaggacggaaataagcaaagccttgatatatcataaatcttaatcaaagacagtgtttaaagttctccagaacctgactgaacaaaagagagtcacataaaagggaggattgactgtgttggcagaaagaaagtgtcagacagatagcaaatgagggcatcatttctgatagtgcaggggaccccagacatgcacatggatgcacagagagatgcacacacacacactcatacacacaggcagacacaaacagagatgcaaatgcccacagatgcacacacagacaaagagagagatgtacacacagagaaagatgtacacacagagaaagatgcacacacaaagagagatgtacacacagagaaagatgcacacacagatgca

SEQ ID NO: 6873 - DNA, 440 bp, Homo sapiens
tggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtacctggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctacca

SEQ ID NO: 6874 - DNA, 253 bp, Homo sapiens
  misc_feature 9, 10, 61, 96, 100, 168, 178, 194, 207, 239, 246: n = A,T,C or G
gccccttgnncaaaggctgactgagcgccagacaggacgtttccaactcaaaaatgcaggntcaacagtaccaccatcagcgtagaaaatttgcanctgncttcttggcattcattttcatactggcagctgtggatactgctgaagcagggaagaaagagaaaccanaaaaaaaagngaagaagtctgactgnggagaatggcagnggagtgtgtgtgtgcccaccagtggagactgnggtctgngcacacg

SEQ ID NO: 6875 - DNA, 232 bp, Homo sapiens
  misc_feature 11, 25: n = A,T,C or G
gccaccttggnaagtgcctgcgcanggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagc

SEQ ID NO: 6876 - DNA, 200 bp, Homo sapiens
tcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 6877 - DNA, 420 bp, Homo sapiens
tgttccagaaataagctgtgttctactatgcctctaaatgactatacatttcagtatcacacttgatgtatttttaaattgtagcttaagttgaactgtaaataaattaagggatgtagacatatgattgcacttttaaagacatgctgggcttctgtagtttataggaagaacatactgtttgctggaaaaatcagtgtctcataatgtgatacatttttgttctctgtgttacttttataggtagatctttttctccgtggtacttaccactgcctcatatattgtatatttgtttggtttcgtctgtcttcttctaccaggatgtaagtcacacagggcggaaactttttgttcactgcagtatcctcgatgctttcaacagtgcctggcacataaatagctcttaatattaattga

SEQ ID NO: 6878 - DNA, 285 bp, Homo sapiens
acaaaaaccccaaaactgaatgctttaattaattagctttgcaacatttataattacatgtaatgcttctttgcaggaacacacatatttgcctttatcaagaagcttatacactaaactatgttgaacttacatgtcaagaaacttatatactaagttaaacgtaatttctggtttaatattgagtatagcattattagtatgtacgcatgttacccatggccttatgtgtgaccattcattttcagtattgaagcagcacgcttggcttgcattttatgaagt

SEQ ID NO: 6879 - DNA, 366 bp, Homo sapiens
gcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggctttt

SEQ ID NO: 6880 - DNA, 438 bp, Homo sapiens
  misc_feature 1: n = A,T,C or G
naccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaataagttctgccacctctgacgcaccac

SEQ ID NO: 6881 - DNA, 430 bp, Homo sapiens
  misc_feature 240, 287, 312: n = A,T,C or G
cttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggnaaggtgtccttaagtttgctcgcttggtcaagtcctacgaagcccangatcctgagatcgccagcctgtcangcaagctgaaggcgctgtttctgccgcccatgaccctgccaccccatgggcctgctgctggtggcagcgtggccgcctcctgagagttggccctcccttgtgccactgccaggggaag

SEQ ID NO: 6882 - DNA, 452 bp, Homo sapiens
  misc_feature 352: n = A,T,C or G
cacaggcatgcatagcctcaacttatataagttatgccaacttgtgttctgaagtgggcatggcagcttatgctcccagcaggagtctatgagaattcttgttgtacatcctcaccaacatttgggattgtgagacctcatgttttatccatctattcagctggaagtgaaatctcagaggggtttttaagttgcttactagtgagcatgagcatcttttcatatgttgcttggcccttcctgtttccccatctgtgatttgaccattcaaggtgtttgcctacttttcaatgggtctattctttttgttattgatttgtagaaatcccatataaattatggaaacatttangtctttaactggaattaattttatatgaatgctgggagatagaaataaatttttgcctgctttatcttcttacttgtttattttcatggtttcctggcat

SEQ ID NO: 6883 - DNA, 443 bp, Homo sapiens
aagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacga

SEQ ID NO: 6884 - DNA, 413 bp, Homo sapiens
  misc_feature 12: n = A,T,C or G
cttgtccatggnaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgaattatgaaataaaaactaaataac

SEQ ID NO: 6885 - DNA, 464 bp, Homo sapiens
  misc_feature 1, 14: n = A,T,C or G
nattccttcaaagnttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatga

SEQ ID NO: 6886 - DNA, 452 bp, Homo sapiens
  misc_feature 448: n = A,T,C or G
cacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcaaagccagcatctccgtgaaggtggatggaagcgcctttgtcctcattttgagctgcaagctgggtcagcggctctgaagccctcgagtgactttctaacccaagacccagcccctggcangagg

SEQ ID NO: 6887 - DNA, 227 bp, Homo sapiens
gtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaacc

SEQ ID NO: 6888 - DNA, 336 bp, Homo sapiens
ccaggagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggcttggaaggggtccagcctcgttggaagaggaacagcactggggagtctttgtggattctgaggccctgcccaatgaga

SEQ ID NO: 6889 - DNA, 500 bp, Homo sapiens
  misc_feature 12, 16: n = A,T,C or G
tattacaattantggncgactagtggatccaaagaattcgacgagcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagc

SEQ ID NO: 6890 - DNA, 257 bp, Homo sapiens
  misc_feature 13, 202: n = A,T,C or G
taccaatgagggnatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaanaaagccgaggctggggctgggtcagcaaccgaattccagtttagaggcggatttg

SEQ ID NO: 6891 - DNA, 361 bp, Homo sapiens
gcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagg

SEQ ID NO: 6892 - DNA, 336 bp, Homo sapiens
  misc_feature 11, 12: n = A,T,C or G
cttcggagcgnnctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgtt

SEQ ID NO: 6893 - DNA, 243 bp, Homo sapiens
gaaaggcaaaccaggagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 6894 - DNA, 443 bp, Homo sapiens
  misc_feature 54, 100, 115, 125, 167, 233, 346: n = A,T,C or G
atttaatacaatatcttgttcaagttcacagagctagccagcagcaggtgcaanactaaaatctagtaatgtcatcggaaaccttgctcttaagcatgtnacttttatgcatctntttctctagngggggatgaaggtaagtacaccagtgagcttatggctttgtnttttggtgatggatcttgctcctcttacagtaccctgggcatttacccatctgattaaagtaagtnattctagaaagagagaaggaaactgccatcagttattatttcaaacttcacaataaggaatgggaatttagcccagatccatctaccttaaagccccaataggaacatcatanagcatggagtagtgcttatactggcaagatgtacaatatcagagaaatttacaacaaggtttccatcagataaattcaatgcttcctgtgagcagag

SEQ ID NO: 6895 - DNA, 106 bp, Homo sapiens
  misc_feature 106: n = A,T,C or G
caactagcttctttattagagaggagcgggtgaaaagtagtagtttaatgttcagatatacaatcatttaaaagtattcaatacatggtgtttgatggtaatggcn

SEQ ID NO: 6896 - DNA, 111 bp, Homo sapiens
  misc_feature 53, 104: n = A,T,C or G
tacttctagagcggccgcgggcccatcgattttccacccgggtggggtaccanggtaagtgtacccaattcgccctatagtgagtcgtattacaattactgggncccgtca

SEQ ID NO: 6897 - DNA, 445 bp, Homo sapiens
cggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttgg

SEQ ID NO: 6898 - DNA, 442 bp, Homo sapiens
  misc_feature 1: n = A,T,C or G
natttggagatacataaattttaaaatcaaaatactagtaatgcatggtaaaggtgtactccaacatttatttgataatattttagtttttaataggatcaactaagtgaatttctcatatcgattttgttgcatcgttagaattacatgcatgatttagatgtgtacataattgaaccaaacacagaaagagttcaaggggaaaagaaggctaatacagtatgtacttaaaaaaagtctatagtgatactagtgaatacttatgtgttgtaacgagaacatttgtgattactttgagcttggggaaatattatttctaagattactttgagcttggggaaataaatgtaaggttggctaagacactcgtaccatgataaattcctccaaacttccacatcattctccagaagtccctgggacttgagaagccaggttagcg

SEQ ID NO: 6899 - DNA, 379 bp, Homo sapiens
aaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatattttttgtacatctagctgtatcgaggcatcaggcctgaataaacatcctttctt

SEQ ID NO: 6900 - DNA, 458 bp, Homo sapiens
ggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactg

SEQ ID NO: 6901 - DNA, 440 bp, Homo sapiens
ccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctac

SEQ ID NO: 6902 - DNA, 106 bp, Homo sapiens
  misc_feature 57, 75, 78: n = A,T,C or G
aatatcttccacagagggaagtttaaaacccaaacttccaaaggtttaaactacctnaaaacactttcccatgantgngatccacattgttaggtgctgacctaga

SEQ ID NO: 6903 - DNA, 440 bp, Homo sapiens
  misc_feature 300: n = A,T,C or G
cccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgangtgggtttggagactcagcaggctccgtgcagcccttgggaacagtgagaggtttgaaggtcataacgagagtgggaactcaacccagatcccgcccctcctgtcctctgtgttcccgcggaaaccaaccaaaccgtgcg

SEQ ID NO: 6904 - DNA, 326 bp, Homo sapiens
  misc_feature 4, 10, 12, 170, 172: n = A,T,C or G
gcgngggatngngagatgagatgccttctggcttacttcactgtaggccatcctgggaaatttcaagtcgttcataaatatacataccaaaatcaaattctaaattacaaacagaataagatgagtaagcaaagatcaaagtgaagaaggtgtggaattttggagggccngngggtagaatggtgtgccatgggaaggagagaggagcatcctggagacgctcctttcaccaacaaggtaagggagtggtttatcaaatttctttggtccataggtattgacaaacgttgtgggcttcaggttctagcctagggcagaacaaagcc

SEQ ID NO: 6905 - DNA, 277 bp, Homo sapiens
aaataaatggctgtggttttgagatatgaacctatatatccctttttaaaaaaactattttagtttttcatgtaatggggaaagagaaatttttactttaccttctccttttaatgagtgttctttcttatgtattattttaaggaaacctgactctttcttctacatctgctttaatatgtaacatttaattttgcactaattttctaaaatcacaatgtatatgcttttgtttgcatgactatgagtaaattattaaacaaagataaggtaaaca

SEQ ID NO: 6906 - DNA, 413 bp, Homo sapiens
gtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagtaagttttgattttcaaatgttctgcttcatgtgtctgtgaagaattgtacttttttaaaagtgtgtgtcctctga

SEQ ID NO: 6907 - DNA, 219 bp, Homo sapiens
  misc_feature 12: n = A,T,C or G
tgtaaccacagngactacaagtagttctttctctattgaattattaggtccagaatagaagatgtcattgtacactttatttccctcacactgtgttacgctctgatgtgctatgcttagctatctgtcagagattagtaaattataaaactcatgtgtactacttaagtttatatcttatgctagtttataagaacaattaaaaggacttagaagatt

SEQ ID NO: 6908 - DNA, 301 bp, Homo sapiens
aaaatctaaataaggtcaataagaaatgaaacaggagatattacaactgacaccacagaaatgcaaaagatcatacaaggctacaatgaacaactttatgtgcataaactagaaaaccaagaatagatgaataaattcttgggaaagatacaaccttcttagcttaaatcaggaagaattagataccctgaacagatgaaaaacaagcagagagattgaaatggtaattcaagaattaacaacaataaaaaaaaaatgtccaggaccagatggattcacagctaaattctaccagacattc

SEQ ID NO: 6909 - DNA, 197 bp, Homo sapiens
aaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccatt

SEQ ID NO: 6910 - DNA, 407 bp, Homo sapiens
gccatttccccagtattggcatgggcatggaaagaatgcttcttgagttaatgattaaggagaggctctcttcctgggcatcccacaggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaaga

SEQ ID NO: 6911 - DNA, 244 bp, Homo sapiens
cggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagca

SEQ ID NO: 6912 - DNA, 440 bp, Homo sapiens
cttatgaaaagaaggctgcgaagctgaaggaaaaatacgaaaaggtaagaagtgtgggtttgcttggtaaaatgatgacaagtacgccagatgtatgattgtacttagtttgaggtgtaataagtttttagggtaacagctacattaagtatggtgttgatataagtcctcatccttcaaagaatgcagaggaccaaataaattagggtttttttgactaaaatgtaatcagactcagacaaaggctgtgtacatttatgttggttttgttattccccagtatcttgaagttcatgaaaatgttggtagtcacttcaagtcaaaaatgagcattttcaaatggcttggcatacagtacaaaaacaggctagacaaagtaatataggctatatttttcttagtcatatcctgaaacatttatgttcttttcctttagatac

SEQ ID NO: 6913 - DNA, 414 bp, Homo sapiens
  misc_feature 410: n = A,T,C or G
gtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtggggtttgggnaaga

SEQ ID NO: 6914 - DNA, 413 bp, Homo sapiens
  misc_feature 348: n = A,T,C or G
tccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccggtgggggaangggggcaaaggatgctggagctgaatcagacgctgacagttcttcaggcatttctatttcacaat

SEQ ID NO: 6915 - DNA, 124 bp, Homo sapiens
gcagagcttcagaggtggccccacctgagcccccacccgggagcagtgtcctgtgctttctgcatgcttagagcatgttcttggaacatggaattttataagctgaataaagtttttgacttcc

SEQ ID NO: 6916 - DNA, 283 bp, Homo sapiens
gcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccatt

SEQ ID NO: 6917 - DNA, 427 bp, Homo sapiens
acgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagc

SEQ ID NO: 6918 - DNA, 429 bp, Homo sapiens
gcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaac

SEQ ID NO: 6919 - DNA, 438 bp, Homo sapiens
  misc_feature 412: n = A,T,C or G
gccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttggtttgnaaaaggatgccaatgttttacctgat

SEQ ID NO: 6920 - DNA, 434 bp, Homo sapiens
gttaaatttcccaaacatttcttctagttctttcttccatgtcatgtaatttattgtgtttttccatttatacaacctaatgctaggttagaaaactgatgcttaggaagatatggtattatctgttggtttcaccagggtttgtgaatactgattacagtctttatacataacagtatttttaaatggctgctatatttggggagccccttgtctatactgaaggtttggactgttcttgtaaacaggtatatgcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggcta

SEQ ID NO: 6921 - DNA, 439 bp, Homo sapiens
cgttgctgctcatgatttacatccctgacttctaatctctttgagtgtgaaaacttcctttttaacaccacaaattattgttctctccctttgaggatataggtcacatatttttatagtaatgattgtacttacaaaatgtatgtactgagaagatatgaaataatgagtaaatgccaggaaattctcactctatgtctttgtattctttggtgtatacatactacaattaaatccacacatattgattgaaccaactatgtttaggggacactgcctgtgatggggattataggggaaagaatgagcaagaagtctctatccttgtgaggctttcacaggaggaggtagataataaacaagtaaatactacagaaaagatatttatagattgtgatgactgacatcaagggaataaagaaggtgatgtataataatg

SEQ ID NO: 6922 - DNA, 435 bp, Homo sapiens
ggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtggttggtccctcaagagggagactttcttcctcagtggcggagagaagaaagtgcat

SEQ ID NO: 6923 - DNA, 255 bp, Homo sapiens
  misc_feature 103: n = A,T,C or G
atttcttcttcttcttttttaactgaaagctgaatccttccatttcttctgcacatctacttgcttaaattgtgggcaaaagagaaaaagaaggattgatcangagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttg

SEQ ID NO: 6924 - DNA, 427 bp, Homo sapiens
aaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgag

SEQ ID NO: 6925 - DNA, 323 bp, Homo sapiens
caaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttcca

SEQ ID NO: 6926 - DNA, 445 bp, Homo sapiens
  misc_feature 9, 10, 13: n = A,T,C or G
ccaagatgnnggncccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggatagggaaagaaaaacttatccaggaaggaaaattggatcgaacatttcacctctcatattaagtctggcaatgatgactatatgtattcctgcctaaataaatcatctatt

SEQ ID NO: 6927 - DNA, 179 bp, Homo sapiens
  misc_feature 179: n = A,T,C or G
ggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcn

SEQ ID NO: 6928 - DNA, 409 bp, Homo sapiens
gtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 6929 - DNA, 406 bp, Homo sapiens
gcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagccggaagggtacagccaatgcccgaatgccagagaaggtcacatggatgaggagaatggagggattttgcgccggctgctcagaagataccgtgaatctaagaagatcgatcgccacatgtatcacagcctgtacctgaaggtgaaggggaaatgtgttc

SEQ ID NO: 6930 - DNA, 422 bp, Homo sapiens
gcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccctgctcccacatcttccacctcaggtgcctgcagaacaacgggacccggagctgtcccaactgccgccgctcatccatgaagcctggctttgtatgactcctggcagcaggcgtgggcttcctcctcgcca

SEQ ID NO: 6931 - DNA, 406 bp, Homo sapiens
  misc_feature 168, 198, 252, 320: n = A,T,C or G
aaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgnggcactgggaaaagtggaaacaaacatgtnttgaaatacatattggaaataaaaatggtttgagcgtcagtgatattctcccanaatgtacttatcttacctcggcatgtactgtagtcactcagtatttgtatatgttgctagaattttanattgtaaaatagtgaaattttaatgtgttcatttgtttttaatgtatatatgtcttgctcagattatttggtttaaataaaacaac

SEQ ID NO: 6932 - DNA, 412 bp, Homo sapiens
  misc_feature 350, 398: n = A,T,C or G
gcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcangcgtcggagggccccctcaagggcatcctgggctacactgagcaccangtggtctcctctga

SEQ ID NO: 6933 - DNA, 172 bp, Homo sapiens
ccagcaggaaagcagtgggagttgggtagctgctggggccagcatgtcctcttccacactacctgcctttcagaactctgctcttccgcttgtcccaaagtcagggctggcaatcttcataatcaaaggggagttggaaaagaacacccactaagaggcctccatggcagat

SEQ ID NO: 6934 - DNA, 438 bp, Homo sapiens
cagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaatttctgtgctaaacagtgttacagtcgccaagagcccataaagggagccctcctggaagtggatgaggccttgggtctcggctcttcattgcttcctgagctgcagcagatgcctttacaaccaagctcaccgaggacgtctgtctcccatattaccctggcagagggccaggcctgttctacacggccggggtttcaacaaggtactgatgtcttctgcccttgcctcttcgacaggcaagtaataagacttaagtgaaggagaattc

SEQ ID NO: 6935 - DNA, 410 bp, Homo sapiens
  misc_feature 12: n = A,T,C or G
ggcaacagccgnttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatatttttttttcctttgcattcatctctcaaacttagtttttatctttgaccaaccgaacatgaccaaaaaccaaaagtgcattc

SEQ ID NO: 6936 - DNA, 286 bp, Homo sapiens
ataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataac

SEQ ID NO: 6937 - DNA, 438 bp, Homo sapiens
  misc_feature 1: n = A,T,C or G
naattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtgggagtttacctgtaatgtgaaattttcacatttgaattttttaattgcctggcaaaagctgatata

SEQ ID NO: 6938 - DNA, 167 bp, Homo sapiens
  misc_feature 24, 70, 160: n = A,T,C or G
ctgtgtttatcttttttttttganatggagtctcgctctgtcgcccaggctggagtgcagtggtgccatntcggctcactgcaagctccacctcctgggttcacgccattctcctgcctcagcctcccaagtagctgggactacaggcgcccgccaccangcccgac

SEQ ID NO: 6939 - DNA, 437 bp, Homo sapiens
  misc_feature 368: n = A,T,C or G
gtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggcttttgtgttcaccaaggaggacctcactgagatcagggacatgttgctggccaataangtgccagctgctgcccgtgctggtgccattgccccatgtgaagtcactgtgccagcccagaacactggt

SEQ ID NO: 6940 - DNA, 112 bp, Homo sapiens
gagtacttctagagcggccgcgggcccatcgattttccacccgggtggggtaccaggtaagtgtacccaattcgccctatagtgagtcgtattacaattcactggggcccgg

SEQ ID NO: 6941 - DNA, 443 bp, Homo sapiens
  misc_feature 11: n = A,T,C or G
gtgtattaagncaatattagaatgagggggattccaggaacctaaaagatactcattttcataagaggaagtatggtgaatagctaactggaatttagtgttctaagaataattttgttaaatttacctttaaaaatatctgagggagttactagattatatatctagtttatgtatatggaaaaaaatgttatggccagccattaacagtgatgccaaggaaaacaatttatttcccagcttttgaatttgaaacttaacagatggagagtgtcaaaatggaagggcagtggtaccctgctttccctattcagagggaaaaaaatccttgacccgcagttgagctgatgatctctgccacagtcattgtgaattctaatcaatatttcatcattgctgtcaaatgatagcctgttactaatgaaacaacattctgtcccagc

SEQ ID NO: 6942 - DNA, 440 bp, Homo sapiens
atttcctaggccccaggcatgggagtaatttgtctcacaggtgtggttgcctgggcaagtgcaaacatagccatgtttgaaatgagcagtttccattggtagcccacacatgattcctttttaagcaacacttgggcccaggttgtcttgtaaaatgtctttcaaaatcacttgtccattcatataaaaatatgtattgcacaaagagaagatcagctggacaacaggaatacaatggtgatcttgctctcacagaacttaccttctagaggagagaataaaaaacaagcaagtaaatatattagtaaacatgatagtgtaagtaccgtgagggcaattacactttccaggcaaacactgaatgaagggagtaaaaactactggatcttttggaatatatgataaaacttttccaagttaggaaaagtctatgggactca

SEQ ID NO: 6943 - DNA, 419 bp, Homo sapiens
cctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctcctt

SEQ ID NO: 6944 - DNA, 275 bp, Homo sapiens
caccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagc

SEQ ID NO: 6945 - DNA, 431 bp, Homo sapiens
  misc_feature 11: n = A,T,C or G
aaaatcttaanggcaatcagagaagaatacacattatatacaaaacagacaatggaaggatcacagacttcatttcacctccaactttgcaagcctgaagacaatgaaataacatctttagagtgctcaaagaaaaaggcagccttgaattctatatttaatgaaaacatcttcaaaaacaaagatgaaataaagtttatcagacataacttgagggaatttgttgtcggcagatatatgcaacaagaaatgtttaaaggaaattattcaggccaaagcaaaatgataccagatggaaacttgaaagacactatttcagaagtagtaaatatgtggacaaatagaaaagactttgtgtccttatttttaaatttcttggaaagctaattgactgcatgaagcaaaaatagtaacaatgtatttttgagata

SEQ ID NO: 6946 - DNA, 360 bp, Homo sapiens
  misc_feature 170: n = A,T,C or G
aaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcantgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaaaaaaacc

SEQ ID NO: 6947 - DNA, 436 bp, Homo sapiens
gacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaat

SEQ ID NO: 6948 - DNA, 222 bp, Homo sapiens
  misc_feature 1, 217: n = A,T,C or G
natcaattaatttagcatagaaaaaaattatgtgcttttttttcttctttgtaagtctgtgagttattgaggacatgccttatatgtgagacctctttgttttcagaccaatgttccattttgtgcctcagtaaatcagaggatactcacattcaaactggttccagaaaaaaaaaaaggttaatttattgtttcacataactgaaaagtagagaanccaat

SEQ ID NO: 6949 - DNA, 128 bp, Homo sapiens
  misc_feature 54: n = A,T,C or G
gttgggagccccctgatgggcttgtctgtgtttgcaccttgtcctgtgtctgangtcctgtgactgtaccctcctttgccctgggacatctgtatctcttggctttgtaataaatgctgcatactttc

SEQ ID NO: 6950 - DNA, 221 bp, Homo sapiens
ggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatattggacgtctgaaaaataaaatattcatcatt

SEQ ID NO: 6951 - DNA, 426 bp, Homo sapiens
ctcaaccacaccatcaactgacaggatctaattggcattcatagcacaatctgtccaacaacagcagaatacacatttttttaaaggtcccatgagacatttaccaagatagagcatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcgtcaaagtggtaatctcaaaggaaattttaaaaagacaagaaaagaatgaacatgaaaatatgacatgttaaaattttgtaagattagctaaagcagtgctgagaataaaattgataggagtaaatgcttacattagaaaagagg

SEQ ID NO: 6952 - DNA, 404 bp, Homo sapiens
  misc_feature 368: n = A,T,C or G
aacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccantggcggtgccgacaagcccctcaagggctgaaggcc

SEQ ID NO: 6953 - DNA, 180 bp, Homo sapiens
atcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaaatgtatgtatgtattatatt

SEQ ID NO: 6954 - DNA, 375 bp, Homo sapiens
  misc_feature 14, 374: n = A,T,C or G
ctcacctgtgagancaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggaagactctggtcaagaagcatcgtgtctggcgttgtggggatgaactttttgttttgtttcttccttttttagttcttcaaagatagggagggaagggggaacatgagcctttgttgctatcaatccaagaacttatttgtacatttttttttcaataaaacttttccaatgnc

SEQ ID NO: 6955 - DNA, 466 bp, Homo sapiens
  misc_feature 8, 169: n = A,T,C or G
gtgacctngagggggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcancctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactgg

SEQ ID NO: 6956 - DNA, 427 bp, Homo sapiens
  misc_feature 275: n = A,T,C or G
ctatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctganaacttcaagctcctgggaaatgtgctggtgaccgttttggcaatccatttcggcaaagaattcacccctgaggtgcaggcttcctggcagaagatggtgacctgggagtggccagtgccctgtcctccagataccactgagctcactgccca

SEQ ID NO: 6957 - DNA, 299 bp, Homo sapiens
cccaggctttgttggtacaattctaattgatcagctgagtctctgtagtaatgctccatttcttggtcatatgtatattttgaggaataacaagtgttttaaagctcaaaataacagttatgctaacatatactataagctgcattctttaatccatatatagggaaagaaaaacctagattgttaatccggaacatttacattcttaaacatagtaaattgtctactgtacttaactatgttaaatacttttaaatggcctagagcttcatctttttatctaataaaaatgaataaat

SEQ ID NO: 6958 - DNA, 293 bp, Homo sapiens
  misc_feature 101, 133, 150, 170, 284: n = A,T,C or G
ctcgtgccgtgagagaccattgtctcgttggctggcgctcacggacatgcagtcacggtagcgggagcaatcacaaaactgtaatttacttaccaaatctnttcctttccgtagcctcgcctgcctgacttanagaaagaaaagcaatanttttacaggcattttgaggngtctctttgggttctttctgtttgaaaggatatttgtcgaaaaaaagagcaaaaccgttttaaataaactccccctggaaaaaaacccaaaacactggcatctgagtaggaatntgaaaatga

SEQ ID NO: 6959 - DNA, 497 bp, Homo sapiens
  misc_feature 16, 23, 39, 52, 58, 61, 64, 137, 153, 175, 250, 251, 310,312, 334, 356, 402, 425, 430, 447, 482: n = A,T,C or G
tcgtattacaattaantgggcgnctagtggatccaaagngcgggccgaccangcagcnggnggnctgagacagcatgacgcctgaggtggatgccacactcaagtccctcaacaaccagattgagagcatccgcagnacccgagggctcccgnaagaaccctgctggcacctgcngagacctgaaactctgccaccctgagtggaagagtggagactactggattgaccccaaccaaggctgcaccttgnncgccatgaaggttttctgcaacatggagactggcgagacttgcgtctaccccaatccancnaacgttcccaagaagaactggnggagcagcaagagcaaggagangaaacacatctggtttggagaaaccatcaatggtggcttccatttnagctatggagatgacaatctggntcccnacactgccaacgtgcanatgaccttcctacgcctgctgtccacggaaggctnccagaacatcaccta

SEQ ID NO: 6960 - DNA, 249 bp, Homo sapiens
cttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatga

SEQ ID NO: 6961 - DNA, 444 bp, Homo sapiens
  misc_feature 13: n = A,T,C or G
ccgagcaggaggngccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcacttgtcctgctctccggtc

SEQ ID NO: 6962 - DNA, 445 bp, Homo sapiens
  misc_feature 9, 12: n = A,T,C or G
attggaccntgnagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctt

SEQ ID NO: 6963 - DNA, 443 bp, Homo sapiens
  misc_feature 10: n = A,T,C or G
caccaatgcnatgctggggaaaaagacagtggtttcagagttctatgatgaaatgatatttcaagacccaacagcaatgatgcaacaattattgacaacatctcgtcagctaacattaggagcctataagcatgaaacagaataatcaagaatgattgagaataggaacggctcaagacgttcacaactaaggccatgaatagctaggaattccctttaagagcaaaggttttatcatcagacagacctacttgcaggcacttctgtgagaactgagccattacaccagccttggaagccagaggcagctggatccttcaggcctggcatctcccaggcccgcggtcctacctcagtggaggaagagtgggaactgctgtgcattccaacttcagttccctgtgtgtgccgctgccaccatcgctcacctgcaaactgcttca

SEQ ID NO: 6964 - DNA, 444 bp, Homo sapiens
  misc_feature 1, 13, 14, 15, 16: n = A,T,C or G
naccaaaataaannnngaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttctt

SEQ ID NO: 6965 - DNA, 461 bp, Homo sapiens
  misc_feature 7, 9, 12, 13, 15: n = A,T,C or G
aaaaaantnganngnggttttcatccacttcttcccaggtaaatccccagtgtagttagggtcaccattcttcttttgctagtctctgacctaatccagggctcggacaaggacctgcaggacaaacctggcccactgcctgttttgtaaatagagtgtcactggaacacagccaggctcatttttttatgcatcgtctgtggctgcttttgcactactatgagagttgaatagttgcaacagagactgtatagcccataaatcctaaaatatttacttttctatcctttacagaataagtttcctgactcctgataatccacaggacttggctctcctcagccatgaggaggagaggaggagagagaacgggttgtcggggggaaaacttggagtgtgaggtgatcaagccacttaagtccccaggttagtttttccttgagcctggatgcagtacaaag

SEQ ID NO: 6966 - DNA, 445 bp, Homo sapiens
  misc_feature 10, 13, 165, 166: n = A,T,C or G
cgaagatggnggnggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagnncctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctg

SEQ ID NO: 6967 - DNA, 234 bp, Homo sapiens
gaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 6968 - DNA, 446 bp, Homo sapiens
  misc_feature 13: n = A,T,C or G
gttcggactattngtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgat

SEQ ID NO: 6969 - DNA, 446 bp, Homo sapiens
  misc_feature 11: n = A,T,C or G
ccctggtgctnttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagccttgggtgagaaacaccatccaaagctggggcaaagatgattaccttcagcatgattacaatgtattaccttcagtatgattaccagaagtcctacttga

SEQ ID NO: 6970 - DNA, 367 bp, Homo sapiens
ggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagag

SEQ ID NO: 6971 - DNA, 310 bp, Homo sapiens
ccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttctt

SEQ ID NO: 6972 - DNA, 434 bp, Homo sapiens
tatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatc

SEQ ID NO: 6973 - DNA, 447 bp, Homo sapiens
ctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgag

SEQ ID NO: 6974 - DNA, 426 bp, Homo sapiens
gctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaac

SEQ ID NO: 6975 - DNA, 364 bp, Homo sapiens
aacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaat

SEQ ID NO: 6976 - DNA, 308 bp, Homo sapiens
ctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 6977 - DNA, 388 bp, Homo sapiens
  misc_feature 7, 12, 13, 15, 181, 352: n = A,T,C or G
acgacgngcggnnanggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtntcttttgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccantcggcccctcacagcccttgcccgcttcgggtatga

SEQ ID NO: 6978 - DNA, 435 bp, Homo sapiens
  misc_feature 331: n = A,T,C or G
acatggatcaggatagaccccctgagtaagctcatgccacagtgggaggaacctccccttcaggggagtctgggctgggctctgggcccaggcactgccctgggggtcatgaggccattccagcatctagctcagtgtgaggcactgttctaagtgcagggaaccacagtatggggtcaggttcatgtcctgtttctgcctaagttaactcccaggcaacctctccctgaaacacttcctctcccaaagagggccttagaatccatgaagctcctaggccaggcccacctgtgatcctgtaaacttttctctcagaaaagccccatctcangctaggcatggtggctcacgcctataatcccagcactttggaggtcaaaggtgggcagatcacctgaggtccgggaagttcgagaccagcctgaccaacatggt

SEQ ID NO: 6979 - DNA, 372 bp, Homo sapiens
  misc_feature 7, 11, 12, 370: n = A,T,C or G
gctgtgnaganngaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtcttggaggagaaaaagacagaacaaagatggaagtggcctgggcccctggggggggggncc

SEQ ID NO: 6980 - DNA, 365 bp, Homo sapiens
  misc_feature 9, 12, 14, 167, 168, 171: n = A,T,C or G
ggcatgggntgngntatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctnngtngattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaag

SEQ ID NO: 6981 - DNA, 410 bp, Homo sapiens
  misc_feature 8, 11, 15, 169: n = A,T,C or G
ctcacttnatncggngactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggngtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaaggggaagcaaagaaagaagaatcccgaggagtctgatgatgacatgggctttggtcttttttgactaaac

SEQ ID NO: 6982 - DNA, 274 bp, Homo sapiens
  misc_feature 118, 126, 164, 187, 189, 202, 229, 245: n = A,T,C or G
gcaggctcaatgaatcgaatgaatgtgaacttcttcatctgtgaaaaatcttttttttttccattttgttctgtttgggggcttctgttttgtttggcgagagagcgatggctgccgnggggagtnctggggagccctcgcggcaagcagggtgggggggactngggggcatgccgggccctcactntntcgcctgttctgngtctcacatgctttttctttcaaaatngggatccttccatgtngagccagccagagaagatagcgagatcta

SEQ ID NO: 6983 - DNA, 436 bp, Homo sapiens
  misc_feature 160, 166: n = A,T,C or G
gaaccactgtgtcatagggcatgcatacctaaagtattgacatataccactaagttcttttcagaaagggctctgccaattttcagttccaccaacagtaggtatacacatagatggttggtattattagcgagaataaccatcctcacaaactctgatngctagngatttttaaggtattttcttaagtgataagcaaaaaaaatttttttggcaaaaaatattttattaatggttgtgacctctatttccttcgtttttaatgagattaaaatcttttcatatatttattggacttttttcttcaacttctgtaaattgctgttatcttttgttcaattttctattgattgtttttatttttcttattgacttgttttatatatatgtatacacacacacacacacacgtatatgtatataatgattaaaattc

SEQ ID NO: 6984 - DNA, 403 bp, Homo sapiens
ctggatacctaatgtcagtggagtcttctgagtgtttcctggaagaagtcgggtcccaggctctagttgctggttcttacatgccaccatccacagtccttcagcagattgattcagtggctaatgctgatatcataaatgcagcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtg

SEQ ID NO: 6985 - DNA, 102 bp, Homo sapiens
  misc_feature 9: n = A,T,C or G
agaactagnctcgagtttttttttgacgtattttatttacaaatatcatacactgctggtgttaccatatgaaaggaaataaagtcaattgataattgcctc

SEQ ID NO: 6986 - DNA, 394 bp, Homo sapiens
cggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttt

SEQ ID NO: 6987 - DNA, 410 bp, Homo sapiens
tgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgt

SEQ ID NO: 6988 - DNA, 458 bp, Homo sapiens
  misc_feature 56, 214: n = A,T,C or G
tccctgtccttcatgggcctgctggccatgtacacctacttccaggccaagataanggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcangaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactgg

SEQ ID NO: 6989 - DNA, 114 bp, Homo sapiens
gctgagggtgcccaccaagcccaccttccagaaacttggagaaatgggggttgggaacttatgcagacatggatttatttttcaacattttttaaaaattaaaaaaaataaaat

SEQ ID NO: 6990 - DNA, 442 bp, Homo sapiens
  misc_feature 12, 15: n = A,T,C or G
gaaggagtaggnggngggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggggggtgtcattccacacatccacaaatctctgattg

SEQ ID NO: 6991 - DNA, 108 bp, Homo sapiens
aaacaactaacctgccactaatagttatgtcatccctcttattaatcatcatcctagccctaagtctggcctatgagtgactacaaaaaggattagactgaaccgaat

SEQ ID NO: 6992 - DNA, 441 bp, Homo sapiens
  misc_feature 169: n = A,T,C or G
gcaaaggagaaattcagttttcagtagcatcattggaagtattatgacttgtgcttaaacttttaccagtgcattcttttgataaatagaaatagtaacaaaatatgaattttaaatatgtggggagatacataaagaacattgcttatttgttcttgaaaataacagngattcaaatatttcattcagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaac

SEQ ID NO: 6993 - DNA, 444 bp, Homo sapiens
  misc_feature 398: n = A,T,C or G
gcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtgggaaaaggaccaagatggcggccgcaaactgacacctcanggacaaagagatctggacagaatcgccggacaggtggcagctgcca

SEQ ID NO: 6994 - DNA, 225 bp, Homo sapiens
ctcagctcaccgcaacctctgcctcccgggttcaagcaattctgcctcagcctcccgagtagctgggattacaggcatggtggcacacacctgtagtcccagctacttgggaaattgaggcaggaggatcacttgagtcctggaggtcaaggctgcagtaagccgtgatcgtgtcactgaactccagcctgggtgacagagcgagaccctgcctttcaaacaaac

SEQ ID NO: 6995 - DNA, 433 bp, Homo sapiens
  misc_feature 8, 11: n = A,T,C or G
ctcatgtnagntggaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttga

SEQ ID NO: 6996 - DNA, 463 bp, Homo sapiens
  misc_feature 10, 11, 13: n = A,T,C or G
gtcaacttgnngncaggagatgaagttcatacactggacttctgggggttggtctcatttgttttaggacaaaacatattatctatcgtaccaagagttcgatagctatctgctttcaaaggtaaatacatttgatcagaaaactccctgctaaaattgcagtttctaagctgcccttgttatactttttcttcctctgaggatactttaaacactcatttcagattcactaggactgtggctgttctttagcttctactttatgtatttatctaagctcgggtattttcatcttccccataagtagttcatccatagcagaactggccgtgttgctgatggttaatatccttttttgttttccctttaaagtaacacacactgagccctgagtaagagccgggctctgtgataagcactttgcaggtgtgagaacacttcattcttaaaacaactgtaggca

SEQ ID NO: 6997 - DNA, 109 bp, Homo sapiens
  misc_feature 1, 11, 13: n = A,T,C or G
nattaccttcngngtgattacagaagtcctacttgacaatcacatatagaagaacggtgctattcagtaagttctctttcctttcccttggagggaagacagcagagtc

SEQ ID NO: 6998 - DNA, 234 bp, Homo sapiens
catagggccgggctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattt

SEQ ID NO: 6999 - DNA, 212 bp, Homo sapiens
ctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagtttgaaagaccagtagacgctcctctactctttgagacatcactggcctataataaatgggttaatttat

SEQ ID NO: 7000 - DNA, 446 bp, Homo sapiens
gaacatttctgttttaaatttcattttaaaatattttattatctgcaattcaccactgctctgggaaagcaaaaggaaagttcctgttgtgtgtgaagagcctcttaggctataaggcttcccagccatagtcagctatagctattcagagacagcaggttcttccagtctttgttcctgggacctgatgttttgagcaactcaggtcactgataaagtggaaggactaagacactgtggtcacagatcccagcaacatcaactcacactcaatccatgtggtggtccacattctgctactcttatccacccatgtggtcattgagagcctttctcagagactcttctgtgtgtttgattgtgcccaggtggcccagggctagctggctctaacaactagcatgacagcctccaatcagaaaggcaggtaaggggacagggtgagg

SEQ ID NO: 7001 - DNA, 434 bp, Homo sapiens
  misc_feature 9, 11: n = A,T,C or G
actactggntngaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacat

SEQ ID NO: 7002 - DNA, 437 bp, Homo sapiens
ctggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgt

SEQ ID NO: 7003 - DNA, 445 bp, Homo sapiens
  misc_feature 11: n = A,T,C or G
ctcaagttcgnctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggaccttggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgcctcagagcagcgccttccagctgctctcgcaccggctccagtgcgtgcccaaccctgagctgctg

SEQ ID NO: 7004 - DNA, 220 bp, Homo sapiens
caaacatccacaagcatcaagacctcccaggaaaatataagctgaacaaatgaactaaataaggcactagggactaatcctggagaaacagagatatatgaccctttcagacagagaatacagaattgctgttttgaggaaatttaaagaaattcaagacaacccaggagagaaattcagaattctatcatataaatttaacaaaaagattaaaataatt

SEQ ID NO: 7005 - DNA, 343 bp, Homo sapiens
  misc_feature 12, 87, 100, 147, 155, 170, 279, 293, 317, 322: n = A,T,C or G
cagacttgcagnttaagtattggaatttcacaaaagacataggacttaactggaaaatgaaaaaaaaaagaaaaagaaaaaactaancaaaaaatccctntaggtagtttaggtgaaaaatgtcccttttattttggctttggttgngatttcanagcataatgctatgnttttttgtctttttactatgtttttcggatttttaagtccgtaagtgcatacagttttctctaatttttaaaccctttcctcctcccattttgacatttgcacttgganaacacttgagttgngaaggttttgggcatccaccccanaaagngggaatttgattttatccttc

SEQ ID NO: 7006 - DNA, 423 bp, Homo sapiens
  misc_feature 15, 316, 414: n = A,T,C or G
ggaataaggatggtntagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagntctatactgttatctgtgtccatttccaaaacttgcacgtgtccctgaattccatctgactctaattttatgagaattgcagaactctgatggcaatnaatatatgt

SEQ ID NO: 7007 - DNA, 404 bp, Homo sapiens
  misc_feature 3, 4, 5, 159, 162: n = A,T,C or G
tannngaagaggtaacacggatggccaataaatgtgaaatgatgctcaacatcattaagaatcaccaaatgtagttaatcaccaaatagtaatgaattgctatttcatacccacccaccacatcaaaaaaatttttcaagtctgataattacaggtgtnagnaaggatatgaaaccatatgaattcccatttacaacggatggaagcataattggtagaaccatttttgaaaaatagtttgacattatgtagcaaagttaaagataaactctaatcctttgtttttatgcttctaggaatactctcacgcatgtaccagcagaattgttggtaatagaagaaaaacacctgaaaaaacctaaacctaaatgtttgtcatgagtggaatgaataaatattacaat

SEQ ID NO: 7008 - DNA, 414 bp, Homo sapiens
  misc_feature 11, 14: n = A,T,C or G
gtcgtaagggntgnggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttcc

SEQ ID NO: 7009 - DNA, 224 bp, Homo sapiens
  misc_feature 11, 12, 169, 171: n = A,T,C or G
caattctttgnngcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagttngngaagtgattgacattttgtagctagtttaaaattattaaaaattatagactcc

SEQ ID NO: 7010 - DNA, 185 bp, Homo sapiens
gaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaat

SEQ ID NO: 7011 - DNA, 410 bp, Homo sapiens
  misc_feature 8, 13, 14: n = A,T,C or G
ctcacatncaganntattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaat

SEQ ID NO: 7012 - DNA, 436 bp, Homo sapiens
  misc_feature 2, 3, 157: n = A,T,C or G
tnnggcacgagggcgggcgcccctcccccagcctcactgccgccttgcagtttgatctcagactgctgtgctagcaatcagcgagattccgttggcgtaggaccctccgagccaggtgtgggatataatctcgtggtgcgccgttttttaagccggnctggaaagggcaatattcgggtgggagtgacccgattttccaggtgcgtccgtcaccgctttctttgactgggaaagggaactccctgaccccttgcgcttcccaagtgaggcaatgcctcgccctgcttcggctcgcgcacggtgcgcgcacccactggcctgcacccactgtctggcactccctagtgagatgaacccggtacctcagatagaaatgcagaaatcacccgtcttctgcgtcgctcatgctgggagctgtagaccggagctgttccta

SEQ ID NO: 7013 - DNA, 445 bp, Homo sapiens
  misc_feature 11: n = A,T,C or G
gccatcctcgnggctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccc

SEQ ID NO: 7014 - DNA, 231 bp, Homo sapiens
  misc_feature 169, 215: n = A,T,C or G
gaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgnacacaactcactccttttaaagaaaaaaattgaaatgtaaggctgngtaagatttgttttta

SEQ ID NO: 7015 - DNA, 104 bp, Homo sapiens
gtaagggtaaaggagcagaggcaaaggagaaaagcagaagttgcagctgatgcaggtatcctatgcccttgatggatgagactaaaataaaatttttgaagtta

SEQ ID NO: 7016 - DNA, 445 bp, Homo sapiens
ggatgatcgcacagactgtcactgctgttgccgggttgacttcctatccatttgacactgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatggga

SEQ ID NO: 7017 - DNA, 443 bp, Homo sapiens
gtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgac

SEQ ID NO: 7018 - DNA, 443 bp, Homo sapiens
  misc_feature 13, 171: n = A,T,C or G
gccagcagctagncatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgnggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgattggtcagaatgtgtggcaattctgatctgcattttcagaagaggacaatcaattgaaactaagtaggggggtttcttctttttggc

SEQ ID NO: 7019 - DNA, 422 bp, Homo sapiens
  misc_feature 169: n = A,T,C or G
ctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagtnggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccacc

SEQ ID NO: 7020 - DNA, 103 bp, Homo sapiens
gtacctattaagacaaaatacttctaaagatacttatgaaatgtatacatattttttcttgcacgttacaaagaaaatactcaattgcataacacggatgttt

SEQ ID NO: 7021 - DNA, 132 bp, Homo sapiens
gtgactcaagactcgaggccgatacgaggctgtgattctgcctttggatggatgttgctgtacacagatgctacagacttgtactaacacaccgtaatttggcatttgtttaacctcatttataaaagcttc

SEQ ID NO: 7022 - DNA, 391 bp, Homo sapiens
  misc_feature 9, 167: n = A,T,C or G
attgatggnggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgnggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctttc

SEQ ID NO: 7023 - DNA, 179 bp, Homo sapiens
  misc_feature 2: n = A,T,C or G
gngaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctcc

SEQ ID NO: 7024 - DNA, 425 bp, Homo sapiens
  misc_feature 402: n = A,T,C or G
gccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaangactatggcaaggagtctcaagc

SEQ ID NO: 7025 - DNA, 443 bp, Homo sapiens
  misc_feature 10: n = A,T,C or G
acggggaagnggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaaggatttcttagagagacgcctgcagacccaggtcttcaagctgggcttggccaagtccatccaccacgctcgcgtgctgatccgccagcgccatatcagggtccgcaagcaggtg

SEQ ID NO: 7026 - DNA, 442 bp, Homo sapiens
  misc_feature 12, 13: n = A,T,C or G
caagtttttagnngcttatatcctataattgagcacatgatagttacagcagaatttaacaatagatttttcataccttcataattctttgcgaccatgatggggtgtttattatattcccacataaagcttctctccttgtcagtcttatagtctagttcacatattatattacccgtgagtaccacctaatcacattctacactagttatatgtagaataaactgtattctatatgttaagattttaattagtaaattgttggaaataaacctgcttttctcttcaaattgcaggctttctaattaaaaacactttttaggacatacagagtggaatggtagacattggagactccaaaaggtgggagagtagaagaggggcgagggatgagaaattacccactgagtacgatagacactcttcgggtgatggcttcacc

SEQ ID NO: 7027 - DNA, 334 bp, Homo sapiens
  misc_feature 14: n = A,T,C or G
gcgacccagcccgngagcgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagt

SEQ ID NO: 7028 - DNA, 352 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacctggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 7029 - DNA, 448 bp, Homo sapiens
  misc_feature 6, 7, 10, 12, 32, 169, 171, 172: n = A,T,C or G
cagaannccngngaggcccttctcctggcagngcggggagggccccacaggtaacacccatgtagctgccatgctcaggacacgtgtgcccgggcaggccagaacccacacggtgggcagcggggactctgggtgatgggtagcccccattcaattcacggcagctggngnnacagttaaaagacacggaaaactggagcgccggcaccatcattttattataatttaaaatgtaattataaaaggctgatttgaatgtaaatatctctcttaaacacatgaaaggggattctaaatttaagaaccccaaatcagcaggtaaatatttcagctaaatgctcttcctgccatctgaaatgccagaatgaaggaaagggcgttccacggggcgggggggaaaaccgccctggttttagaaagccagaagcatcagggacgattccttcta

SEQ ID NO: 7030 - DNA, 180 bp, Homo sapiens
  misc_feature 13, 15, 170, 172: n = A,T,C or G
gtcttgtttaagngntaggaagttcctgtctcaagtattctggggcaaccaggaagaggagaatattagagtcatttggggcacgtaagtggccaagtactttaaaagtccctttgggggcatttttaaccacctaggctcattggataaatttgttttttttttaaacngngatactat

SEQ ID NO: 7031 - DNA, 439 bp, Homo sapiens
  misc_feature 167, 170: n = A,T,C or G
cggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggnggngctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaa

SEQ ID NO: 7032 - DNA, 444 bp, Homo sapiens
  misc_feature 13: n = A,T,C or G
ctcctgggccggntggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccatctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagga

SEQ ID NO: 7033 - DNA, 327 bp, Homo sapiens
cctacgcacacgaggaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 7034 - DNA, 433 bp, Homo sapiens
tacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaactgtcagtttgagccagatggaagctgagctgaacacattacgatggatgatggaaacataagactatcaagaaatccaagtggtaatgggccgaagtttattcagcat

SEQ ID NO: 7035 - DNA, 122 bp, Homo sapiens
aagagattgagaaaattggtatatcatgcagataacatacaaaatctttttgtaacgtaaaaaatgcagttttattattgcttgtgcctcaactgtttaagtgaatattaaagggcttggag

SEQ ID NO: 7036 - DNA, 302 bp, Homo sapiens
ctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtc

SEQ ID NO: 7037 - DNA, 430 bp, Homo sapiens
atcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagtttttgtgttgcaagaacaaatggaataaacttgaattgtgc

SEQ ID NO: 7038 - DNA, 361 bp, Homo sapiens
gctctaccttcatcccactgctacttatttctcttcgggcttctgtgatataaatctggctgcttcctggctcactctggttttggtttaggactcaagtagatgagttactgcttgcctacccgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatag

SEQ ID NO: 7039 - DNA, 435 bp, Homo sapiens
  misc_feature 434: n = A,T,C or G
ggtaacaggttccaaaaatattatgaaagtagaagtgacacatcttgaaccatttgtatatggtgatcatgatttccacgaagttgtccatgtgtggcactaaaaataaaggaataactacgcaatagaagggctagataattgcaagttcacctttccctatcttgtaattccttcatgtgcataaaatatcactttccagttatataatgatttctcctgttacattatatgttttatgaagaattctgtaagtgaaagtggaaatagtttattcaaattggattaactatcagaagcaaatgtattggtaagttgagaagaatggctataccatagctaggttctaagaaagaacatattatgtatgtttaacaatgtctaccatgtctgtggaagagagaaatacctttttatatcttctacatggttgnt

SEQ ID NO: 7040 - DNA, 427 bp, Homo sapiens
gttttttaagcccattggaaaagggcagtattagggtgggagtgacccgattttccagttgccgtctgtcacccctttctttgactaggaaagggaactccctgaccccttgtgcttcccgaatgaggcaatgccttgccctgcttcagctcacgcacggtgcactgcacccactgtcctgcacccactgtctggcattccctagtgagatgaacccggtacctcagatggaaatgcagaaatcacccatcttctgtgtcgctcatgctgggagctgtagaccggagctgctcctattcggccatcttggctccaccgtatccttgttttaatagaagaaaactgtataatatcaatattgggaatggttaaatactgttttactcattatattgatattatacattcattagaagatgacttaatt

SEQ ID NO: 7041 - DNA, 301 bp, Homo sapiens
caaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttatt

SEQ ID NO: 7042 - DNA, 403 bp, Homo sapiens
cagaggccctggaggtctccaggggcctgcagaaggaaagaagggggccctgctacctgttcttgggcctcaggctctgcacagtcaagcagcccttgctttcggagctcctgtccaaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaaga

SEQ ID NO: 7043 - DNA, 102 bp, Homo sapiens
  misc_feature 47: n = A,T,C or G
ccaaggtcctgggcaggaccggttctcagggacagtgcacgcagggncgcgtggaattcatggacgacacgagccgatccatcatccgcaatgtaaaaggcc

SEQ ID NO: 7044 - DNA, 453 bp, Homo sapiens
  misc_feature 2, 443: n = A,T,C or G
gnaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtantcggtagagc

SEQ ID NO: 7045 - DNA, 132 bp, Homo sapiens
aaaaaatttgtcacaaaaactttgttgtcatagttaagttgattgtagatggtaattgaatatactcctttgaaaatatttcatcaagtatgtttcctgctcattgtgatacattaaaaaaaaaatatgagc

SEQ ID NO: 7046 - DNA, 327 bp, Homo sapiens
gaacattccagtgctggtgttggatgtcaatgatgatttttctgaggaagtaaccaaacaagaagacctcatgagagaggtaaacacctttgtaaagaatctgtaaccaataccatgatgttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgttttt

SEQ ID NO: 7047 - DNA, 445 bp, Homo sapiens
cccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctgtctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtg

SEQ ID NO: 7048 - DNA, 324 bp, Homo sapiens
  misc_feature 28, 40, 75, 121, 174, 218, 272: n = A,T,C or G
ggcacttcctggattttttttttatganaaaaatactgtntttaaaatgtaaaataaacttttaaaaagcaggcnctaatatatatttcttccagcctttgattacaaatttgtccttgcncatgttaagatgaattatctcctaaaaatatcattgttcttgggagcagtgtntgttactttacatagcagcggttcctgtcatgtgttcatgtcanaatatttttggttttaaactttcttattgcctttggctgttgattagtacagtncaagtgcgatttcaaaaagatcttgaaagtaatatatttaatcaattaaaat

SEQ ID NO: 7049 - DNA, 444 bp, Homo sapiens
cgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatggatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatg

SEQ ID NO: 7050 - DNA, 445 bp, Homo sapiens
  misc_feature 82, 91, 121, 130: n = A,T,C or G
aaaaggtaaaagtgaaaccgattatgcacagcgggccttgtgactcttgagtggattttatttttgcactccaggatgcagngaagacggnggaaggttcatcttcacaccgagggccctnagtgtcgangtgactcccggcctgaggagggctgaggcatcctgaattttgagagttcgaggttgaggtctaagaaggtgtacgtgctgtagtcatgatgctgcaggttcttgtaggtagtgttgtcaaacggctcagcaggcactggggctggctctgcggaggaaacacgatgcccatgagaccaacacaaggacagctctttatgaatgactcggctcacacacaggcgcttacctaccaagcattcttcatcatccctatctgtgaacagctctttatgaatgacttggctcacacacaggcgcttacctaccaagcatt

SEQ ID NO: 7051 - DNA, 443 bp, Homo sapiens
accacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccc

SEQ ID NO: 7052 - DNA, 293 bp, Homo sapiens
  misc_feature 290: n = A,T,C or G
aaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcntgt

SEQ ID NO: 7053 - DNA, 385 bp, Homo sapiens
  misc_feature 346: n = A,T,C or G
cctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagggggggggtgccgcccaaccttctcccctccccacccccgcccccgggaccgtgcaggcaccanggttccgtgcacctattatattttttgaaaactggaaga

SEQ ID NO: 7054 - DNA, 314 bp, Homo sapiens
agggccaggcatgggggctcatgcctataatcccagcacttcgggaggccgaggttgggaggattgcttgatgccaggctgaccaatatagcaagatccaatctctactaaaaatttcaaaaacaaaaattaaaaaaattagctggacgtggtagcacgtgcctgtagtctcagctatttctgaggctgaggtgggaggtttgcttgagctcgagagtacttctagagcggccgcgggcccatcgattttccacccgggtggggtaccaggtaagtgtacccaattcgccctatagtgagtcgtattacaatta

SEQ ID NO: 7055 - DNA, 283 bp, Homo sapiens
accaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgc

SEQ ID NO: 7056 - DNA, 400 bp, Homo sapiens
  misc_feature 396: n = A,T,C or G
atttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcangagg

SEQ ID NO: 7057 - DNA, 454 bp, Homo sapiens
ctcactctaattattaagttgactacaattcaatattatcaaccaacacatgaattgcttctttaggacatttgaattttacttctctagtagcaaagcaaaaatgggatccctcaggtacctgatttcagacgtcagcacatagcatgatctttcagggtgtgagtctgaattcatccttttgggataagtggaagtggaaaaacatatgtgcctgtctccccagctacctacctgtgctgcttggaagatgagccaagctcggcactaaggtatattcccatcatcactgcttctgtgggcctgagtcccgctctctcacacctataggtctgtctgacaggcccttgcctgtagactctcatcctacatcccctccagagctcatcttatcccccaaaaatccctttcccttctccccataatcactcctctttcagatgcagacttcatg

SEQ ID NO: 7058 - DNA, 250 bp, Homo sapiens
attttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttc

SEQ ID NO: 7059 - DNA, 393 bp, Homo sapiens
  misc_feature 386: n = A,T,C or G
cctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattntaatatt

SEQ ID NO: 7060 - DNA, 362 bp, Homo sapiens
tataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggt

SEQ ID NO: 7061 - DNA, 351 bp, Homo sapiens
gaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctg

SEQ ID NO: 7062 - DNA, 443 bp, Homo sapiens
aaatgtttgaaatttcctagagacttggagggttcagaagacaggaaaatgtgtgaaagtttagaacttcctagagacttgttgaatggctttgaccaaaatgctgatagtatggacaataaagtccaggctgaggtggtctcaagaggagatgaggcacttgttggaaactgaagaaaagtaactcttattatgcttagcaaagagactggttgcattttgcccttgccctagagatctgtggaactttgaaattgagagagatgatttagggtatctggtggaaaaaaatgtctaagtggcaaagtgttcaaaagaaagcagagcataaaaactttgaaaaatttgcaacctgatgatgcaatagaaaagaaaaacccattttctgggaagaaactcaagcaagctgcagaaatttgcataagtaatgaggggccaaaggc

SEQ ID NO: 7063 - DNA, 444 bp, Homo sapiens
tggggttctaaaatttccctaggaagtatggccaaatgagaaaaatcagactccaaattctccagttatgggcctgctgtagtggcttatacctgtaatcccagcactttgagaggcagaggtgggaggattgcatgagccaaggagtttgagaccagcctgggcaacctaatgagactacatctctacaaaaaaaaataatccaaaaattagcctggcatggtggcgctcgcctgtagtcccagctacttgggaggctgaagtgggatgatcacttatgtccacaaaaagagtcaaactctgtaaaatatttgaaaagatttattctgaaccaaatgtgagtgaccgtggtgtgtgacacagccctcaggagaccctgaaaacgtgcctaaggtggtcggggcacagcctagttttataccgtttaggaagacatgaggcaat

SEQ ID NO: 7064 - DNA, 395 bp, Homo sapiens
ctcgtgccgctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattat

SEQ ID NO: 7065 - DNA, 350 bp, Homo sapiens
  misc_feature 139, 153: n = A,T,C or G
cctggccccattgggcctcctggtccccgtggacgatcaggcgaaaccggccctgctggtcctcctggaaatcctggaccccctggtcctccaggtccccctggccctggcatcgacatgtccgcctttgctggcttangcccgagagagaanggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggaga

SEQ ID NO: 7066 - DNA, 291 bp, Homo sapiens
ctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctcccctttcatactaataat

SEQ ID NO: 7067 - DNA, 448 bp, Homo sapiens
  misc_feature 100: n = A,T,C or G
gcagcacggtgccagtcatctgcatgtgctcctgcggcgtgggggtttgtagacttggaaaaccctgttggcagaaagttaagagctcccaggcctgaangcaggacacagtgccagcagggggccgtttgcccccatgtgtaagggaggcagggcccagctctcccacggcgaggtgagctgagactttctgagaacagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggt

SEQ ID NO: 7068 - DNA, 444 bp, Homo sapiens
  misc_feature 264: n = A,T,C or G
ccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagantggagactacttggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatg

SEQ ID NO: 7069 - DNA, 443 bp, Homo sapiens
acgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaagg

SEQ ID NO: 7070 - DNA, 275 bp, Homo sapiens
ctcagaggctcactcagtaacgttgtttaattctctgccctggggaaggaggatggattgagagaatgtctttctcctctcctaagtctttgctttccctgatttcttgatttcatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtga

SEQ ID NO: 7071 - DNA, 413 bp, Homo sapiens
ggcttttagcttatgtcttagagtatttgcctactgatcttggactaagaaaaatgtgattaattattgtgttaacactttgctgtgatcaaagttctcaattgccaaaagattatctgcttttggaaaaataggtacgtctgttaacttccagtgatgtgactcattaaatgtgcaccttctcttcattcactgagttctgattggctcatattacaacttgaaaatttttatctaaggaaacctgccttatatggaaaatcaatgagcaatagtacccatgaggtgaacttttcacttaagccaaaagttgtatatgtaataaatctcaattttgccaatttaccattgtttacttgtaactatgatgctgacccataaacaaacatttcattgaccatttaatataacta

SEQ ID NO: 7072 - DNA, 443 bp, Homo sapiens
atgattcaaagaggcaaggccagagctcccaaccaggcttcttgtttctaaaatctgccaatcaatataactctgaaatattgaaatacggccccaaccccaaccccaccccactgctgttgtaggggagaaaagcagtgtattttccttacccattgcaaggttcatggctgagaccccgtaacaaaagacagattaacaatagaaaagtgcttttagaaaaagcccaatgtagaaaaaggtccctattgccctttatacactggtcacccactggactcggctctgtggacctggggccacttcttgttcagctgccgatgcaggagtggcgtcagaggatgtgctttctaccttggaccccacacgcaatggaaaacactgccacctctttgtggaaagttgttgcaggttggcttccctgggaagcagactctgagagg

SEQ ID NO: 7073 - DNA, 438 bp, Homo sapiens
  misc_feature 396: n = A,T,C or G
ggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagaatgcagggccacctgaagcgggcctccaacgagagcacccgccagaggctgcagcagcagctgacccangcccaagagaccctgaagagcctgggtgccctgaagaagtga

SEQ ID NO: 7074 - DNA, 456 bp, Homo sapiens
cagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagacttt

SEQ ID NO: 7075 - DNA, 421 bp, Homo sapiens
gatcctggcccggggggaaaacttggaacatctccgcaataagacagaggatctggaagccacatctgagcacttcaagacgacatcgcagaaggtggctcggaaattctggtggaagaacgtgaagatgattgtccttatctgcgtgattgtttttatcatcatcctcttcattgtgctctttgccactggtgccttctcttaagtaacagggaacctctcccacctgcccttcttttcagggacaaccctccataaatgtgtgccaagagggtctcctttcctgtcttcctctacagagaatgctgctcggtcctcctacccctcttcccgaggccctgctgccacgttgtatgccccagaaggtaccttggtcccccggaaggagagaaaaaagagagatgggcctgtggctgcattt

SEQ ID NO: 7076 - DNA, 495 bp, Homo sapiens
  misc_feature 2, 3, 51, 53, 68, 76, 93, 104, 109, 332, 367, 374, 383, 410: n = A,T,C or G
gnngctcgcgcgcctccaggtcgacactagtggatccaaagtaattgggcncnaggtttttggcttgnacgactgnggctcttcctcagtgcngcggaagcggngcggnggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccganctgctcatccggaagctgcccttccagaggttggngaggganatcgcgcangatttcaaaaccgacctgaggtttcanagcgcagccatcggtgcgctgcaggaggctagcgaagcgtacctggtgggtctgttcgaagataccaacctgtgtgccatccacg

SEQ ID NO: 7077 - DNA, 444 bp, Homo sapiens
  misc_feature 326, 377: n = A,T,C or G
gtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcangatttcaaaaccgacctgaggtttcagagcgcagccatcggtgcgctgcangaggctagcgaagcgtacctggtgggtctgttcgaagataccaacctgtgtgccatccacgctaaga

SEQ ID NO: 7078 - DNA, 442 bp, Homo sapiens
  misc_feature 15, 214: n = A,T,C or G
caacatggtgttcangcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccanaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtact

SEQ ID NO: 7079 - DNA, 440 bp, Homo sapiens
cattttcttgtctaagtcagttatgtgattctgttccccttgccagtgattggtgtgaggtgggcatgtgacacaatgatggccagttagatagaaatggaagttcattggggggtgtataagtccgttctcatgctgctataaagaaatacccaagactgggtaatttataaagaaaagaggcttaactgactgacatttccttatggctgaggaggcctcaggaaacttttaatcacagcagaaggcacctttccacagggcggcaggaaggagaatgagtgccagcaagggaaatgccagacgcttataaaaccatcagatctcatgagactcactcattatcacgagaatagcatgggggaaactgcccccttgttccagttacctccacctggtcccacccttaacacatggggattattaccattcaaggtgat

SEQ ID NO: 7080 - DNA, 262 bp, Homo sapiens
catttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtg

SEQ ID NO: 7081 - DNA, 443 bp, Homo sapiens
gttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcac

SEQ ID NO: 7082 - DNA, 305 bp, Homo sapiens
  misc_feature 30, 32, 42, 270: n = A,T,C or G
ctttagtgtgctatacctatgagtcttatngngggccactgngccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtatnggtttccttcttcaccttgaacttttgttgaactg

SEQ ID NO: 7083 - DNA, 428 bp, Homo sapiens
atttattttaagttaactgcttaaggattgtagacaagttctccctagaacaatgttaaaccttttgatttccaggccagctcaaaacatgcatggagcatgcaaagctattgtgagtctttgggaatattttttcagagttgtgtcttgggtagatcaagacccatttgactcttccttttacttttctgcctgcctgctaggcgctgaagatggtcctgatggttctgatggccctctagctaccaacagaaggttttgaagatcggggtgaacttactgctttttattacttggtttttctaccattcctagcctaaactgtttaggaatttggcaactgaacttaaaatgtttacagatcttgtgaaggctctttcagtgatgtgattaatctcttagccttttgttattctttaaaaagaaag

SEQ ID NO: 7084 - DNA, 416 bp, Homo sapiens
gctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactga

SEQ ID NO: 7085 - DNA, 440 bp, Homo sapiens
caacttgaaattttaggaaataagtagtaatgcagcatagtgttttaggagtacagctcaagctccaccatttgctagatttgtaaactcagacattgcctgatcttatgccttagttgtgttatttgtaaagatagtagttcctagttcattgagattgttgtaaggattataatgagctgagaggcataacagtctgtacacaaaacctgtgacatagcaaatgctcaagagctgtaattaattacttacagagcataagtggattgagttgaatgaagtgggaaaaattggcaaatttggtccctttcattaccccttggttcctattgacttctcggcagcacatgtgctctatacaaaatggggagagtgaacaacactgggaacttgattaaaaggttttagaggtactccactatcatttgagtcatcctgtg

SEQ ID NO: 7086 - DNA, 445 bp, Homo sapiens
  misc_feature 231: n = A,T,C or G
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctangactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtg

SEQ ID NO: 7087 - DNA, 421 bp, Homo sapiens
gtgctaccacacctggctttttgttgttgttgttgttaaagctagggtctcgttatgttgcccaggctggtcttgaactcctaggcttggcaaaatattgggattacaggcatgaacaaccgaacctggcctgtgataggtttttatatttctaaaaaaacactgttgggatgttaataggattgcattgcctctgatgaccactttgggtagtactgacatgtgaacaatattaaactttccaacacaggatgtctttccatttaattgtgtctttaaatggatataattgaacacaggatgtctttccatttaattatgtcttctttaatttctttcaacaatattttgtagttttctgtgtacaagtctttcacctccttggttaattcctatgtattttattctttttgatgctatt

SEQ ID NO: 7088 - DNA, 471 bp, Homo sapiens
  misc_feature 414: n = A,T,C or G
gttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgttttggcatctaccctggttcacctgggtgaatatcangcagctgttgatggggctaggaaagctaacagtactcgaacatggaaagaggtctgc

SEQ ID NO: 7089 - DNA, 258 bp, Homo sapiens
cactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttg

SEQ ID NO: 7090 - DNA, 290 bp, Homo sapiens
gcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatata

SEQ ID NO: 7091 - DNA, 250 bp, Homo sapiens
tattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttgggagaaggcgcaatactctccagctccaccgttaccgctaatataagtaaagtttgtaaaattcatacttaataaacaatttag

SEQ ID NO: 7092 - DNA, 460 bp, Homo sapiens
  misc_feature 6, 59, 135, 201, 216, 333, 420, 430, 459: n = A,T,C or G
caattntcatttaattacccatgcacttatgcatggcctttgcattcattcctgcattngcatgctttcttagagctggttttccttctatttgaaaatgcctttagcatctctttcactgaaggctgactaagncaaagtctttctgggtggtttttcaaaaatactattatttagtcttcatgtttaaagaatatattnatctatatatagaantctaggtccttgggttctcttcatcttaaacacatcactccattggcttctgaatgtcattatttctgttcaaaagtcaactttaatcttattggtgctttcttttacgttaattgncattttcctctttttagcaagtccgttatgatatacccaggtgtgatttcctttacggctggacatcatatcacttcttgaatctgnggcttgatgntgctcactagctttggaaaattctctgtnt

SEQ ID NO: 7093 - DNA, 441 bp, Homo sapiens
ggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttc

SEQ ID NO: 7094 - DNA, 420 bp, Homo sapiens
  misc_feature 362: n = A,T,C or G
gtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtgggttgtagctgatgagttattacctcatagagactataatattctatttggtattatattattttggatgtttgctgttcttcaaacatttaaatcaagctttggactaattatgctaatttggngagttctgatcacttttgagctctgaagctttgaatcattcagtggtgggagatggcc

SEQ ID NO: 7095 - DNA, 410 bp, Homo sapiens
  misc_feature 298, 301: n = A,T,C or G
ggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggctgggaggggcctgaatgtgggtgnaanacgggccgagtcatgctcggggagaccaaccctgcagactccaagcctgggaccatccgtggagacttctgcatacaagttggcaggaacattatacatggcagtgatt

SEQ ID NO: 7096 - DNA, 406 bp, Homo sapiens
cgcttgtgctgcagccatgtctctagtgatccctgaaaagttccagcatattttgcgagtactcaacaccaacatcgatgggcggcggaaaatagcctttgccatcactgccattaaggggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcg

SEQ ID NO: 7097 - DNA, 382 bp, Homo sapiens
tatctcccctggccaagtaagaaaaagtgacagcaacaggtcccagagaatctgtctctatctggatgcatcagatgccagagcagaaaagcctgcaccagacgccaccagcctggagtccctggggggcgtcccctcctgtcccgagaagatacactggtgactccctgcttactaggctggggttgcacattgtcttaatttactgtacaagcagcacccacgttggttcttatttgcatggtgaacactgagctggggcagtaaagaaagggtcacattttacaacagagctgggagcattctccttgcagtgagaaacggctgaaaataggcttagccaggaagatgggactcaagtaccagggaattaagggagatg

SEQ ID NO: 7098 - DNA, 401 bp, Homo sapiens
gtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggac

SEQ ID NO: 7099 - DNA, 409 bp, Homo sapiens
aaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccac

SEQ ID NO: 7100 - DNA, 455 bp, Homo sapiens
ctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaac

SEQ ID NO: 7101 - DNA, 355 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacctggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttcttggttttaaaaaatac

SEQ ID NO: 7102 - DNA, 421 bp, Homo sapiens
  misc_feature 392: n = A,T,C or G
cccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatttgtggaanatgtttaaattaaattgtgaaaaaaatga

SEQ ID NO: 7103 - DNA, 377 bp, Homo sapiens
taatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatggtagattttcctcccatgaacatgagtaaataaatctgtttcctg

SEQ ID NO: 7104 - DNA, 441 bp, Homo sapiens
cgccgatagagggacggccaagaatgtacgtccagcctgccccggagctggaggatcccctccaagcctaaaaggttgttaatagtttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattggagtttttacaagatgtatttgttgtagacttaacacttcttacgcaatgcttctagagttttatagcctggactgctacctttcaaagcttggagggaagccg

SEQ ID NO: 7105 - DNA, 422 bp, Homo sapiens
cctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtggggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacgaagcagctgacagaaatgctacccagcatcttaaaccagcttggtgcggatag

SEQ ID NO: 7106 - DNA, 401 bp, Homo sapiens
  misc_feature 280, 319, 346, 349, 373, 384, 399: n = A,T,C or G
gccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccanagaaggtcacatggatgaggagaatgaggattttgcgcncggctgctcagaagataccgcgaatcnaanaagatcgatcgccacatgtatccncagccctggtncctgaaaggtgaaangg

SEQ ID NO: 7107 - DNA, 439 bp, Homo sapiens
ctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatag

SEQ ID NO: 7108 - DNA, 390 bp, Homo sapiens
gtctcgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcat

SEQ ID NO: 7109 - DNA, 137 bp, Homo sapiens
  misc_feature 113, 135: n = A,T,C or G
gtttacaacataatctagtttacagaaaaatcttgtgctagaatactttttaaaaggtattttgaataccattaaaactgcttttttttttccagcaagtatccaaccaactnggttctgcttcaataaatcttngg

SEQ ID NO: 7110 - DNA, 439 bp, Homo sapiens
gtgccggatccagacacctgacctagaatgcctgcccgctatccctgtggcaggaaatatcccctcatgtcccagggaattgcagatgggtcttctatacccttctacctgcccttagatctccatttttatcaaatagtacattggcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttat

SEQ ID NO: 7111 - DNA, 438 bp, Homo sapiens
  misc_feature 407: n = A,T,C or G
ctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcnttttccttttggattataaaaatatggggga

SEQ ID NO: 7112 - DNA, 401 bp, Homo sapiens
ggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcatt

SEQ ID NO: 7113 - DNA, 439 bp, Homo sapiens
gctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgaca

SEQ ID NO: 7114 - DNA, 437 bp, Homo sapiens
gtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgt

SEQ ID NO: 7115 - DNA, 439 bp, Homo sapiens
ctcgtgccgctcccttcttcatggaatatttgcacttttcctcagacaaaaagcttaaacttttgtaagaggataaaaatttgagacagaatttaaagtcattaaggcttaattcatgtgtacccagatacctggaacctaccagatgataaggtgatgatgagcagagccttctagaggtctcatgtgaccctgaaacctggcaattcaggggattcatgcactccctgtgcatgagaaatgtcttctggtttctcctcatccattacgggagtgaaattttaacttggcttgtacacaggttgcttatttggctggtgggttcagatattggagtttcccctcaacagagactaaggaacagacctgtgagataaaagccagagagagaaaaaagagctaaagttaacaggtaacattgcccctacagtgggagctt

SEQ ID NO: 7116 - DNA, 438 bp, Homo sapiens
  misc_feature 273, 382, 414: n = A,T,C or G
ctgagtttcgcacttgattttcaatattttatagtaagaaatgacaaactgctttggttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattantaatattctaggtacctcacaaaatgtattatggtgccatggctgttagtttttagtgagtgctgtaggattaattcgaaaataggcagaattccattcctcccaaggnggcaaaaattagctatactgatgtaattgtcntttacctgggtatgaattccctga

SEQ ID NO: 7117 - DNA, 144 bp, Homo sapiens
gttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttc

SEQ ID NO: 7118 - DNA, 340 bp, Homo sapiens
gtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaat

SEQ ID NO: 7119 - DNA, 130 bp, Homo sapiens
cggccatcgtgatcgccgccctgctggccacctgcgtggtgctggcgctcgtggtcgtcgcgctgagaaagttttctgcctcctgaagcgaataaaggggccgcgcccggccgcggcgcgactcggctgc

SEQ ID NO: 7120 - DNA, 437 bp, Homo sapiens
gctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgcccc

SEQ ID NO: 7121 - DNA, 223 bp, Homo sapiens
  misc_feature 205: n = A,T,C or G
gtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcanccaacttttcccatcttg

SEQ ID NO: 7122 - DNA, 384 bp, Homo sapiens
gtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaat

SEQ ID NO: 7123 - DNA, 438 bp, Homo sapiens
  misc_feature 424: n = A,T,C or G
ccgatacctcccaaaccgattccttcaactcaaacccagccaaatcatcctgactgcatacctgcctgcccaccttctgctcatcatcttactagaatgctgcaaatgaatggggcttcaataggccaaaaaccagacccattctctacccccactccaagctaatcatggccgcagtgaattgcaccatcagaaaattagaagtgatgctcttgaatccatgtgtcctggcctttatcttgctgatttcactgcctgatgctctccaattcattcactgttttcccaccagtcttctccagattatttgcacctcttgcctggatactcatgactccctcctaactgctttcacccccttctttctggtcctcccctcccctcactccaaattcttatcccaagcaatcttgtcacataaacntgttggatatgtca

SEQ ID NO: 7124 - DNA, 439 bp, Homo sapiens
atgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcagggagtttaagaccagcctgaccaacatggagaaacctcgtctctactaaaaatacaaaaattagccaggcatggtggcacacgcctatagtcccag

SEQ ID NO: 7125 - DNA, 439 bp, Homo sapiens
cttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 7126 - DNA, 439 bp, Homo sapiens
gccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatg

SEQ ID NO: 7127 - DNA, 109 bp, Homo sapiens
tacttctagagcggccgcgggcccatcgattttccacccgggtggggtaccaggtaagtgtacccaattcgccctatagtgagtcgtattacaattccactggccgtca

SEQ ID NO: 7128 - DNA, 435 bp, Homo sapiens
gccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccag

SEQ ID NO: 7129 - DNA, 437 bp, Homo sapiens
atgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatt

SEQ ID NO: 7130 - DNA, 439 bp, Homo sapiens
caaagctttcaaccagtcctcaaaccttattgaacaaagtaattcatactggagagaaaccctacaaatgtgaagattgtggcaaagcctctaacccgtcctgaattcttactaaacataagaacattcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagt

SEQ ID NO: 7131 - DNA, 403 bp, Homo sapiens
gttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaac

SEQ ID NO: 7132 - DNA, 302 bp, Homo sapiens
tggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatt

SEQ ID NO: 7133 - DNA, 428 bp, Homo sapiens
ctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcc

SEQ ID NO: 7134 - DNA, 428 bp, Homo sapiens
gcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtg

SEQ ID NO: 7135 - DNA, 329 bp, Homo sapiens
  misc_feature 239, 241, 307, 310: n = A,T,C or G
gacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggcgaggtgggaaggattgcttgangncaggagttcaagaccagcctggggcaacacagcaagatcctgtctttgtaaaaaactaaccaaacnggnaaactggggaaatttctgc

SEQ ID NO: 7136 - DNA, 266 bp, Homo sapiens
atttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccg

SEQ ID NO: 7137 - DNA, 438 bp, Homo sapiens
ctaacttcggattacctcaaggaagtggatgtttttgtttccatgggataccacaaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtgggggcca

SEQ ID NO: 7138 - DNA, 348 bp, Homo sapiens
ccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggt

SEQ ID NO: 7139 - DNA, 402 bp, Homo sapiens
  misc_feature 401: n = A,T,C or G
acgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaaggaaang

SEQ ID NO: 7140 - DNA, 439 bp, Homo sapiens
aatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgcta

SEQ ID NO: 7141 - DNA, 392 bp, Homo sapiens
ataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggct

SEQ ID NO: 7142 - DNA, 188 bp, Homo sapiens
ccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 7143 - DNA, 437 bp, Homo sapiens
gcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggcc

SEQ ID NO: 7144 - DNA, 437 bp, Homo sapiens
cgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaaga

SEQ ID NO: 7145 - DNA, 310 bp, Homo sapiens
ggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaat

SEQ ID NO: 7146 - DNA, 397 bp, Homo sapiens
cccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtaggg

SEQ ID NO: 7147 - DNA, 182 bp, Homo sapiens
  misc_feature 112, 154, 162: n = A,T,C or G
tcaacccctactttcctggccaggccattgccatggcccctcccatctacacagatgtcttagagtttgacgatggcaccccagctaccatgtcccagatagccaaggatgngtgcaccttcctgcgctgggcatctgagccagagcaggaccntcgaaaangcatggggctctagatgttg

SEQ ID NO: 7148 - DNA, 430 bp, Homo sapiens
ctctcttctagtgacagtacccttttcacttgaggaaaacctccctcctcaattccaattctggtagggctgcctatcacatggccccactggtccaggccagatggctgggagtatgctacatgactgattagccacagtggttcctacctctggctatagctattggtcctagcactggaccaatctcagagcattagtctaaacccagctcagattttgtacttggatgctaggagacagaggatttttttgttttgattattgaattgtgatgatgtaatctaaagctgtttatagccaaaccagcccccatcctaggttctctcctaacatttgcaggaagttatcgatagtgagaaagaagatcactaacatatcaagagaagtacaggtgaaaagttggtgagctagagatgaagagaagata

SEQ ID NO: 7149 - DNA, 438 bp, Homo sapiens
gatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatca

SEQ ID NO: 7150 - DNA, 439 bp, Homo sapiens
tgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttata

SEQ ID NO: 7151 - DNA, 232 bp, Homo sapiens
gtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatt

SEQ ID NO: 7152 - DNA, 235 bp, Homo sapiens
ccaatgcagaccctagtataccgcctccacccagagctcctgcccctgcgccccctgggaccgtcacccaggtggatgttagaagtcgagtggcagcctggtctgcatgggcagccgaccaaggggactgtgagtcttcctagaattaatacttattgaacacttactttgggttgggacatagttcttgctttcaaattctgatgctgatttcagaactgaagcttgaggttag

SEQ ID NO: 7153 - DNA, 106 bp, Homo sapiens
  misc_feature 2: n = A,T,C or G
gngctagtggttaatagtaacgtgtcaatattggttcatcagttgtatcaaatgtaccacactgatgccagatgttaataatcggggaaactgtgtgtgctgaaga

SEQ ID NO: 7154 - DNA, 116 bp, Homo sapiens
tcgagagtacttctagagcggccgcgggcccatcgattttccacccgggtggggtaccaggtaagtgtacccaattcgccctatagtgagtcgtattacaattgcactggccgtca

SEQ ID NO: 7155 - DNA, 324 bp, Homo sapiens
gtgcaatcaaaacgaggaagagaaggaaaagaagtgtttaaaaaaccaccatgggggttcagagctgcaatccgagttccgagccgcagaatcctggagcgctgcgggctcggctcgccggagtgtgcggcaaaggtgggagcgcgcgccggctcccccgggagggagatggacaagcgagagcgagtgtgtatgcgcgcgtgtgtctgttggtgtgagctcgagagtacttctagagcggccgcgggcccatcgattttccacccgggtggggtaccaggtaagtgtacccaattcgccctatagtgagtcgtattacaattc

SEQ ID NO: 7156 - DNA, 304 bp, Homo sapiens
cccgtgccccacactttcctcctccccactgcagtgagtcaatagtccagggtggggcctggcctccctgccctgattggggactcaggaaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagc

SEQ ID NO: 7157 - DNA, 216 bp, Homo sapiens
gcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattc

SEQ ID NO: 7158 - DNA, 111 bp, Homo sapiens
agtacttctagagcggccgcgggcccatcgattttccacccgggtggggtaccaggtaagtgtacccaattcgccctatagtgagtcgtattacaattccactggccgtca

SEQ ID NO: 7159 - DNA, 299 bp, Homo sapiens
  misc_feature 3, 4, 11, 16, 18, 20: n = A,T,C or G
ccnncctgggngacanancnagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgc

SEQ ID NO: 7160 - DNA, 418 bp, Homo sapiens
gacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatccc

SEQ ID NO: 7161 - DNA, 255 bp, Homo sapiens
  misc_feature 231, 237, 253: n = A,T,C or G
tcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaactnggttcngcttcaataaatcttngg

SEQ ID NO: 7162 - DNA, 218 bp, Homo sapiens
gagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgt

SEQ ID NO: 7163 - DNA, 458 bp, Homo sapiens
cacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaaca

SEQ ID NO: 7164 - DNA, 457 bp, Homo sapiens
ggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagag

SEQ ID NO: 7165 - DNA, 455 bp, Homo sapiens
cgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtg

SEQ ID NO: 7166 - DNA, 439 bp, Homo sapiens
gtgaactctgctagggactaagtactttgttagaaaggtgctcataatagaatggcgtgaacgcgggagacggagctttcagtgagccgagagcgagactccgtctcaaaacaaacaaacaaacaaacaaacaaaaataaaatagaaaggtgctcataataaaatgagaaataaaaaaaattctaactgatcaaatgggacaaaacccagattcacggtctttatatgcaaataaagtatagattcttagattcagaacagtaaaagaaaaatacctagaaaacaataaacaaaaggcatgaacaggcatttcacaaaagagctactgcaaagtcacaaacatattaaaagttactcatcctaactaacaatcaaataaatgtaaattagagcaagcaaacttgtttttccatttatgaacttgccaaagatttaaaag

SEQ ID NO: 7167 - DNA, 186 bp, Homo sapiens
gggaagagatcaaggtaataggaagaggggttagccagtctttttgtacaggtgccgtgtgacacttccacatcgcgggagcaggacccgtgctgtaccgaagcgcacttatacaaatgagtgggcaatacaaagtctgaatatgaaaataagatttcctctgaaaacacatttttggcacagatt

SEQ ID NO: 7168 - DNA, 443 bp, Homo sapiens
  misc_feature 208, 358, 442: n = A,T,C or G
gaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacngtgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcantttgggaaccagaccctgcatgtgtccaccgtgcagatgtggctactgctgtatctcaacgacctgaaggcggtctctgtggana

SEQ ID NO: 7169 - DNA, 128 bp, Homo sapiens
cggttgtcaactcagctgaagaacacaatcaccgatgctgtcctgttgttttttaggggattgctattaacattttattttttgagacagtctcgctctctcactccagcctgggcgacagagcaaga

SEQ ID NO: 7170 - DNA, 438 bp, Homo sapiens
ctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatg

SEQ ID NO: 7171 - DNA, 120 bp, Homo sapiens
cgtgatgaaaatggggagcttcggttattgtcatccattgtggaagagctgctggatcagtgcctggcaccagacacttctggggatggtacagggggtgacaacatgacctgcatcatc

SEQ ID NO: 7172 - DNA, 108 bp, Homo sapiens
tacttctagagcggccgcgggcccatcgattttccacccgggtggggtaccaggtaagtgtacccaattcgccctatagtgagtcgtattacaattcactggccgtca

SEQ ID NO: 7173 - DNA, 439 bp, Homo sapiens
aaaaaagatttagtagaatctgaaatctggagttcagttttcctggaaattttccttatatggaaccacagagagaaataagaagtaaacacataagatggaaccatttcagaacaccttcgtacatgcattaaagctcatgcactccactcactaagcgctctaagtgcactaaagctcatgcatttctttcatttgtgtttaaacttaacaaaaaatacagttcaaacaagtttcaatattaggtttcctatcaaattagaatggttttatggcaatctaaacacaaggtgatgagctcttagagacaagctcatttgacaatagtgagaagtgacagtagcagcttagtggtcaaggagggaacaggaaagctttaaaagccgactcaaccaaatcacactagccgatttgtgtagggtgatttgaaacagcttta

SEQ ID NO: 7174 - DNA, 439 bp, Homo sapiens
gatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaaatgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaagg

SEQ ID NO: 7175 - DNA, 432 bp, Homo sapiens
  misc_feature 320, 408: n = A,T,C or G
ggtgcagccagtttgcataaacaagagaacagcaggtgcagccggttctaggcaagatcaggcagcatgcaggccacatcctcatgcctgtgataaaaagacaagaagtttccacttcagcctctgcttgaccatgagctaagcctccacttcagcctctgattggtcacaggccaatccttcacaggctgtagccaattggaggcttctaaagggtacctaggggtgttgccaagttcttttggctttataaaaaccctaattagggccgggcgcagtggctcacacctgtaatcccagcactttggaggccaaggcangtggatcactcgaggtcaggagtttgaaaccagcctggccaacacagcaaaacccccatctctgctattaaaaaaatacaaaaattantcaggcatggtggccccgcacctg

SEQ ID NO: 7176 - DNA, 216 bp, Homo sapiens
gtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgc

SEQ ID NO: 7177 - DNA, 436 bp, Homo sapiens
cctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtct

SEQ ID NO: 7178 - DNA, 435 bp, Homo sapiens
ctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaattgtggatttgtgctcttgtatttttaagtggatt

SEQ ID NO: 7179 - DNA, 439 bp, Homo sapiens
cttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttt

SEQ ID NO: 7180 - DNA, 214 bp, Homo sapiens
gcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaactta

SEQ ID NO: 7181 - DNA, 409 bp, Homo sapiens
  misc_feature 159: n = A,T,C or G
taacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcanagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctg

SEQ ID NO: 7182 - DNA, 194 bp, Homo sapiens
gccgtcagcatttggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaagga

SEQ ID NO: 7183 - DNA, 394 bp, Homo sapiens
aagtcggaatccggaagaagatccgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctgg

SEQ ID NO: 7184 - DNA, 191 bp, Homo sapiens
cgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcat

SEQ ID NO: 7185 - DNA, 265 bp, Homo sapiens
gttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttc

SEQ ID NO: 7186 - DNA, 439 bp, Homo sapiens
acaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtg

SEQ ID NO: 7187 - DNA, 439 bp, Homo sapiens
cgatggccgggatcctggagcactcggtcatgtacccggtggactcggtgaagacacgaatgcagagtttgagtccagatcccaaagcccagtacacaagtgtctacggagccctcaagaaaatcatgcggaccgaaggcttctggaggcccttgcgaggcgtcaacgtcatgatcatgggtgcagggccagcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacac

SEQ ID NO: 7188 - DNA, 380 bp, Homo sapiens
ctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggagggagataagaagagaaagggccaagtgatccagttctaagtgtcatcttttattatgaagacaataaaatctttgagtttatgttc

SEQ ID NO: 7189 - DNA, 417 bp, Homo sapiens
gtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatg

SEQ ID NO: 7190 - DNA, 436 bp, Homo sapiens
cttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggattttagagggaaagatcattgtagatgaactgaagcaagaagttatcagtaccagcagcaaggcagaaccaccccagtgcacctccctggcctggtctgctgatggccaga

SEQ ID NO: 7191 - DNA, 358 bp, Homo sapiens
aattaatgcccctctcttacagaacactcctatttgtacctcaacaaatgcaaattttccccgtttgccctacgccccttttggtacacctggaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttat

SEQ ID NO: 7192 - DNA, 439 bp, Homo sapiens
tcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacag

SEQ ID NO: 7193 - DNA, 437 bp, Homo sapiens
ggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcagg

SEQ ID NO: 7194 - DNA, 311 bp, Homo sapiens
  misc_feature 115, 166, 222, 233, 278, 301, 307: n = A,T,C or G
cggcagagaggatcacagagttctgccaccgcttcctggagggcaaaatcaagccccacctgatgagccaggagctgccggaggactgggacaagcagcctgtcaaggtgcttgntgggaagaactttgaagacgtggcttttgatgagaaaaaaaacgtctttgnggagctctatgccccatggtgtggtcactgcaaacagttggctcccatttgggatnaactgggaganacgtacaaggaccatgagaacatcgtcatcgccaagatggactcnactgccaacgaggtggaggccgncaaagngcac

SEQ ID NO: 7195 - DNA, 438 bp, Homo sapiens
ctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcc

SEQ ID NO: 7196 - DNA, 439 bp, Homo sapiens
  misc_feature 19, 71, 115, 222, 234, 323, 365, 423, 430, 432: n = A,T,C or G
gaaaaaaaaaagatttgcnccatcatatccgagtctttactaataaaatgaggctgcttaagtacccaagnggagcaagggaagagttactacagttactgtaagtctgagttanaaaaaatacagagcatctagttattgagcaaagcccccttttacctgttcgcttattcaaagagaaacaatagaatttgcttctcagtacatgtttttaaaattganaatctctgatgngacaaaatcaatttttacaaaagttgaattaaaaacttttaaaaattgcttgtctttgggggtatgtctacatattcgtttaaatttanaaattcccacatgtttaagatatatgcccatcccctttttanagtaatcaaaatttctatcacagttcacatactggaatacatagtaaaattgagatgngtccaananattttca

SEQ ID NO: 7197 - DNA, 437 bp, Homo sapiens
  misc_feature 374: n = A,T,C or G
caacaatgataagttatttcatctagttaacacatatataaatgtatctttttataatttagctagccacagtaagacaaatattaagataatcaatgtctctatggatacttttcacatgatttaaactcacatcaatataaacaatatttctaaataaggaagccatcctctactctcttccgtgtgaccacagtatcaaatgcataatgagaatgaaaaaaaatatgttgctttaataatttcagtgtatgttcccatacctccttaacaacacacttacaatatctgtatccaaaagctactacctgatagaaataaccaagatgttcctcctcacttcattccaaattcatgttaatttagtagtcagnggtgatactccttccctctctgcttttatttataacaactagcttttgtttaaatggctcatg

SEQ ID NO: 7198 - DNA, 406 bp, Homo sapiens
cggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggt

SEQ ID NO: 7199 - DNA, 435 bp, Homo sapiens
atggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatggatacaggtgtgctgagtgagctgtgctgc

SEQ ID NO: 7200 - DNA, 299 bp, Homo sapiens
ctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaaccccc

SEQ ID NO: 7201 - DNA, 136 bp, Homo sapiens
ctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 7202 - DNA, 281 bp, Homo sapiens
cggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccatttt

SEQ ID NO: 7203 - DNA, 341 bp, Homo sapiens
ggcaagtttactacggaggcatagagcacgagatccgcaaggacgtctggccctttctgcttggccactacaagttcggcatgagcaagaaggagatggagcaggtgaggggagcctgttcccatggggctgagatggggagctgggccaggggacgccagggaggggaccttggaagcctcagccccttcccagccggaaagaagcatggcagggcagctccaccgtccttaccctgaggcccgtcttgagtctgagactcaggacccaaggtccagtgcaggcccagctcctgaaggggagggcctggtgcacgcttcccccatggtcgtggtgtggtc

SEQ ID NO: 7204 - DNA, 436 bp, Homo sapiens
aacagtacttcataataagaatcttttatagcaatctacagttatttatctactatcctaagaaatatatataaattttatgagatttttcttgtcattttaaatattttatgtatttcaatgtaaacttatttccttaaatgatgccaatatataatctagcccattgaaactgataaacaaatagataaggttgaaaaaagttctggtttatatagctaatcacaaaagaaaggaaatgctgtattagagatctcttttgtctgttctctggtatcttgtcactataaccttcacaccatctatcacattgttctgtttcatgttttgccccatttttccttttaacaataacaataacaccaaagggcaagcgggcaaagttatgtatactctgtttcttggcttttgaccacaaaaaactggtaccatagtc

SEQ ID NO: 7205 - DNA, 176 bp, Homo sapiens
ggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatg

SEQ ID NO: 7206 - DNA, 439 bp, Homo sapiens
cgggtgctgctgtgtcgctccagtgagtcacccctttagcgtcctcctgggctctgggtgctgggtaaagtcctgggacatctcgttttctttagctttctcatttatcccacagacttttgcggagtattggctgtatgtagcacgcgctgctgggtgttaagaaagacttggaatacatagcccttatcctcaagggaatcgcagtctaattgggagacagatgcataaagtgatcactacagtctctgggataaggaaacagttgaaatgttcacccactttttaaggctgccagcaatgatcgtgcaagagagaaaaaatgagaccgggcgcggtggctcacacctgtaatcccagcgttttcggaggtcgaggcgggtggatcacttgaggccgggagttggacaccagcctggccaacatggtgaaaccccgt

SEQ ID NO: 7207 - DNA, 437 bp, Homo sapiens
aaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatggg

SEQ ID NO: 7208 - DNA, 100 bp, Homo sapiens
  misc_feature 86: n = A,T,C or G
aaactatccaacccttacattaaacagacctccaaccctacactacatctggggaagtctttaatatccatgatttttttttttcngggggaaactcttt

SEQ ID NO: 7209 - DNA, 438 bp, Homo sapiens
acatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttggtttttgatgttaaacagtaaatgcca

SEQ ID NO: 7210 - DNA, 443 bp, Homo sapiens
  misc_feature 225: n = A,T,C or G
gccatttggtgggcctgtcctgctgaccagcaagtctctgtactgaatttggtgactttgatcttatgattcatgtttcccagcgaggtactctgtgtctttgctatgaataatgtgttattcaagggctagttggaagattgcatatataaattgaaaacattttgtctaaaaaggggtgtatagagagaaagaaaatttcagccagagagaattcttttttcngtcttgagacagggtcttgctctggagtgcagcggtgctatcatagctaactgcagccttgacctctcaggctcaagcaatcctcccgcctcagcctcccgagtagctgagactacaggtgtgcaccaccatgcccataaattttttgtaaggacagggtctttcttagttgccccaggctgatctcaaactcctgggctcaaccagtcctcccttcc

SEQ ID NO: 7211 - DNA, 211 bp, Homo sapiens
tctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataactt

SEQ ID NO: 7212 - DNA, 135 bp, Homo sapiens
cttagctctctacatacctatcatgtgccctgtatcacagaagattcaggaaaaatgcacttgggaatcaaagaaaatggaacttctttttgaaaagacaagcaaccatgttaactgtattgacacatcctcaat

SEQ ID NO: 7213 - DNA, 250 bp, Homo sapiens
ctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagt

SEQ ID NO: 7214 - DNA, 170 bp, Homo sapiens
ccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaacta

SEQ ID NO: 7215 - DNA, 338 bp, Homo sapiens
gaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcat

SEQ ID NO: 7216 - DNA, 142 bp, Homo sapiens
ctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 7217 - DNA, 281 bp, Homo sapiens
cttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaag

SEQ ID NO: 7218 - DNA, 415 bp, Homo sapiens
ctcagtttggagtttttggtttctatttgttagtgtagaaagaaaatagtcttaacttctactttgagattatagatagcagaaaacagttctatattaattttcccacatattccctttggttctggttttatacaagtataatgggaaatactgaaatacagcaagttgacaatccattttggaacacttagataccttgaataattattgagatctgtgggttattacctgtactgagtcttttgagattcatccacttctattttccatttaaaggggaccttggtcctatgacttcagaaaggacaagccccaaggtcccagctgtgttccccttttatctcctaatctagtcatctcacttacccctaaggtcatatatcttttgctgttctctgttgcatgaagtagc

SEQ ID NO: 7219 - DNA, 234 bp, Homo sapiens
caacatggaacgtgattaatcggacagacttactggtttaaaaagtatattatcaaatgcgtggctctgtgtttattttcactagattcagagaaaatgtgagagctggtaaaaccgttgttggaaaagctatatgtacttttctccatccacagaattgaatcacgctaacttccaaatgtaaaaacaatataagtttcatgaattataacatgggaaaaataaattatgagg

SEQ ID NO: 7220 - DNA, 436 bp, Homo sapiens
atggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttt

SEQ ID NO: 7221 - DNA, 426 bp, Homo sapiens
aacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccc

SEQ ID NO: 7222 - DNA, 436 bp, Homo sapiens
cttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcc

SEQ ID NO: 7223 - DNA, 378 bp, Homo sapiens
ctctgttgctgaggaggagcaagtctataagcagccctggaagcattccatcttcctttgcttgtgacaacagccataaaactctcattttcccttgcacggctgctatctaaagtctcaccgctcacccaattctctgctcacaaacagactgacggggcccatttgcattctgaagtgcagctcccctgagtcccctgtccctccaggcaggtattattagtccccttgttttgttgggtgactctgaatgggagcctgtttacgggctgggttcctaatagaaggcttcggttccctcctaataatctatcccctggtgggttttatttccaaagtacagcagtacagaacctgccctcttgggagtttattggg

SEQ ID NO: 7224 - DNA, 383 bp, Homo sapiens
catgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggattttgggtcgtggacgtggtcagccacctcagtaaaattgggagagg

SEQ ID NO: 7225 - DNA, 415 bp, Homo sapiens
ctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgt

SEQ ID NO: 7226 - DNA, 417 bp, Homo sapiens
aggaggttgatcaacatcaccccagggcctgtcagggtgtcaggggctaggggagggatagcattaggagaaatacctaatgtagatgatggattgatgggtgcagcaaaccaccatggcacgtgtatacctatgtaacaaaccagcacattctgcacatgtaccccagaacttaaaataaaatttaaaaaaaagaaagagtagaatgatggataccagaggccgggagggcactcaaaatacgtacgactattatatatcaattatgaatttaatgcattaaaaataagcctgctggattggaaatgtcagttcatgtagattttatgtttgtatccccaaactgcctaaactcatcaaacttttgatcagtcagtagaattaaataaatttggaaaccatattgcccaataaggg

SEQ ID NO: 7227 - DNA, 165 bp, Homo sapiens
  misc_feature 26, 163: n = A,T,C or G
atttttaatttctaaggttggaatanaacttattctcaaaattcctttagggttattaaatattttcatttattagtcaaaggtaagttaattaagcttgtttaatgatgccaatcttatgcttttctgtaatcttcaatttttaataaatgtgagttagatnct

SEQ ID NO: 7228 - DNA, 439 bp, Homo sapiens
caagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggac

SEQ ID NO: 7229 - DNA, 435 bp, Homo sapiens
ctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactg

SEQ ID NO: 7230 - DNA, 193 bp, Homo sapiens
atttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacac

SEQ ID NO: 7231 - DNA, 137 bp, Homo sapiens
ctcgtgccgaattcgggcacgaggcgtgagccaccttgcccagcccacatcatacagtttgaaatgaaactttgccacaaccagcctttgctgtagcacacacatatatcactgaacctgtttgaaataaagttttt

SEQ ID NO: 7232 - DNA, 405 bp, Homo sapiens
  misc_feature 78, 368: n = A,T,C or G
tggagacgacgtgcagaaatggcacctcgaaaggggaaggaaaagaaggaagaacaggtcatcagcctcggacctcangtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcanagccctttgcccgctcgggtatgaagatcgggcggat

SEQ ID NO: 7233 - DNA, 249 bp, Homo sapiens
cctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgat

SEQ ID NO: 7234 - DNA, 434 bp, Homo sapiens
gttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagac

SEQ ID NO: 7235 - DNA, 436 bp, Homo sapiens
gttgacatttgctatgccaggtactttctgtgtattttctttcagaagttccaggcatggcaaggtggcttacgcctgtaattctagcattttgggagactgaggtaggcggatcacctgaggtcaggagtttgagaccagcctggccaacatggcaaaaccccgtctctactaaaaatataaaaattagccggaggtggtggtgcatgcctgtaatcccagctacttgaaaggctgaggcaggaaaatcgcttgaatccaggaggcagagagttcagtgggccaagactgtgccactgcactccagcctgggtgacagagtgagactctacctcaaacaaacaaacagacaaacaaaaaagaagttccatgtcatataaattatcagttgtttcacagatgaggaaactgaaccttaaagtgattaagttgcttc

SEQ ID NO: 7236 - DNA, 437 bp, Homo sapiens
gaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttctt

SEQ ID NO: 7237 - DNA, 436 bp, Homo sapiens
cgggagccgcggcttatggtgcagacatggccaagtccaagaaccacaccacacacaaccagtcccgaaaatggcacagaaatggtatcaagaaaccccgatcacaaagatacgaatctctttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggcccaaggccaaggatcaaaccaag

SEQ ID NO: 7238 - DNA, 303 bp, Homo sapiens
tcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttt

SEQ ID NO: 7239 - DNA, 430 bp, Homo sapiens
ctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagttttagtagggaattggaagtggaagtccaggcttgg

SEQ ID NO: 7240 - DNA, 437 bp, Homo sapiens
gaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagta

SEQ ID NO: 7241 - DNA, 108 bp, Homo sapiens; identical to SEQ ID NO: 7172

SEQ ID NO: 7242 - DNA, 251 bp, Homo sapiens
ggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatac

SEQ ID NO: 7243 - DNA, 370 bp, Homo sapiens
  misc_feature 122, 203, 301, 309: n = A,T,C or G
gtttgaggctgcagtgagctatgagggtgcctctgtgctccatcctaggcaacagagtgagacgctgtttaaaaaggaaaaaatccttccctagagctagtatcctaaagctgcagagctancccagacctcattggtttccttgtccttggggtgcttttcctgaatctttgggggtgaagggagtgttgctcccagtccanaggcctgattctgttcggactgggttctcaagacacgaccaggttctcaagacaggagtccccttgttcctccccattaaagggggtttgtcataagnaagaacancccctctccccagtcacagcctgaagggaggccccgagagcttcctccttccccccacctg

SEQ ID NO: 7244 - DNA, 416 bp, Homo sapiens
tcactttgtataactggaagccttctgtgaaattttagttttcaaagcattatctggtgatgggcaacccagggcagcgaatcattcagaattttcttatctaggctaataaacataataaaatcaataaggactttgaaagtaactccactgggttcaggaaactgagtgtggccgccctgtggggtggtgtttggtgagtgcttcccggaggtgagtagttaattcacaggagtgactaatggcagcgtcccactcactcctccttccggggtcatggtctcaaggggtcactccatgcactggggatgtcagctcattacagaatgatatattcgggaagtgtctcagttctgagtgcctttgagggaatttgcacttccgttcccacacagccttgcattgtgtgtgttaga

SEQ ID NO: 7245 - DNA, 439 bp, Homo sapiens
cagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggca

SEQ ID NO: 7246 - DNA, 341 bp, Homo sapiens
cctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaat

SEQ ID NO: 7247 - DNA, 434 bp, Homo sapiens
actggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccat

SEQ ID NO: 7248 - DNA, 363 bp, Homo sapiens
cgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaagg

SEQ ID NO: 7249 - DNA, 281 bp, Homo sapiens
atttatcctgggctttatgtacctctggtttgagggactcttgaacttcattttaagaaacatggcccaatgagtacacagtcaagtcttcatgtccctgaacactgcattacaaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttca

SEQ ID NO: 7250 - DNA, 238 bp, Homo sapiens
cggtctcagaactgtttgtttcaattggccatttaagtttagtagtaaaagactggttaatgataacaatgcatcgtaaaaccttcagaaggaaaggagaatgttttgagggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 7251 - DNA, 386 bp, Homo sapiens
ctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaat

SEQ ID NO: 7252 - DNA, 128 bp, Homo sapiens
cacacacatgcttccctttcctgagtcccatccctgcgtgattttgggggtgaagagtgggttgtgaggtgggccccatgttaacccctccactctttctttcaataaaacgcagttgcaaacacctg

SEQ ID NO: 7253 - DNA, 190 bp, Homo sapiens
  misc_feature 3, 28, 29, 33, 36, 38, 93, 94, 123: n = A,T,C or G
tcnaaaagggggacactagtggatccanntacntcngnacggagattatgctaaatctactctgcctctgctctataaatggaacactgcaannctggatgaccacatatgtgtgtgcagcgnggtttcctgaatattttaagcccactgttgagacctgctcagaaaaaaggattccttttaaaacatt

SEQ ID NO: 7254 - DNA, 437 bp, Homo sapiens
  misc_feature 44, 407: n = A,T,C or G
ccgctccggctgcaccgcgctcgctccgagtttcaggctcgtgntaacctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccanaaagagtaaaaccttttatgacaggggctg

SEQ ID NO: 7255 - DNA, 381 bp, Homo sapiens
  misc_feature 328: n = A,T,C or G
gaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacnaacacccctgaggccccggacgcccccggacacaataaaggtgtgaagcttcg

SEQ ID NO: 7256 - DNA, 440 bp, Homo sapiens
gggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgca

SEQ ID NO: 7257 - DNA, 146 bp, Homo sapiens
  misc_feature 111, 128: n = A,T,C or G
tgcgtttgcatttttataatcaaaagcttaatatattcccatcttttttagttaaccctttcttgactctgagtgctgtgaatttctttactgatttctctattctccggngagaaacaattaaatgngatttaacgtaagcagtg

SEQ ID NO: 7258 - DNA, 387 bp, Homo sapiens
ccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatt

SEQ ID NO: 7259 - DNA, 332 bp, Homo sapiens
  misc_feature 111, 290: n = A,T,C or G
cgcttgccaagatggttgaatcccaagatgtaaaaatctgatggttaaaccatcggaggagaaactctagactgcaagaactgtttttacccatggcatgggtggaattanagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagngggtttttatgaactgcatccaagacttcaatcctgattagt

SEQ ID NO: 7260 - DNA, 251 bp, Homo sapiens
  misc_feature 49: n = A,T,C or G
atttaggacagtcatgtctgcttacaggtgttatttgtctgttaaaacnagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagag

SEQ ID NO: 7261 - DNA, 184 bp, Homo sapiens
agaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagt

SEQ ID NO: 7262 - DNA, 394 bp, Homo sapiens
cccatttcagaagccccccggcctctcctgggcgggctgtaagtctccaggctttgcatccgtgtgcctgtgtctcacgcagaaggccctcacaagcgaaaacggggccacagggtggcgtaagcaggcagcagggactcaggggacattgaggcaggcagaagaggagaagcggcgagaccgcagggaatgctgggagccgcccaaaaggactctatgatccaaaaagcacccagagctgtttgggttcggctgtaaagccccaaccgttggaacagggtgcctgtgtctctcgcggagggcccccacaggcaaaacgggcccgcagggtggcgtgggcaggccacagtgactcagggtgacattgtcgcaggcagaaaggagaagtggcagg

SEQ ID NO: 7263 - DNA, 430 bp, Homo sapiens
gttgcattaaaacttatagtatgtacattccagtctcttcttagagaagaggaggtggcctgtcgatatctaatgaaaaataacatttaggaaactctcaacagtactggatgttttatttgtagagttataattttgaaacacataaggagccagcagtaaaatgaaagtttataccttttagtgttaatcttattttggctttttgttttgcaaaacaaactgcacatagttatataggggtatatattaagttttcattttttcttgtttggaaaaaaatactaatctttttcatttaggtttcttttttaattgatgccaaagagttccaatattgaacatcttaagtctgttacttggattacggattgagtttggagcttactcagaggactacaggagagtatccaggaagtagcaagaaatg

SEQ ID NO: 7264 - DNA, 413 bp, Homo sapiens
  misc_feature 318: n = A,T,C or G
gtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcatgcagcagtcctgccggtgtgtttctgtgcacctggggatgaagtgtgctcctcccccagcggttagcctcaatgctttncctccctctgttttattatttgaaattagccaaagaaaagctgcagggggcactgctgatcatcactggactggtgggtcgtactgtttgacaga

SEQ ID NO: 7265 - DNA, 108 bp, Homo sapiens; identical to SEQ ID NO: 7172

SEQ ID NO: 7266 - DNA, 439 bp, Homo sapiens
cggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctgg

SEQ ID NO: 7267 - DNA, 436 bp, Homo sapiens
aaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctac

SEQ ID NO: 7268 - DNA, 116 bp, Homo sapiens
ggggccttcgtgtccgaggccagcacaccaagaccactggccgccgtggccgcaccgtgggtgtgtccaagaagaaataagtctgtaggccttgtctgttaataaatagtttatat

SEQ ID NO: 7269 - DNA, 366 bp, Homo sapiens
ggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttcccccttgcagg

SEQ ID NO: 7270 - DNA, 436 bp, Homo sapiens
ggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcag

SEQ ID NO: 7271 - DNA, 346 bp, Homo sapiens
tgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacc

SEQ ID NO: 7272 - DNA, 340 bp, Homo sapiens
  misc_feature 44, 46: n = A,T,C or G
attatttgtttcttcagacaagcaaatcatttggtcagagttcntntaacctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgttttta

SEQ ID NO: 7273 - DNA, 184 bp, Homo sapiens
  misc_feature 50: n = A,T,C or G
gtgaaaccccgtctctaccacaaaatacaaaaattagccaggcatggtgntgcacaccctgtaatcgcagctactcaggaggctgagacaggagaatcgcttgaacccaggaggtggaggttgcagcgagccaagatggtgccactgcactccagcctggatgacagagcaagaccctatctca

SEQ ID NO: 7274 - DNA, 456 bp, Homo sapiens
  misc_feature 44, 48: n = A,T,C or G
cgggaacatcctcctggactcagtcatggcttgtggtctggtcnccancaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggccccca

SEQ ID NO: 7275 - DNA, 268 bp, Homo sapiens
gtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctggggttgtatttgtattttaaaatgagcatttgccacacaaagccaggagcttcagaccagcgtggttaacacagcgagacc

SEQ ID NO: 7276 - DNA, 417 bp, Homo sapiens
  misc_feature 127, 143, 239, 292, 376, 395, 405: n = A,T,C or G
gaaatttgaaaaaactttctctttgccatttcttcttcttcttttttaactgaaagctgaatccttccatttcttctgcacatctacttgcttaaattgtgggcaaaagagaaaaagaaggattgancagagcattgtgcaanacagtttcattaactccttcccccgctcccccaaaaatttgaattttttttttcaacactcttacacctgttatggaaaatgtcaacctttgtaanaaaaccaaaataaaaattgaaaaataaaaaccataaacatttgcaccacttgnggcttttgaatatcttccacagagggaagtttaaaacccaaacttccaaaggtttaaactacctcaaaacactttcccatgagngtgatccacattgttaggngctgacctanacagagatgaac

SEQ ID NO: 7277 - DNA, 439 bp, Homo sapiens
aacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttg

SEQ ID NO: 7278 - DNA, 461 bp, Homo sapiens
gccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaataga

SEQ ID NO: 7279 - DNA, 108 bp, Homo sapiens; identical to SEQ ID NO: 7172

SEQ ID NO: 7280 - DNA, 245 bp, Homo sapiens
caggtacgaaaccatcaatggacaacttgaaaatgcatgttcctcaggcctatgcagttcccagagactcttgacaccggtctctgctgaggctcccagcctcagtttcccccacagcagcacgggccccactgtgctgctcttcaggtccccacagccctgcctttggttcctggacatttggtattctgccctccactctggtactatcagagtagggcaggctctggattaaagcttttagc

SEQ ID NO: 7281 - DNA, 437 bp, Homo sapiens
gcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctg

SEQ ID NO: 7282 - DNA, 138 bp, Homo sapiens
tcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 7283 - DNA, 449 bp, Homo sapiens
  misc_feature 24: n = A,T,C or G
aaaagagcccgcatcgccaagtcnatcctgagccaaaagaacaaagctggaggcatcacactacctgacttcaaactatactacaaggctacagttaccaaaacagcatggtactggtactaaaacagagatatagatcaatggaacagaacagagccctcagaaataacactgcatatctacaactgtctgatctttgacaaacctgagaaaaagaagcaatggggaaacgattccctatttaataaatggtgctgggaaaactggctagccgtatgtagaaaacagaccgtttctttctagcttttatctggggatattctgttttccccataggcctcaagaggttcctaaacatcccttcacagattctacaaaaataatgctccaaaactgctgaatcaaagggaagatttagctttatgagatgaattttcacatctcaggga

SEQ ID NO: 7284 - DNA, 434 bp, Homo sapiens
aaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtacc

SEQ ID NO: 7285 - DNA, 437 bp, Homo sapiens
agaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttct

SEQ ID NO: 7286 - DNA, 459 bp, Homo sapiens
agagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttgga

SEQ ID NO: 7287 - DNA, 230 bp, Homo sapiens
tcaagattcagtaagatggcaaaaccaaatccaaggaaaataagaatcacaataaagtgatacaggagctgaaggatgaaatagctggtatcaaaaagaacctaacaggtctgacagagctgaataacacaatacaagaatttcacaatgtaatcacaagtattaacagcagaataaaccaaactgaggaaagaatctcagaacttgaagactggttctctgaaataaga

SEQ ID NO: 7288 - DNA, 255 bp, Homo sapiens
tgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgt

SEQ ID NO: 7289 - DNA, 500 bp, Homo sapiens
  misc_feature 18, 29, 31, 47, 51, 106, 107: n = A,T,C or G
caaagctggagctcgcgnttctccaagangnactagtggatccaaantttnccgcacgagggaagatttataggtagaggcgacaaacctaccgagcctggtgatnnctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcatt

SEQ ID NO: 7290 - DNA, 328 bp, Homo sapiens
gtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttc

SEQ ID NO: 7291 - DNA, 218 bp, Homo sapiens
attttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggc

SEQ ID NO: 7292 - DNA, 440 bp, Homo sapiens
  misc_feature 112: n = A,T,C or G
ggccactgcgcagaccagacttcgctcgtactcgtgcgcctcgcttcgcttttcctccgcaaccatgtctgacaaacccgatatggctgagatcgagaaattcgataagtcnaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtgggg

SEQ ID NO: 7293 - DNA, 360 bp, Homo sapiens
ctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 7294 - DNA, 498 bp, Homo sapiens
  misc_feature 26, 29, 48, 49, 107: n = A,T,C or G
caaagctggagctcgcgttctcccangangacactagtggatccaaannttcccgcacgagcggcggttggggtggtggggccccgggcggcgttgaccatgactcngcacggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcag

SEQ ID NO: 7295 - DNA, 353 bp, Homo sapiens
  misc_feature 17, 24, 51, 98, 104: n = A,T,C or G
tggagctcgcgttctcnaagaggngactagtggatccaaattttcccgaangagggggacatgggcacctcgggaggcccgggccctgcccagctacntttccncccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaag

SEQ ID NO: 7296 - DNA, 318 bp, Homo sapiens
gctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggtcgtgtgag

SEQ ID NO: 7297 - DNA, 439 bp, Homo sapiens
ataaaaatagggctgattatatttttaggaaccatcctacagaggagaggatggggagaggcagctgcatcctcctctttactaaaccaatatagcttgatcaatttaccttacaacttgaacactaacgttacaacacaaaggggaaaaatcttgattcatgtatcaaaaccttggataattcactatttgagccctctcttgtcagatgcaatttcacagctttgtctgtaacataaaacaaaatcttgccttttgggctgatgaaatgagaattgtctcttttccttctctggatttgactgacgtggccaaagaaatgaagtttctgtcaggctaccttgaagagtgggtcagtcatctgtcttcaaggtcaaacctgtggcttcagagcggcttcccaaagtcctgtctgcctgctgcattctgggctttgcag

SEQ ID NO: 7298 - DNA, 440 bp, Homo sapiens
cagaaagctatttctgactgcatgttgaggaacccaataaactcaaggagggaggaaaaaaagagatatccaatgatctcagtaagccggccaggaaataattgatgcagccgggactgggcatcagcatatcacagggagcatttccaagatgcacatctagctcttacccctgacatcctacatagaaattccttgggttgaagatcatgcacccaagttttaaaatgtctttttagttaattctttttcaggcccttcattaacttctgctctaaggagctgtcccctaaaacactgtctaaaacaacaggtatgtctcttttgtcctttctgtatccccaaattcaaataaactaggatgcacaggttgtcaagtttttattttgtgagtgtatcatctgtgcctgtacctgggattccatcctgagccaggcaag

SEQ ID NO: 7299 - DNA, 439 bp, Homo sapiens
ccttgctgaagggtcaggaatgattaaagccacttttgggtgagttaaatgaagcactgagtagtgaaaggatgtgcccaaatattcatggaggcagggtcaaaaacccaggcctcccattcaccagtgtagacacagcccagtggatgcacctgcctatgtacctttggccaaccaacctcaaaggatttcttagataaataatcagtaaatgtctactattgttattgttattgcgttgtcgacacatatgacaacggcaatgcaatgttatcaataacgagcgtgtttctgctgttaataagttggaggaattgagtctttagttctttaactctcaaagcatcatcttgccttttttgttgtgaatctaatatagttttacagtattgctttgagtgaatctgtgaatagatgttttgttgaatgctcagctaag

SEQ ID NO: 7300 - DNA, 456 bp, Homo sapiens
aagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcag

SEQ ID NO: 7301 - DNA, 349 bp, Homo sapiens
  misc_feature 22, 27: n = A,T,C or G
gtcgcggcgacatggccaaacntaccnagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 7302 - DNA, 395 bp, Homo sapiens
  misc_feature 3, 19, 31, 78, 84: n = A,T,C or G
ggngactagtggatccaanttttccccaaangagccacattgttggagagacagctgcctttctatgccccaggctgnttgctnccacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatg

SEQ ID NO: 7303 - DNA, 489 bp, Homo sapiens
  misc_feature 3, 5, 48, 52, 62, 316, 321, 355: n = A,T,C or G
aangngcgtctgcatatctttattgaaaattttcttgtatttatggcntttntccccatttntataaatgttccatgagtgaatgagaatatgtactttctaattatttgttgcagttaaatattgacacacttgacaaatatgtgatcactttacttaccaatttcttcatgaagttctgactgtgcatagttgatattatgttcttaggtttagacaaaaactgttgtctatttctgaggagttgtatacttgaccctcatgtactgaatgtatttattcctaatgatacattttactgtatggtttattttgntgganggtaataataccatggtggctttcttctgattanaaaatgtctgctatatattttccttccttttatattaatatgtctatttccctatactatacacatgtttactctcaacatttttctgttataaaatatttcaatacgaatatctatgtctttttattggcatg

SEQ ID NO: 7304 - DNA, 416 bp, Homo sapiens
  misc_feature 43: n = A,T,C or G
ctggcttcttggcgcgatgaggttccggttctgtggtgatctngactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtg

SEQ ID NO: 7305 - DNA, 376 bp, Homo sapiens
  misc_feature 331: n = A,T,C or G
ggtccaaagcacattattaactggggattaatttcctagtagtcatctgtcgggagggctgatccaccccgaggcacattaactggcgtgactttcaggacggcggggctgtgggagccactggacacatctgccccccaacccctagcctcttgaattactcaagtccctcagctctgttggcacaaatacgtgctggatgatagaagaaccgtttttcccatggatgaactttttttggcttgaattcttacaaggcctgacttctggatctggagaaagaagacttctttgtgtcccatcttcaaaatgcctcctccacttgttgcanaagcctaaaattcctttagttggggcagaaagcctattattattt

SEQ ID NO: 7306 - DNA, 426 bp, Homo sapiens
  misc_feature 3, 29: n = A,T,C or G
cangtcgacactagtggatccaaagattncggcgaggaattcgtggccttccgggcattaaggggccccctggtgctcttggtttgaggggacctaaaggtgacttgggagaaaagggggagtacggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagtt

SEQ ID NO: 7307 - DNA, 437 bp, Homo sapiens
gttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaag

SEQ ID NO: 7308 - DNA, 439 bp, Homo sapiens
cggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctcacaatgtttcctccaagaaccgcaaagccatcgtggaaagagctgcccaactggccatcagagtcaccaaccccaatgccaggctgcgcagtgaagaaaatgagtag

SEQ ID NO: 7309 - DNA, 500 bp, Homo sapiens
  misc_feature 23, 30, 54, 104: n = A,T,C or G
caaagctggagctcgcgttctcnaagaggnactagtggatccaaattttcccgnacgagcttcattcgagatgagtttctgaggatcagcactgccagtggagntgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaaca

SEQ ID NO: 7310 - DNA, 458 bp, Homo sapiens
  misc_feature 49: n = A,T,C or G
atcacaagcctgtggggcaaggtgaatgtggaagatgctggaggagaanccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgc

SEQ ID NO: 7311 - DNA, 355 bp, Homo sapiens
gccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagtt

SEQ ID NO: 7312 - DNA, 465 bp, Homo sapiens
gatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctcca

SEQ ID NO: 7313 - DNA, 468 bp, Homo sapiens
  misc_feature 6, 16, 29, 53, 56, 103, 104, 105: n = A,T,C or G
taagcnggagctcgcnttcctcaaaaggngactagtggatccaaattttcccnaangaggccgcctcttggggccatcaaggacagggccatgttctgtcccnnnacacctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccagg

SEQ ID NO: 7314 - DNA, 275 bp, Homo sapiens
  misc_feature 49: n = A,T,C or G
ctgcattcaggttggcaggaacatcattcatggcagtgattcattaaanagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 7315 - DNA, 187 bp, Homo sapiens
  misc_feature 27: n = A,T,C or G
accttctacccacgccgtacgtcgctncagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggt

SEQ ID NO: 7316 - DNA, 463 bp, Homo sapiens
  misc_feature 23, 48, 55, 110: n = A,T,C or G
caaagctggagctcgcgttctcnaagaggacactagtggatccaaatnttcccgnacgagcggagccggactggacatggtcactcagtaccgcctgcagtgtctccatnactgatcatggctcttgcatttttgggtaaatggagacttccggatcctgtcagggtgtcccccatgcctggaagaggagctggtggctgccagccctgggtcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 7317 - DNA, 223 bp, Homo sapiens
  misc_feature 45: n = A,T,C or G
aacgtcaaggagctggaagtgctgctgatgtgcaacaaatcttantgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcat

SEQ ID NO: 7318 - DNA, 321 bp, Homo sapiens
  misc_feature 43: n = A,T,C or G
gcgcagcccagcctcgaaatgcagaacgacgccggcgagttcntggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaac

SEQ ID NO: 7319 - DNA, 415 bp, Homo sapiens
catcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaaga

SEQ ID NO: 7320 - DNA, 226 bp, Homo sapiens
gcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgc

SEQ ID NO: 7321 - DNA, 456 bp, Homo sapiens
  misc_feature 45, 48: n = A,T,C or G
attgcatacatggatcaggccagtggaaatgtaaagaaggccctnaanctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccacca

SEQ ID NO: 7322 - DNA, 183 bp, Homo sapiens
  misc_feature 2, 11, 31: n = A,T,C or G
tncaaaggggngacactagtggatccaaatntcccattaagatggattctcagatatttatatttttattttatttttttctaccttgaggccttttgacatgtggaaagtgaatttgaatgaaaaatttaagcattgtttgcttattgttccaagacattgtcaataaaagcatttaagttg

SEQ ID NO: 7323 - DNA, 360 bp, Homo sapiens
  misc_feature 329, 344: n = A,T,C or G
accaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgtacttatgttctcnttctatggccattgngctgcctctgttactg

SEQ ID NO: 7324 - DNA, 215 bp, Homo sapiens
atttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagt

SEQ ID NO: 7325 - DNA, 410 bp, Homo sapiens
  misc_feature 39, 41, 399, 401, 407: n = A,T,C or G
cttctgttgctgtgaatacttctctcagtgtgagaggtnanccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgccagccctgctgaagggccctaacnanagttcnaga

SEQ ID NO: 7326 - DNA, 380 bp, Homo sapiens
gggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 7327 - DNA, 319 bp, Homo sapiens
atttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatattgagt

SEQ ID NO: 7328 - DNA, 257 bp, Homo sapiens
cttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaat

SEQ ID NO: 7329 - DNA, 414 bp, Homo sapiens
  misc_feature 45, 347, 358, 397, 398, 400: n = A,T,C or G
gtgcagaaatggcacctcgaaaggggaaggaaaagaaggaagaanaggccatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccantcggccctcanagcccttgcccgctcgggtatgaagatcgggcggtttgnngntgtccccccccttc

SEQ ID NO: 7330 - DNA, 316 bp, Homo sapiens
  misc_feature 43: n = A,T,C or G
gccagatggttttagtaacagtgaattgaattaaatcaattgnaaaagattggtagctgctgtccttatcctgcaggtctgctttaaagaagagtctggcagggagccagggacctgttcctaggaaaggcaggcaagatgctgctggagaggaacaatatgcgttcctctctgagaccatttcctttgaaacatgttctggggcaggagcttgattggctgccaaggcacatgtgagttgggaagcaccatgtcagacatgcaaaccagggagcccctgggccgtgtttattatacgtgttctgactggcccttg

SEQ ID NO: 7331 - DNA, 184 bp, Homo sapiens
cccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 7332 - DNA, 289 bp, Homo sapiens
  misc_feature 2, 48, 50, 168: n = A,T,C or G
gnttaccaaaatggctgtttacagtgcatttagttctgatatttatancnatgacatttcacagaataactttaaaatagtttgaaattctatatagtttagacatcgatcacatctggagacaaaataaaatgtgcaatattttttatgtaggcgagctaacacagngtacctaattgcagaattatctgattaatttgtaatagataagttgtataacattttcatatcttaaaatgttttttagatcaatcttgaagtgaaatattttcaaaataaaattctacag

SEQ ID NO: 7333 - DNA, 107 bp, Homo sapiens
ggctctgattttgagttatttataataaagtttggggattatcataacatctcatatctttgtgtatgttgttttaatgctcggcagagcacaacactgatgataac

SEQ ID NO: 7334 - DNA, 442 bp, Homo sapiens
  misc_feature 440: n = A,T,C or G
cacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagncc

SEQ ID NO: 7335 - DNA, 440 bp, Homo sapiens
  misc_feature 43: n = A,T,C or G
tccaggctcaccctcgcgcctgtctacaccagcccccagctgnacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgaggctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgag

SEQ ID NO: 7336 - DNA, 439 bp, Homo sapiens
gaacatgttctccaaccacaatggactcactagaaatcagtaacagaagggcaacaggaacaccttcaacacttggaaactgaacagcacacttataaataatctatgggtcaaagaagaggtctcgagggaaatccaaaaacatactgaactgaatgaaaatgaggataaaatatcaaaaattgtgagacatggctttatccactgctttaatacagccgcactgagaggaaattttgggcaagaagaaaattctgaaatgaatagtttatgctcttacctccataacctagaaaaaggagaacaaactagacccaaggcaagcagaaggaaggagataataaaaatctaagcagaaatttaaaaagatacagagaagtaatagagaaaataaatgaaagaagtggttctttgaaaagatcaataaaattgacaaacc

SEQ ID NO: 7337 - DNA, 440 bp, Homo sapiens
  misc_feature 43, 44: n = A,T,C or G
cacaattgtggaacccacattggcctgagatccaaaacgcttnnaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggt

SEQ ID NO: 7338 - DNA, 230 bp, Homo sapiens
  misc_feature 1, 44: n = A,T,C or G
ngaacttgtcaatgatggatggtaaattttcatggaagttatanaagcgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 7339 - DNA, 439 bp, Homo sapiens
  misc_feature 45, 50, 113, 127: n = A,T,C or G
atctcatccaagcaagttagagtccagcctaatcaaatgtcatanttgtngtacctattgaaagtttttaaataatagatttattatgtaaattatagtatatgtaagtagcntaatgaagaaaganatcatgaagaaagaaattgataggtgtaaatgaaaagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcaga

SEQ ID NO: 7340 - DNA, 234 bp, Homo sapiens
gtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttc

SEQ ID NO: 7341 - DNA, 458 bp, Homo sapiens
  misc_feature 9, 13, 39, 47, 48, 49, 51, 95, 98, 99, 101: n = A,T,C or G
ggagctcgnttcntcaaaaggggacactagtggatccantttccccnnnangaggaggcggcacagctgcgggaggagcggctacggcagtacgnttnnanccaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 7342 - DNA, 398 bp, Homo sapiens
  misc_feature 36: n = A,T,C or G
gatactttgagattgtgttctgagagatgatatgantacctaaaatacaattaaaaatgttataatataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaagcatgtttattcccctaatccattaaagagcatgaaaaaaagaataaatgtatttgaaaatt

SEQ ID NO: 7343 - DNA, 439 bp, Homo sapiens
  misc_feature 49: n = A,T,C or G
gaaacttgtcacttgcatgtcccatcacgtgtactggctcctttgtggngtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatga

SEQ ID NO: 7344 - DNA, 403 bp, Homo sapiens
aagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaat

SEQ ID NO: 7345 - DNA, 438 bp, Homo sapiens
  misc_feature 50, 293, 317, 347, 349, 385: n = A,T,C or G
cagtcttcatttctcctggttattggtttgtttgtcattaaagatatatnttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttcttggttttcctcactaatcttttttttttagnccaaaagccaaaaatatttatctnggttttacattttaatttccattcttaatngnaatttttttctttaaataaggaaaccaatataatcncatgtataaaaacttaaatattttacaagttacatatagcatcattctaaaat

SEQ ID NO: 7346 - DNA, 486 bp, Homo sapiens
aaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtattt

SEQ ID NO: 7347 - DNA, 445 bp, Homo sapiens
  misc_feature 46, 49, 342: n = A,T,C or G
gccaacaccaagattggcccccgccgcatccacacagtccgtgttnggncaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaanaaatatgatgaaaggaaaaagaatgccaaaatcagcagtctcctggaggagcagttccagcagggcaagcttcttgcgtgcatcgcttcaaggccgggacagt

SEQ ID NO: 7348 - DNA, 274 bp, Homo sapiens
  misc_feature 50: n = A,T,C or G
ccaccccactcttaatcagtggtggaagaacggtctcagaactgtttgcntcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 7349 - DNA, 237 bp, Homo sapiens
ccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttg

SEQ ID NO: 7350 - DNA, 500 bp, Homo sapiens
  misc_feature 2, 16, 42, 44, 48, 49, 96, 100, 106, 108, 444, 481: n = A,T,C or G
anttccttaaaaaagngggctaggggatccaaatttctccanangagnngggctgtgaatttcatttagatacagaaagatagatgtccctttttncccnaaaaanangggcctagaaccaataattaatcaatatggcttagaacaagcaatgagtagccctaagttcattctgtactctaagacaagttctgctacaggcaggaaagacatgaagaaataccttcctttgcaccaagacactattttttttaatatggggaattttaaaaaaaagaactccagatggattttaaacacagtggggaactgggcggtgtgatggcagatggctatttcagctgcacatgggtaaaaataattccaactccccaatacccaggactgctctgaacttgtgaaaaccttttaaggaaaagctgcagtgtgatgctcaaagcgcanagctgcagcagactgggggccaagggcttggaactcnccaataagaaaacagctac

SEQ ID NO: 7351 - DNA, 438 bp, Homo sapiens
aacgccaatatagatctgcttattatcctgaagatctctttattgacaaccaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggt

SEQ ID NO: 7352 - DNA, 405 bp, Homo sapiens
tggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatacaaataataaatctatt

SEQ ID NO: 7353 - DNA, 344 bp, Homo sapiens
  misc_feature 2, 3, 28, 35: n = A,T,C or G
gnnactagtggatccaaattttccccgnacgaggnggcttaagccatggcgcttctcacggcattcagcagcagcgttgctgcaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttgg

SEQ ID NO: 7354 - DNA, 459 bp, Homo sapiens
  misc_feature 46: n = A,T,C or G
cacgacacgtactacgttgtagctcacttccactatgtcctatcantaggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgcaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcg

SEQ ID NO: 7355 - DNA, 156 bp, Homo sapiens
  misc_feature 45: n = A,T,C or G
gaagaaccctccataaacctggagtggctatatggatgccccccnccctaccacacattcgaagaacccgtatacataaaatctagacaaaaaaggaaggaatcgaaccccccaaagctggtttcaagccaaccccatggcctccatgactttttc

SEQ ID NO: 7356 - DNA, 417 bp, Homo sapiens
  misc_feature 21, 27: n = A,T,C or G
tggaggaggaaattatggaantggaanttacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaag

SEQ ID NO: 7357 - DNA, 465 bp, Homo sapiens
  misc_feature 1, 55: n = A,T,C or G
nccgcacgaggttgggggccgtcccgctcctaaggcaggaagatggtggccgcanagaacacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttt

SEQ ID NO: 7358 - DNA, 436 bp, Homo sapiens
  misc_feature 46, 300: n = A,T,C or G
gcaaggtccaagatggccgctggcatcagacactcttcaccttttnggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtanaagtgggtgggggtaggaggggatagggtgtccttgggaacaatggatcccagcttagccccaaagaccaaccaaagagccagccagagtaagctggacctgcaacctgcctgagccccgtggcctctcagctctg

SEQ ID NO: 7359 - DNA, 403 bp, Homo sapiens
  misc_feature 44: n = A,T,C or G
gacaagtcccacccctagatctgaagcaagctctaccagcagcntgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttga

SEQ ID NO: 7360 - DNA, 407 bp, Homo sapiens
  misc_feature 18, 26, 29, 48, 52, 107, 108, 113: n = A,T,C or G
caaagctggagctcgcgnttctccangangacactagtggatccaaantttncccgcacgaggtcgcggcgacatggccaaacgtaccaagaaagtcgggatcgtcnntaaanacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 7361 - DNA, 437 bp, Homo sapiens
ctgagagagcaggaagagaagaagtggagaatcataatctaggttttatcagagtcattctgggaagactgaaatagctacttaacacataaagatacagaaatgcacaaccaacagatccatttcaagccaaattaagacaggccttgtttctgtcacaaaatacattccaagttaaatgggaggtgccagaaacaatttctttaaatctcaccagtttcatggaaagactaaaggggtgaaccaatgattcttagtccccatcccagtagtaaactaagtttttattcccctgtcaattcacttagaactggtgtgtatgtggttgtttgtggtgggggtagcagtggaaggattctcactcatttgtactatacagaagcgattcccaatacttatgttttctataacttactagaagacaaatcagaagagag

SEQ ID NO: 7362 - DNA, 498 bp, Homo sapiens
  misc_feature 47, 48, 105, 111, 261, 326, 329, 486: n = A,T,C or G
caaagctggagctcgcgctttccaagacgacactagtggatccaaanntttccgcacgagcagcagcatcccacccctgggagtctggccagctgagccccaggntggcangggcattatagcctggtggacatgtgccttcagggttcctccggggccaccttcctcaggccagtgctgggttcaaagggctgtgtgtgtgtgtgtgtgtgtgtgtatgtatatgtgtgtgggtgcacacatctgtcccatgtatgcagngagacctgtctacctcccacaaggagcaagggctctgcccgccctctgctcattcctacccaggnagngggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcanaggtggaaggcc

SEQ ID NO: 7363 - DNA, 362 bp, Homo sapiens
  misc_feature 26, 49, 57, 106, 107, 112: n = A,T,C or G
caaagctggagctcgcgtttctccangaggacactagtggatccaaatnttccccgnacgaggctatttccaggctgggcgcggtggctcaagcctgtaatcccannacttnggaaggccgaggcgggcggatcaggaggtcaggagatcaagaccatcctggctaacacggtgaaaccccgtctctactgagaatgcagaagattggccgggcgaggtggcgggcgcctgcggtcttggctgctcgggaggccgaggcaggagaatggcggaaacccggggggcggagcttgcagtgatcttggctcacgcggtgagccgagatcgcgccactgcactccagcctgggcgacagagggaga

SEQ ID NO: 7364 - DNA, 500 bp, Homo sapiens
  misc_feature 23, 25, 30, 55, 105, 107, 110: n = A,T,C or G
caaagctggagctcgctttctcnangaggncactagtggatccaaattttcccgnacgagataaatctaagaagaaggcctttaccaagtactgcaagaaatggntnganccaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgc

SEQ ID NO: 7365 - DNA, 111 bp, Homo sapiens
gagtacttctagagcggccgcgggcccatcgattttccacccgggtggggtaccaggtaagtgtacccaattcgccctatagtgagtcgtattacaattcactggccgtca

SEQ ID NO: 7366 - DNA, 496 bp, Homo sapiens
  misc_feature 18, 29, 49, 52, 57, 108, 112, 345: n = A,T,C or G
caaagctggagctcgcgnttttccaagangacactagtggatccaaatnttncccgnacgaggaatgtcctgccttcctgaccctctatgatatagagtttcagtatnaaangggagaaaacaggagaaaatctctaatttgttttctccagatttcagtctgtaatttgaaaaggttaactgagtatcatgcaaaagtaatgaaagtggcctaaatgtatcctgattccaaggagaaaagtttaatcaagggaaaacaacaacatcagcacacaaaaaccctgcaattatctagatgacaaaaacaggttgcctcagaggaaaaaaaaataatgctggcattanatgtcttccttgaaatattacatttcagaaagcattagcctaatattacagttttaaggaaaaaaaattaggacaataatttttaactgtccaaattacctgatatggttaaggtataaagaaagttaagacatcacaataaaaatgaatg

SEQ ID NO: 7367 - DNA, 188 bp, Homo sapiens
  misc_feature 49: n = A,T,C or G
ggggagatgtaggtgtagaattattgcttatgtcatttcttaatcagtnctgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttcta

SEQ ID NO: 7368 - DNA, 357 bp, Homo sapiens
  misc_feature 44, 49: n = A,T,C or G
gtgaatttttctaaaggtgctatttaacatgggaggagagcgtntgcgnctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacc

SEQ ID NO: 7369 - DNA, 487 bp, Homo sapiens
  misc_feature 49, 51: n = A,T,C or G
ggcaggggaagtattgaatgcctaattaagaaatatgtgttctgtttancngaaaacaataggggagtgtttaatagccactatgatagcacaaggatgaggcaaagcagctgtagggaaaggggagccatggcagagcagatgcacattttacagggcttggtgacagatgtgtgttgtgatttcaggaaagagaaactgaaactgtaaggaagcaggtagacccctgaacaggccagtttctcttgaaaacttgagattccagttcacctaagtaagcaagtcctctgtttttgtttttttgtttgtttttttgacagttataccactgtcatttgctcaatggaaatataaagttggcatcactgaaattaacaagtttttaagaaagaaatgatcgctcagagcttaaggaagactgcctaaatcctagtgatctcctaacggggacgggggatgtgatgatgagctttagagctgagagagt

SEQ ID NO: 7370 - DNA, 263 bp, Homo sapiens
  misc_feature 45, 50: n = A,T,C or G
ccacactgagctggagggaggagagaaggagggaggagaaagacngggcntgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccat

SEQ ID NO: 7371 - DNA, 498 bp, Homo sapiens
  misc_feature 5, 10, 30, 75, 76, 85, 91, 94: n = A,T,C or G
ggggnctagnggatccaatttttcccaaangagaaagtacttggagtctgcaggtgcgagagttgtaccagtaanntttttcccnacaaanaangactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgt

SEQ ID NO: 7372 - DNA, 499 bp, Homo sapiens
  misc_feature 15, 26, 28, 74: n = A,T,C or G
actagtggatccaantttccccaaangngggcgcgtggtctacgccgagtgacagagacgctcaggctgtgttntcacgatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcaggacggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggat

SEQ ID NO: 7373 - DNA, 338 bp, Homo sapiens
  misc_feature 24, 25, 27, 52, 100, 101, 107: n = A,T,C or G
tggagctcgcgtttcctccaaagnngncactagtggatccaaattttcccgnacgagggaagaagggagaagaaaggtgagtttgagctgccttccctanntttacnccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtt

SEQ ID NO: 7374 - DNA, 232 bp, Homo sapiens
  misc_feature 44: n = A,T,C or G
cagagacaccagcttcagtggcctgtcgttggaagagtacaagntgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagt

SEQ ID NO: 7375 - DNA, 500 bp, Homo sapiens
  misc_feature 26, 105, 111: n = A,T,C or G
caaagctggagctcgcgttctcccangtggacactagtggatccaaattttcccgcacgaggaggaggatttgcaggaagagctcgtggaagaggtggtgaccantttagnggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggtttt

SEQ ID NO: 7376 - DNA, 362 bp, Homo sapiens
  misc_feature 43, 49: n = A,T,C or G
cgccgcgccgccatcatggacaccagccgtgtgcagcctatcntgctgnccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaag

SEQ ID NO: 7377 - DNA, 438 bp, Homo sapiens
  misc_feature 44, 49: n = A,T,C or G
gctccgctgtacctggatcctgctcctctgggttgaaacccggncgccnccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtg

SEQ ID NO: 7378 - DNA, 251 bp, Homo sapiens
  misc_feature 49: n = A,T,C or G
gctgtacttccctgtggcacgttaccatggaagccgctccagggtgggncagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcag

SEQ ID NO: 7379 - DNA, 439 bp, Homo sapiens
  misc_feature 45, 49: n = A,T,C or G
gctgaccatgaacatccccttccagtccatccacttcatcacctntganctcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtca

SEQ ID NO: 7380 - DNA, 465 bp, Homo sapiens
  misc_feature 45, 46: n = A,T,C or G
cagcacatggaagaagtaccaagaggcgatgaagacatccttggnnagttccacaacgtggtgacctggaagacctggaggagcatctgccagggcagacagtctctgaggaagccacaggggttcacatgatgcaggtggacccagccacaccggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttac

SEQ ID NO: 7381 - DNA, 131 bp, Homo sapiens
  misc_feature 49: n = A,T,C or G
tccaagtgtaaaataattttgactccagcagctacaaatacagacgganttttcttttcatgcctcaaatactacagtgtggccacgagcaaagagattttgtgtgtgtctgtgtgacagagcgagacctt

SEQ ID NO: 7382 - DNA, 500 bp, Homo sapiens
  misc_feature 2, 5, 27, 28, 90: n = A,T,C or G
cncangtcgacactagtggatccaaannttcccgcacgagcttccgaggaagctaaggctgcgttggggtgaggccctcacttcttccgncgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgt

SEQ ID NO: 7383 - DNA, 500 bp, Homo sapiens
  misc_feature 21, 25, 28, 51, 61, 104, 111: n = A,T,C or G
caaagctggagctcgcgttcnccangangacactagtggatccaaattttnccgcacgagngatgccctccggggccaggaggacctgaaggagcagctggcgnttgtgcnagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcg

SEQ ID NO: 7384 - DNA, 440 bp, Homo sapiens
  misc_feature 2, 45, 50: n = A,T,C or G
gnggtcccacttgactgttccaaagagcagcttctcagatcttcngtgtncactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcga

SEQ ID NO: 7385 - DNA, 438 bp, Homo sapiens
  misc_feature 45: n = A,T,C or G
gtgccttgcaggaatttaaactctctacccttaaagaaggaaatntatttgtacaaaagccacagataatggtccttttactcaagcgacctgctggataaatgacagcctgcagggattgagtttggagatctagtctcaattctgcttccgatttagatgcagttcacttttgttttttaaagtaagttttattaatggaaaggaagaactttttccaagaaagcattttgaaagccactgggggagggggacatttatgcttttgggctgtggagatcctttaggtggagagactgctctctcatccctagtggaatggaggtttgggttggtgagtttctatcaatagcctgctctctatagtgggtcagtgactggcaccaaattgtagtcctgttccatggacattgccctgttttggttttatgagctttt

SEQ ID NO: 7386 - DNA, 313 bp, Homo sapiens
ctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaat

SEQ ID NO: 7387 - DNA, 468 bp, Homo sapiens
  misc_feature 3, 27, 30, 77, 82: n = A,T,C or G
ggngactagtggatccaaatttccccnaangagaaggacatggcgtattttgtatttaaaagtaattgtattaattntttancccgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtg

SEQ ID NO: 7388 - DNA, 162 bp, Homo sapiens
  misc_feature 48: n = A,T,C or G
gtcagataagttttttcatgaacccgttgtggaaattattggaattanctgagccaaagtgattatgcattcttcatctattttagttagcactttgtatcgttatatacagtttacaatacatgtataacttgtagctataaacattttgtgccattaaag

SEQ ID NO: 7389 - DNA, 207 bp, Homo sapiens
  misc_feature 9, 36, 49, 50, 75, 108: n = A,T,C or G
gctgatcantattttttatcaacacctgagaactgntacaccttttatnntgtcttttaggaaatccctgtcttnccattttttcatgtaaattttgcacagttactnggtcatatgtaaatattttactttcagaaatgaagtttttaattgctattgttttatataggattgaaagaaaattaactcctttattaaaaacaaatt

SEQ ID NO: 7390 - DNA, 209 bp, Homo sapiens
  misc_feature 2, 5, 52: n = A,T,C or G
gnggntgatcagtattttttatcaacacctgagaactgttacaccttttatnctgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaat

SEQ ID NO: 7391 - DNA, 106 bp, Homo sapiens
  misc_feature 48: n = A,T,C or G
ctcactcctgtaatcctagcactttgggaggccaaggcaggaggatcncttgagcccaggagttcgagaccagcctgggcaacgtagtgagattctatctctattt

SEQ ID NO: 7392 - DNA, 286 bp, Homo sapiens
  misc_feature 44, 49: n = A,T,C or G
gccgccgctgtggctctaaggcctaccaccttcagaagtcgacntgtgncaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaat

SEQ ID NO: 7393 - DNA, 500 bp, Homo sapiens
  misc_feature 4, 7, 31, 37, 82, 85, 88, 90, 95, 100: n = A,T,C or G
aagnggngactagtggatccaaattttcccngaacgngaggatatcaaaacagaggttccagaagaagatgcactaagtagnttngancnctcanaaagnagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgag

SEQ ID NO: 7394 - DNA, 497 bp, Homo sapiens
  misc_feature 2, 18, 27, 75, 76, 78, 81: n = A,T,C or G
gncactagtggatccaantttcccccnacgagcaagaggcgtttctataagaattggcataaatctaagaagaanntnttncccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgc

SEQ ID NO: 7395 - DNA, 172 bp, Homo sapiens
  misc_feature 3, 12, 27, 32, 39, 86, 91: n = A,T,C or G
tcnaaagggganactagtggatccaantttcnccggaangagcttgtaaccctttaccctataattgctatccttaaagatttcanataanctcggagggaactgcagggagaccaacttatttagagcgaattggacatggataaattttttattttttttaaaaaattat

SEQ ID NO: 7396 - DNA, 460 bp, Homo sapiens
cacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaata

SEQ ID NO: 7397 - DNA, 438 bp, Homo sapiens
  misc_feature 1, 44, 50, 51: n = A,T,C or G
nataccccttggttccttgggctggaagacagttaaacaaccantatatnncgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagcc

SEQ ID NO: 7398 - DNA, 456 bp, Homo sapiens
  misc_feature 43: n = A,T,C or G
cattaggctgttggttcaaacttttgggagcacggactgtcanttctccgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaag

SEQ ID NO: 7399 - DNA, 148 bp, Homo sapiens
  misc_feature 48: n = A,T,C or G
gttcaaggcagaaccacgacccttgactcccgggtggggaggtggccnaggatgctggagctgaatcagacgctgacagttcttcaggcatttctatttcacaatcgaattgaacacattggccaaataaagttgaaattttaccacc

SEQ ID NO: 7400 - DNA, 439 bp, Homo sapiens
ctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttcttttccttgaagggcagcctcctgcccaggccc

SEQ ID NO: 7401 - DNA, 165 bp, Homo sapiens
  misc_feature 58: n = A,T,C or G
agcagccggcgacttcatcgagcatgccgagttctcggggaacctgtatggcacgagncaaggtggcggtgcaggccgtgcaggccatgaaccgcatctgtgtgctggacgtggacctgcagggtgtgcggaacatcaaggccaccgatctgcggcccatctaca

SEQ ID NO: 7402 - DNA, 437 bp, Homo sapiens
gtatgtgcttttctgtgggggtgggatttggaaggggggttgggttgtgctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgat

SEQ ID NO: 7403 - DNA, 423 bp, Homo sapiens
  misc_feature 88, 399: n = A,T,C or G
cttcggtgaagcgtcacagaaatttggatttgaagtggggccggcttgcttcatgggctaggagccgccgagcccgggctcccgagancaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcctgacccatcctgttcgtgaataggtctncagggggtgtggggggagggattg

SEQ ID NO: 7404 - DNA, 400 bp, Homo sapiens
gcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaag

SEQ ID NO: 7405 - DNA, 439 bp, Homo sapiens
ctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctac

SEQ ID NO: 7406 - DNA, 246 bp, Homo sapiens
caggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagcgaaaaaggtgtgaagcacccaccatgttcttgaacaatcaggtttctaaataaac

SEQ ID NO: 7407 - DNA, 433 bp, Homo sapiens
cctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtgggggggaggtctgtaatgtgaaacaacttcttgtctttttttctcccactgttgtaaataacttttaatggccaaaccccagatttgtacttttttttttttctaactg

SEQ ID NO: 7408 - DNA, 116 bp, Homo sapiens
cctgtagtcccagctactcgggaggctgaggcaggagaatggcgtgaacccaggaggcggagcttacagtgagccgagatcgtgccactgcactccagcctggggacacagcaaga

SEQ ID NO: 7409 - DNA, 439 bp, Homo sapiens
atttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacac

SEQ ID NO: 7410 - DNA, 223 bp, Homo sapiens
gtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtt

SEQ ID NO: 7411 - DNA, 342 bp, Homo sapiens
ggagagctgagcagtcaagatgtgtgacttcaccgaagaccagaccgcagatctgatcccaagcactggagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaattttgtatctagcctaaagtttccctaggctttcttgtctcagcaactttcccatcttgtctctcttggatgatgtttgccgtcagcattcaccaaataaacttgctctctgggcc

SEQ ID NO: 7412 - DNA, 457 bp, Homo sapiens
agagcacatacagggctccagaaccagattaaaacaagaagtgaaggtgggaaagagagaaaatgcagaattggaaacaaagcgtgaaacaattcacaggaactgagaggcagcagccagcacagggtagaagggcagtggcagttcagctccctgtcaggtgtgtctgccgtgtaaaataataatacgcccccacccatggctgtgtggcctgcacactcccacatgcatgcccacacacagactgaaggaattgtacccccttccccagcaggtgccctttctctctgccaggtgagcagagcagacaggggctgctccttcattccaggggttgggaggagagagtgaccaggaacggagctggcagcatggctaaccttgactcaacctgcaactagagcaaggaatgagccttggttgctataagtcacagaggcatggtggatcagggatt

SEQ ID NO: 7413 - DNA, 125 bp, Homo sapiens
  misc_feature 106: n = A,T,C or G
acataatctagtttacagaaaaatcttgtgctagaatactttttaaaaggtattttgaataccattaaaactgcttttttttttccagcaagtatccaaccaactnggttctgcttcaataaatc

SEQ ID NO: 7414 - DNA, 349 bp, Homo sapiens
  misc_feature 202, 330, 340: n = A,T,C or G
ccccgctctcccctgtcccgaaggattactctgcccctcagcggttccagtgccctcaaagcaatctgtctctgaagtactggctatcttctgagcgtgtgccagaagatccagctttgttgaaaagcgaagccgttagtcccttaatacaaaggatcagggatagcagaaatgaaagtataatggaagccagctgggaggngaattccaggtccactttcacccaagtaatggagacggaaggttcatcgaaacttcttcagctgcagatctagaagtcattagctattctagcaaagtatctggtccacagaaaagggggctttcatnaaaagggctngccctgggg

SEQ ID NO: 7415 - DNA, 386 bp, Homo sapiens
  misc_feature 378: n = A,T,C or G
gctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggnagggggtg

SEQ ID NO: 7416 - DNA, 439 bp, Homo sapiens
ggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatgga

SEQ ID NO: 7417 - DNA, 395 bp, Homo sapiens
  misc_feature 172, 186, 211, 265, 305, 330, 381, 388: n = A,T,C or G
acagggcaagtgtttttcttcctaaaaaaagttctttcttttattattttcacctattggctgctgcattttacgaagtggacttcccggtgtttgtttgtttgcaatacactcagtgcagccttaagcaaatgagatcattttcagatttcattttattttttttttcagnctttctacttttgnaataataggaagttagtaggactcncttctctgattaataagcaatttgcagcacacagcgttccactgcggggtttcncgctcacctgaaaacacctgttcccaacctacttcttggngcaagttgaccaaatcgttttaagnggtaactctttccaaccgtagcagggttgttttctgttaagcaaagccganatccagngcaatac

SEQ ID NO: 7418 - DNA, 425 bp, Homo sapiens
cgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacaagggggagaaaggggaaggggttaagttaaataaagaagattatttttgtttcctgacttt

SEQ ID NO: 7419 - DNA, 439 bp, Homo sapiens
cttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagca

SEQ ID NO: 7420 - DNA, 439 bp, Homo sapiens
ttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcagggatgaggatggca

SEQ ID NO: 7421 - DNA, 109 bp, Homo sapiens; identical to SEQ ID NO: 7127

SEQ ID NO: 7422 - DNA, 439 bp, Homo sapiens
ggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggagggaggagaaggggggctccttccctctcctcgaatgacgtt

SEQ ID NO: 7423 - DNA, 361 bp, Homo sapiens
caagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcat

SEQ ID NO: 7424 - DNA, 394 bp, Homo sapiens
caagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcagggg

SEQ ID NO: 7425 - DNA, 417 bp, Homo sapiens
agactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctca

SEQ ID NO: 7426 - DNA, 439 bp, Homo sapiens
tgcaggacgcctggtctgccttgtgggtcctggacggagcccctacctctgcaaagatgacttggagacaggccgtcctgctgtcttgcttctccgccgtggtgctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggcaagcggtcccccaagtcccgagatgaggtcaatgtggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgca

SEQ ID NO: 7427 - DNA, 439 bp, Homo sapiens
  misc_feature 237, 239, 269, 302, 327, 330, 399: n = A,T,C or G
gttatatctcctggcttcagaagcagatactgagcctcaaatctgctaagattgccctgagtgagattcttatctcctgtagagaaaactgaaattgtggaaagacagacacaagctcttattatgtgcatggctgacttgcaatgaaaggcgcacctacagccctgccaggtgtctactgttaaagtgagggcattgattggaaaaaaaaaaatgggaacctgcaacttgggatgngngggaggaccgtgatgaagctggggacacanattttgtaaactttgatgaatctcttttgccanaaggaatagtttttccatccacagnagnggcaacatctcctccctgacccatgctgacatcagcctttccaccttggtctgaggagataaaccctgngctgactgacacaacagtgatggcctcccctgaggcagtt

SEQ ID NO: 7428 - DNA, 439 bp, Homo sapiens
atgatctcaagagatgcagaaaaatttttcaattacattctaatttctttcatgattttaaaactttcttagcagaccaagaacagaacattcttaatctgataaaaggtagctgtaatgacatttagcgcctcagtcatatttaatgataaaatggaaagctttccttttcagatcaggaacaaaacaagggtgcctcctgttaactattttcctcaacagtgctttagaagttctggccagtgtactagtataagaaaaagaaataaaatataaaaattagagggggggaaacctgtccctttatttgcagatgttatgaatatgtatttagaacatgaaagagaacctatggataagtcattagtattaataagagagtagggttcctgagtataaaatctgtacataaaaatcagttcttcctgccagcagaggt

SEQ ID NO: 7429 - DNA, 218 bp, Homo sapiens
atgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcatttatatagaggagacaagt

SEQ ID NO: 7430 - DNA, 439 bp, Homo sapiens
gtgggcgactaccagagcgaagcgagcggcgtgtaggcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagc

SEQ ID NO: 7431 - DNA, 355 bp, Homo sapiens
gtgatctagtcaattgtcagtctaccagagaattaagaaaaacattgaacttcacaattgaaaggggagcaatctgttttttcctctccttcctgaagtttcctggtttatgtcaaatatcttcctcctccactctcttaatatcaagacacagtagaggagacactttttgtcagggttctattaaatattcttccttgggatgtgggagcctacttgacttatatttacacatctaaaaggactacttggtaattcatccaggaagaaagatccactctagtgttgattctttattttatagatgaacaacaatagcaacaaaacatttgaaagctttcaatttgatgacttt

SEQ ID NO: 7432 - DNA, 439 bp, Homo sapiens
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccggg

SEQ ID NO: 7433 - DNA, 439 bp, Homo sapiens
cggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggc

SEQ ID NO: 7434 - DNA, 437 bp, Homo sapiens
atttgggacaccctcttaccggaatccttaccccaggcacaacaccatatgattagaaagagactgccaaaccctcagcttttccgcggagaaagaattggttcatgcctctagcacattcaggagctcagagtagcttgtcttgccagccacatggggggagaatagagatggctgtttggccttgtagattctacagttcctcctttcccatcagcacagagagatcagatgaaaaatctcagctctcaacttcctcctgggagagaaagagttgatccttgtgtccagcgttctaacttctctggggctgccccagagaactggtatctgttttgtcagccttagacctctaacgggtgttgtgcagtctaactgcctgggggagaacagagacagtggcttgggttggtagatgccatagtgccttcccctga

SEQ ID NO: 7435 - DNA, 337 bp, Homo sapiens
gaaaacaataatgaaaagcacctggtgtaaatcctggttcacagtaggtgttccataaatttagctaatttgctactagtgacaattcaactggacctttcccagtagcaggcagtacctatttttaaaaaattagctgttgttaaataggtactattctaagtggttgtaaatagtgtgaaacatctgtttgagttctcacagtaaattacaactgttttacgtctgctttgtttggcattacgctcagttatgacctaagcttgattttattcagctgttaaaatgagttttatcagagatctgaaatgtaatcattgaactttaatggtaaatt

SEQ ID NO: 7436 - DNA, 437 bp, Homo sapiens
tgatcagagtcaggcttctggaaccacaggtggccgaagggtctcaaaggctctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattctttggagaaggtatttgggattcaattga

SEQ ID NO: 7437 - DNA, 439 bp, Homo sapiens
catggctgttatactgacttgttttctttcaaattcatgttagaaaaatctgtgcgtgtgtgtgtgtgtgtgtctgtgtacacaaatatttatattaccgtgtctcagtgctttgagactgtgtgaggcgggggaagagctgttgaggctttttatagataaagttgataatgcttttttgacttggttttctgttaccatcttttttgtctctattatgatatctattatataagtcagaaggagaaatgacacaaatgccagtataccagttcaagataggatcttggtttgatttagctaaaatttaccctacttattggtgcaatttttaataatagaaaaccattcctcattgcttggaatttttatctgcactttccattttgaatattattgttagttgttgaacaccaggtttactctgcaggacaccaag

SEQ ID NO: 7438 - DNA, 439 bp, Homo sapiens
ctcgtgccggcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgac

SEQ ID NO: 7439 - DNA, 320 bp, Homo sapiens
caggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttacgctatctgcggggccattcgtaggatgggtgagtcagatgattccattctccgattggccaaggccgatggcatcgtctcaaagaacttttgactggagagaatcacagatgtggaatatttgtcataaataaataatga

SEQ ID NO: 7440 - DNA, 417 bp, Homo sapiens
ttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggc

SEQ ID NO: 7441 - DNA, 188 bp, Homo sapiens
tcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatg

SEQ ID NO: 7442 - DNA, 137 bp, Homo sapiens
atgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 7443 - DNA, 439 bp, Homo sapiens
caggcatgtgccacgacaccaggctaattttttgttttgacgaggtctccctatgttgcccagtctggtcgcgaactcctagcctcaagcaatccttccaccttggcctcccaaagtgctgggttactggcgtgagccactgtgcctggccaaggctgcttttaatcggttctgattaccaccccaaagtgactggcatgagaatcttaaccccggctgaacagagggaaatttctttggcagtttggccatcttcccagagccagacctacatgtttagtaagaaatgactcaagtatctaaataatcaccgcagcaaggattctcattttttccccttttccaaaagtttgggtgttcttataagtactcagaaaacaattctttgcttaagaaaaaagcttaaaattgggggaaaaaaaattcaagaaaattaaat

SEQ ID NO: 7444 - DNA, 435 bp, Homo sapiens
ctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccg

SEQ ID NO: 7445 - DNA, 436 bp, Homo sapiens
gtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtggggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatc

SEQ ID NO: 7446 - DNA, 439 bp, Homo sapiens
tccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggctt

SEQ ID NO: 7447 - DNA, 439 bp, Homo sapiens
gaaacttccagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcc

SEQ ID NO: 7448 - DNA, 439 bp, Homo sapiens
gccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtggggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcag

SEQ ID NO: 7449 - DNA, 300 bp, Homo sapiens
ccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattg

SEQ ID NO: 7450 - DNA, 109 bp, Homo sapiens; identical to SEQ ID NO: 7127

SEQ ID NO: 7451 - DNA, 313 bp, Homo sapiens
gaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctatt

SEQ ID NO: 7452 - DNA, 439 bp, Homo sapiens
cctgaaattccaaaagcattttccaatggaaacactgttataaatggtgtctcctttccaccaatagtacatccaggtaatagggaataaataggcttctgcaggctggcaaaggcaacctggctcatttataagattacacaaaaaaagcctattccaagttccacacaaccttcttgttgatttctttttccttcttcaaacgttcatttaatatctttttgctgaacctgcatttccttctgcctggaattcactgctctccttgaaagttcctatccgccattcaaaaaccaactgaaaggtcttcagtgaaggttttcctgagaactatcacacttctgttaggccccaaatacacataaaaaccctctcccatcttctatgttccgcagcattttggatctatcttttcacttatctgtttccatcagggttg

SEQ ID NO: 7453 - DNA, 439 bp, Homo sapiens
tgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttcctggggagtgttctgtgcctcttacatgccctggaggcctcatggtctcagtgctgaggcggcacacctgtagcacacctgcgt

SEQ ID NO: 7454 - DNA, 347 bp, Homo sapiens
ctgaatggctgacctgacctgatgtccattcatcccaccctctcacagttcggacttttctcccctctctttctaagagacctgaactgggcagactgcaaaataaaatctcggtgttcttatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattat

SEQ ID NO: 7455 - DNA, 440 bp, Homo sapiens
attttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagcc

SEQ ID NO: 7456 - DNA, 428 bp, Homo sapiens
taaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttattgtggaggaggacga

SEQ ID NO: 7457 - DNA, 183 bp, Homo sapiens
caaggttgggaccatcactggttaactggccttcctgcctttgggctgttgttctttagcccattctgcacactgataccagagtgatgatcctactgtgcccatctgatcagttcacacctctgctcaagaactttctttggctccctactgcctcctgaataaaattcaaacgtagcctga

SEQ ID NO: 7458 - DNA, 292 bp, Homo sapiens
tcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgtt

SEQ ID NO: 7459 - DNA, 439 bp, Homo sapiens
atgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttatt

SEQ ID NO: 7460 - DNA, 122 bp, Homo sapiens
cccagccttatgtttcttttaatgacttctggatcctgagctccctttgcagtctgaaaaaggtattgcagtcagaactgtgtactgatgataaaagcctctggtagcaataaaaagttgtc

SEQ ID NO: 7461 - DNA, 356 bp, Homo sapiens
ctcgtgccgttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatc

SEQ ID NO: 7462 - DNA, 439 bp, Homo sapiens
gcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagat

SEQ ID NO: 7463 - DNA, 439 bp, Homo sapiens
ctcgtgccgcttggttgcagatctgttcgcagaagctacctagaagatatttcattcctttgtatggggagacattcaaatatttgaaatcacaaatctgctcttataaaaaattggctaagtaaattcttctttgactgtgtagaataaacatgcatacagttgtctttgaagtcgttagctcacattgaaaagaaaaagtttagaagaaattaaatatataattttgggggaaaatttatctataattttagctcatagtttacaattcctatatgactgtttggaaggtatttattttagaatggatggatgttccgtattaacctgtaggaagggtttgtgaatattctgttgctctgaattattagcggtctagatctaggctggactttgagaaatatgaaataaaaaaatacctctttggagtgtggtgttg

SEQ ID NO: 7464 - DNA, 169 bp, Homo sapiens
aaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatt

SEQ ID NO: 7465 - DNA, 437 bp, Homo sapiens
  misc_feature 89: n = A,T,C or G
ctttctatgcacagatttcaaggtgctaacatagacacgacagtgtgcgtagtgtggtggattgagactagatgttcaagaagcctcanggaaactggagaggaagggcagaacgtgtgattgttaaaaacgtcagagaaaagggcaaggttaggtaaggcattttgactactcaaggtagaagtctgagaagagagaaagctagtaagtggttactgatatatgtttggaaattctaggggagaactctgggtttttcctaaaaactggaataaaacaagggattttcatttcaagccttagtcgctttggggttcattgtgaaatacgatgcaaaaacagtgttatttgttgtgaagctgcctaagaaaaggtctcacctcgcaccacctcagaagccttacaaaggtgtagggtttttccctgcacctttatcc

SEQ ID NO: 7466 - DNA, 439 bp, Homo sapiens
gcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttga

SEQ ID NO: 7467 - DNA, 415 bp, Homo sapiens
ggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaaggg

SEQ ID NO: 7468 - DNA, 439 bp, Homo sapiens
ccgcatcttcttttgcgtcgccagccgagccacatcgctgagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgacgcccccatgtt

SEQ ID NO: 7469 - DNA, 439 bp, Homo sapiens
gttcaagtgtcctctccaacttgagaagctctcccttctcctggtgtctatgatccaaggctgtctcctgtttaccctcagcctccttccccagtgtttactcagcactggaacatcctacccaggcctactgcccttaaggctggtctgcatgtagaacccatattcatccaatcttctgtcaaaaaattgacttctgtaactaacggtagagtagaatgaactcttttgtacaatttaacttcagtaaatgaatttctaattgccatttttactttaggtcagaggctgtaaaacttgaagaaaggagccaagatcgccagaaatacagtggtggtattatagcaaacatgagatcctaagtcctttttcaaagcgtgcctgctccctgcaagaggaggaacagtggccaacccactcaatcagctgttgccatgtg

SEQ ID NO: 7470 - DNA, 195 bp, Homo sapiens
cataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttattt

SEQ ID NO: 7471 - DNA, 322 bp, Homo sapiens
cgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 7472 - DNA, 228 bp, Homo sapiens
ggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttg

SEQ ID NO: 7473 - DNA, 116 bp, Homo sapiens
ctttgagaagaatttaattatgtctcatgaggtatcaaactatgtaattttgtccttgttatttttgtttcctttgtaatttacttgatgagtttatatcttcattaaagaatgtt

SEQ ID NO: 7474 - DNA, 243 bp, Homo sapiens
  misc_feature 239: n = A,T,C or G
aattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcncaag

SEQ ID NO: 7475 - DNA, 274 bp, Homo sapiens
atggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggtttcgttggcttgtaagaacctaaagttcttatgagattgtccaaaacaaagaaacatgtcagcagggcctatggtggttcccatgtgtgctaaatggggttccgtgg

SEQ ID NO: 7476 - DNA, 135 bp, Homo sapiens
ccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 7477 - DNA, 458 bp, Homo sapiens
ggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttc

SEQ ID NO: 7478 - DNA, 313 bp, Homo sapiens
  misc_feature 219, 288, 302, 309: n = A,T,C or G
gacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcanaaacacaggcaaggaaattggaactgccacccagcccagcatggtggctcaattggttggttgcgttgncagttgtctcttcnttttgtnaagg

SEQ ID NO: 7479 - DNA, 437 bp, Homo sapiens
gacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtacttttt

SEQ ID NO: 7480 - DNA, 439 bp, Homo sapiens
tcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgttt

SEQ ID NO: 7481 - DNA, 436 bp, Homo sapiens
gcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgcctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatat

SEQ ID NO: 7482 - DNA, 270 bp, Homo sapiens
ggagggtggagtgggcctcgggtccccctgaactccctgtatatctgtataaataacgggattttcatggcgccgccccacccgcattatcactgcgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagt

SEQ ID NO: 7483 - DNA, 439 bp, Homo sapiens
cctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaacctggtttttttgggttttttttt

SEQ ID NO: 7484 - DNA, 345 bp, Homo sapiens
tgaactcctaggttcaagcaatctttctgactgggcctcccaaagtgctgggattacaggcgtgttacaccctgtgcccagctaattttttgtatttttagtagagacggggtttcaccgtgttagccaggagttcaagaccagccttagcaacatggtgaaacaccatctctaccgaaaatacgaaaattatccgacttgatggcaaatgcctgtaatcccagctttccagctacttgaaaggctgaggcaggagaatcagttgaacctgggaggcggaggttgcagtgagctgagattgcaccactcactaaagcctgggcaacgagagtgaaactccatctc

SEQ ID NO: 7485 - DNA, 436 bp, Homo sapiens
gccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtg

SEQ ID NO: 7486 - DNA, 452 bp, Homo sapiens
ccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtg

SEQ ID NO: 7487 - DNA, 169 bp, Homo sapiens
ccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggt

SEQ ID NO: 7488 - DNA, 326 bp, Homo sapiens
tccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggc

SEQ ID NO: 7489 - DNA, 437 bp, Homo sapiens
  misc_feature 426: n = A,T,C or G
gccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcanctgccaacaag

SEQ ID NO: 7490 - DNA, 360 bp, Homo sapiens
  misc_feature 355: n = A,T,C or G
ctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggggngaggg

SEQ ID NO: 7491 - DNA, 276 bp, Homo sapiens
gttgtcattttttgtcttagttcaccgtgatgttctcagtgttatgtgcttacagtctgtgccatctttcagactttcctctaagggggaaatggctttaatggagctctcaatgtaaaatagatgcattaacaaaatatggacgagagtagggagatcatcacaaagaatagctaatggatgctgggcttaatacctaggtgatggggtgatctatgcagctgtttaccatggcacgtgtttaactatgtaacaagcctgcacattaacccctga

SEQ ID NO: 7492 - DNA, 441 bp, Homo sapiens
cagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttgggg

SEQ ID NO: 7493 - DNA, 439 bp, Homo sapiens
  misc_feature 339: n = A,T,C or G
ggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctanatattatcctactgaagatgtgcctcgaaagctgttgagccacggcaaaaaacccttcagtcagcacgtgagaaaactgcgagccagcattacccccggg

SEQ ID NO: 7494 - DNA, 448 bp, Homo sapiens
gaaaaaaatgaatgaaaaatatcttacagaaatgtttaaatattgattacatgttgaaatgataacattgtgaacatattggttagatagaaatatattaccaaaatgaatttcacctgtttctttttgctttttaaatgtggctcctggaaatgtaaactcatgtatgcagctcacatgctttttctattggacagtgctgcgttaggcaattaaacaagcaattacaatgtaaactcataaaattatggtgagcattaaatgagatactgccagtaaaatgcttagttcagggcaagcactttgtcaatattagctacagctaagcatcagacactggactgcaccccaacttactcctttccctgtctcagagctgagctctagttcccattgctgagggtgatttctttcctaggagtctcctgggtctttcatgtaaataggg

SEQ ID NO: 7495 - DNA, 430 bp, Homo sapiens
tataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcatttttattctccagtactgacttgtggggaaagcatactttttcactgccaggtactgaatgcagaggctcagtgaagtatatatgtgggaagtgcatgcatttcgtttattagcaaacatagctggattaagacaaagttgttggttttggaaaggggtta

SEQ ID NO: 7496 - DNA, 439 bp, Homo sapiens
ctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttat

SEQ ID NO: 7497 - DNA, 428 bp, Homo sapiens
agagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattggagggagtaggagactaaaagaatg

SEQ ID NO: 7498 - DNA, 328 bp, Homo sapiens
  misc_feature 199, 265, 271: n = A,T,C or G
cccacctgaagtttttataaatgtccattaccctgcactctcacccaaatttccatttagatttttgcctatctgatgtgattctaaaggaaacaggtttacttgacactatccttatattttattgagacatgttcaatggatgcatctcagttttatgcttttgagactctttttgagggcttgggtttttttttgngtgtgtgcccttatgcatagtcaactagtaagctgtacattgattatattctcttttgatgtatgngtttgngtgtatctttatatatttaggtttatatcatcaaatttattaaaaccctttatattc

SEQ ID NO: 7499 - DNA, 357 bp, Homo sapiens
gcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 7500 - DNA, 121 bp, Homo sapiens
tcaaaagcttaccagtgtggacttggtgttagccacgctgtttactcatacagtacgtgtcctgtttttaaaatatacaattattcttaaaaataaattaaaatctgtatacttacatttc

SEQ ID NO: 7501 - DNA, 439 bp, Homo sapiens
cgccgccgcttgtgctgcagccatgtctctagtgatccctgaaaagttccagcatattttgcgagtactcaacaccaacatcgatgggcggcggaaaatagcctttgccatcactgccatttaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccac

SEQ ID NO: 7502 - DNA, 375 bp, Homo sapiens
cctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtg

SEQ ID NO: 7503 - DNA, 260 bp, Homo sapiens
gcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactca

SEQ ID NO: 7504 - DNA, 234 bp, Homo sapiens
gaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgtaaaat

SEQ ID NO: 7505 - DNA, 401 bp, Homo sapiens
ccagacctcagcgtgtgggctgagatgctggacaaatcgcccatcagatacatccctcaggtgaagacaccactgttactgatgttgggccaggaggaccggcgtgtgcccttcaagcagggcatggagtattaccgtgccctcaagacccggaatgtgcctgttcggctcctgctctatcccaaaagcacccacgcattatcagaggtggaggtggagtcagacagcttcatgaatgctgtgctctggctacgcacacacttgggcagctgaagccctgccattctgcatgagctgatcagcctgtgccacacttcgctcttgaggagctcaacggtctggcagggcagcaggaggctttctgggctctggactccacggatgcgtgggcagaaggaatg

SEQ ID NO: 7506 - DNA, 319 bp, Homo sapiens
ggaatttgagctatcccagtcaagagactactttattttacccctatcctgtggcatatagtaactgctaaggtacaggctgaactgaactaggctagaagacagggttttgcaggtatctgatgatgtatcttagaagttatgtctaactccaaatactgagtcctttccattatacatcaaactaccttctacccctataatatttctaataaagaaatattagagggaatgtaatgatttaagagagaggtggagaacttggtaataaagacccaatttatgcctccgatttaactgcttggctttttaaccaggt

SEQ ID NO: 7507 - DNA, 462 bp, Homo sapiens
tgagaagccatgagcagcaaagtctctcgcgacaccctgtacgaggcggtgcgggaagtcctgcacgggaaccagcgcaagcgccgcaagttcctgggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggattgagg

SEQ ID NO: 7508 - DNA, 438 bp, Homo sapiens
tgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctat

SEQ ID NO: 7509 - DNA, 342 bp, Homo sapiens
gttttaagtcattcaggaaaatctaaacttttttttccactaaggtatttactttaaggtagcttgaaatagcaatacaatttaaaaattaaaaactgaattttgtatttattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaat

SEQ ID NO: 7510 - DNA, 439 bp, Homo sapiens
gcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggt

SEQ ID NO: 7511 - DNA, 365 bp, Homo sapiens
  misc_feature 329: n = A,T,C or G
ggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcanaagtgtctatagaacaataaaaatcttttacttctg

SEQ ID NO: 7512 - DNA, 359 bp, Homo sapiens
gcggtggctttccagattttatgccagttgcaccagcatgcagaatatttgtaatgcatttcaaagtggatataatggcaccctttgtcagaatcacaaagctcactgcggcactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagcctgggcaacagagcaaaacccc

SEQ ID NO: 7513 - DNA, 430 bp, Homo sapiens
gcaaagttatttaacatatgaggaaataatctagagtaacagcacaaataacaaacagaaggactaaccccaaagaacttcagattattagcattaaagttttataattttaagattttagaagctggaaaacagatagtctagtgacaactgatttagcaaacaggagaaaccgtactgtaaaactgcagagaggagcactagcaagaggctctctgccccttccctgcttggtctcgaaacactaacagcctggctcctactccctaaattgggggtggcagtatacctctgggtaaactgagcagtcggaagatgaagtcatgtgggggtgatcctcaaatgaaaaaattcattccttatcttgcccccactcctcacctaactgccagtcaactatttaatgtgaacaaaaagccaggtatttggg

SEQ ID NO: 7514 - DNA, 401 bp, Homo sapiens
  misc_feature 264, 392: n = A,T,C or G
cgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattancccacataccagtaacttaaagatgggatggagttgtaaagtgcttttataatacaatataattgttaaaggcaagggttgactctttgttttattttgacatggcatgtcctgaaataaatattgantcaatatgg

SEQ ID NO: 7515 - DNA, 357 bp, Homo sapiens
ggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 7516 - DNA, 439 bp, Homo sapiens
  misc_feature 436: n = A,T,C or G
gcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaaaaacatgggnggc

SEQ ID NO: 7517 - DNA, 165 bp, Homo sapiens
  misc_feature 102, 161, 163: n = A,T,C or G
ctgagacagagttttgctctgtaacccaggctggagtgcagtggtgagatcttgacttactgcatcctcccccctcccaggttctagcagttctcctgcctnaccctactgagtagctgagactacaggcatgtgccaccacacctggctatttttttttncntg

SEQ ID NO: 7518 - DNA, 398 bp, Homo sapiens
  misc_feature 370, 372: n = A,T,C or G
ctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttcccctgtacagtanantttccaaatgtaataaactttaatat

SEQ ID NO: 7519 - DNA, 408 bp, Homo sapiens
gtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaattccagctgtacaactgaccagtgagttatctgtcatcactgttgcccacatacccgtcctt

SEQ ID NO: 7520 - DNA, 415 bp, Homo sapiens
ccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaacagattacatgaaatcaataccgtgaggatggtgtgaccc

SEQ ID NO: 7521 - DNA, 437 bp, Homo sapiens
ggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaagggtgggggagtctgtgttccacacaacccgctgggtgccccccttgatcggggagctgtacgggctgcgcaccacagaggaggctctccatgccagccacggcttcatgtggtacacgtaggccctg

SEQ ID NO: 7522 - DNA, 334 bp, Homo sapiens
  misc_feature 313: n = A,T,C or G
gaaacgcctttacatttgtgcggatagagaagttaactctccctcatatgtcactgtgctaccataatccctacattttctgtctgttctagtctaagaatattgttatagatggaagttaggaccattagcccacagatgcgtgtattctctcagacataccggtgtagatgccatatttctgatgtcttcttaatgtctgtgaaagcaactggcatctacaataaatcacacttagaactggttagaggactccctcacttttgttgtccatgtggttcccttccgtggaccagccgtaataaagagccangggagtgatggtggccacgtg

SEQ ID NO: 7523 - DNA, 435 bp, Homo sapiens
tagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttcc

SEQ ID NO: 7524 - DNA, 257 bp, Homo sapiens
ctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcaga

SEQ ID NO: 7525 - DNA, 303 bp, Homo sapiens
gctaaatagaacacaagattttgaaagacttgagtcaaaaacagtaggcaaatcaaagaagcaatcccaaacagatgctatctttcagaaattaacagattatttcacctgcaacatattcccatcctagaaagggcattcctgcattacaatcatttatgcttggataaaggcaaaacgaacagatgtccaagaaccaccctcattacctgaggcctatggcagaaacatgtctcctttcttggagtctgagtagacttgatcaaaatcacccacaggtataaattcacattataatatcac

SEQ ID NO: 7526 - DNA, 437 bp, Homo sapiens
  misc_feature 177, 243, 287: n = A,T,C or G
gcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaanacctcacgcctccccatcattgacattgcacccatggacataggagggcccgagcaggaattcggngtggacatagggccggtctgcttcttgtaaaaacctgaacccanaaacaacacaatccgttgcaaacccaaaggacccaagtactttccaatctcagtcactctaggactctgcactgaatggctgacctgacctgatgtccattcatcccaccctctcacagtttggacttttctcccctctctttctaagag

SEQ ID NO: 7527 - DNA, 314 bp, Homo sapiens
ctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggccc

SEQ ID NO: 7528 - DNA, 245 bp, Homo sapiens
gaaaaatgggctcaataatgagcatagtgtatgcccatggaaaagagaaagcattctcattaagcatttgtggtgatgatgatgatgatgatgatgatgatgacatcatcaaaagctccaaagggtaaattgctgcatttgccaaaggcagaactggatgagatgcatgcttcataaaataaatcaagggtagacaggatggcttcatcgactcttccttcagaggataagcagcaatttggaat

SEQ ID NO: 7529 - DNA, 336 bp, Homo sapiens
gtagcacggttagtagagcttcagatctgagggaatgtactcttgtcaaataaaagcctgtttaaatgggaacagttcactgtctgagcgttaagagaaaactgtctaaatagcatcaaggtggcaacacatagcgacataagctgggaattcaaagaaaagctgtgaccctcagtatggaattcagattgctttgcacaagggaggaaagccttcctctggactggggtgaatatgaagctcttgaattactgctgtgtggcttctgctttcacccatcatagccttgctctttaaaatgtttggcaaaaatcctcattttttgagggttttgtg

SEQ ID NO: 7530 - DNA, 415 bp, Homo sapiens
  misc_feature 411: n = A,T,C or G
gttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgngttg

SEQ ID NO: 7531 - DNA, 174 bp, Homo sapiens
ctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaat

SEQ ID NO: 7532 - DNA, 176 bp, Homo sapiens
cctgtctctactaaaaatacaaaattagctggatgtggtggtgcacgcctgtaatccagctactcgggaggctgagtgaggcaagagaatcgcttgaacctgggaggcacaggttgtagtgagtcgagatcacgccactgcactccaggctgggtgacagagtgagatattgtctc

SEQ ID NO: 7533 - DNA, 424 bp, Homo sapiens
  misc_feature 308: n = A,T,C or G
caaacattcataatgaaataaggagaaaatacttagaacaattacagttcttgtttctgtaactggtcacatggttattgctggtatttataacttatctattcaatttttttttcttgtttgccttctgcaagaacctcatgattctttacccagcagggtgacccaaaggtttggcccatttgtagttctgcctggattgcatttttgtagttatccattggccctaatcacaacgtggagtaatactgagaaacaccctaaggtatctcctgtactgtagacatactcttcaattcttccattgnggagtagtagttcagtttctccttgatagtccagatgaatcacctcagccaacaacaccacaactccctctttacctgttgactcagaggcacaaggagcccagagtagctgggtg

SEQ ID NO: 7534 - DNA, 439 bp, Homo sapiens
gtggcttaatccttgtcatgttttcggctcatggacacaaggacacattttcatgccttctctcacagggctctgcggctccggttcacttctgtgtctttacactcccttcacagagacacttgctcccccttctctcgttcttggcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggag

SEQ ID NO: 7535 - DNA, 222 bp, Homo sapiens
ccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgacc

SEQ ID NO: 7536 - DNA, 425 bp, Homo sapiens
  misc_feature 405: n = A,T,C or G
acgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcgggaattganggatgtcaccccccatcccc

SEQ ID NO: 7537 - DNA, 446 bp, Homo sapiens
ctcgtgccgcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaagg

SEQ ID NO: 7538 - DNA, 442 bp, Homo sapiens
  misc_feature 293, 400, 422: n = A,T,C or G
ccgcctgcagctgaacgacctcctcatcaaacctgtgcagcggatcatgaaataccagctgctgctcaaggattttctcaagtattacaatagagctgggatggatactgcagacctagagcaagctgtggaggtcatgtgctttgtgcccaagcgctgcaacgatatgatgacgctggggagattgcggggatttgagggcaaactgactgctcaggggaagctcttgggccaggacactttctgggtcaccgagcctgaggctggagggctgctatcttcccgaggtcganagaggcgcgtcttcctctttgagcaaatcatcatcttcagtgaagccctgggaggaggagtgagaggtggaacacagcctggatatgtatacaagaacagcattaangtgagctgcctgggactgggangggaacctccaaggtgaccc

SEQ ID NO: 7539 - DNA, 177 bp, Homo sapiens
ctcgtgccggacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaaca

SEQ ID NO: 7540 - DNA, 334 bp, Homo sapiens
ggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccac

SEQ ID NO: 7541 - DNA, 439 bp, Homo sapiens
ggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtt

SEQ ID NO: 7542 - DNA, 147 bp, Homo sapiens
cagatgccttcagattgtttttcagccttttcctggcctctcttttgagtctgtcatttatctaattcaggcatacctttcttgacctagtagatgtctatcaactgttgtgtccacacctagaaaatcaagtgccctattaagaag

SEQ ID NO: 7543 - DNA, 125 bp, Homo sapiens
aataaacaaacatgccctctaatatatgaattcatcacacaacacgcacactgtccccacaaacacctttttggtgtcaagaagaaaaagactagcttcactgaacagagaaatgctggacagtg

SEQ ID NO: 7544 - DNA, 439 bp, Homo sapiens
ctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggtaaatttcctctccaaagaagaccaaaggaatcattttagaatacttacatatttgggaatgcaaggactctatttagaagactgtaaggatgctagtactagcaattgctgctgcagtagaaatgtcaaggagttggaggaccggagagagagccactggctctcactgtatacccttttgttccatgtacttatgttacctagtttaaataaatacattt

SEQ ID NO: 7545 - DNA, 439 bp, Homo sapiens
cccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggac

SEQ ID NO: 7546 - DNA, 440 bp, Homo sapiens
  misc_feature 301, 304: n = A,T,C or G
tagaatttagtgatactggctcagaagaatttaagttctattcagctttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagnagntccagtcctaactttctgaattatttttaaagatcttctctaacaagctatgggaatttggcttcatactctttctttgcaacagcagtgttctgggtgataattttgaattgatacctgttcctttttctgggtt

SEQ ID NO: 7547 - DNA, 215 bp, Homo sapiens
taacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 7548 - DNA, 460 bp, Homo sapiens
  misc_feature 353, 433: n = A,T,C or G
aagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcanatgtgcttttcctcactttggagatgaacactctgggttttacagcattaacctgcctaaccttcatggtgagaaatacnccatctctcttctagtcatgctgtgca

SEQ ID NO: 7549 - DNA, 439 bp, Homo sapiens
ccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagtttgtgtagtagttaaggactatggcaaggagtctcaggccaaggatgtcattg

SEQ ID NO: 7550 - DNA, 438 bp, Homo sapiens
tgcaagcaagtttatcagagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaaccttactggaatcaagccctgcaggagctgaggcgccttcaccatgcgtgccagggggccccggtgcttaggccatccgtgtgcagggaggctggaccccaggcccatatgcagcaggtgacttccagcctcaagggcagccca

SEQ ID NO: 7551 - DNA, 287 bp, Homo sapiens
caaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttta

SEQ ID NO: 7552 - DNA, 121 bp, Homo sapiens
  misc_feature 19, 20, 23, 67, 101: n = A,T,C or G
caaatccatgcacctgtannaanctcatttttgacaaaggtgacaagaacatacactggagaaaacnaagtctcctcaataaatggtgctgggcaaactgnatatccatatgcaaaagaat

SEQ ID NO: 7553 - DNA, 381 bp, Homo sapiens
ccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagctaatgtataataaaaccatgtaaagttttgttgt

SEQ ID NO: 7554 - DNA, 433 bp, Homo sapiens
cttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccaggggtcggggagggccagccagtgtgcctagctcctccccaggcacgtcagt

SEQ ID NO: 7555 - DNA, 287 bp, Homo sapiens
atctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 7556 - DNA, 268 bp, Homo sapiens
cccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctacccc

SEQ ID NO: 7557 - DNA, 439 bp, Homo sapiens
ggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtagg

SEQ ID NO: 7558 - DNA, 284 bp, Homo sapiens
  misc_feature 100, 101, 250: n = A,T,C or G
gaccccagatctcctaggcccaggctctctcttgaccccagagaagccactgtcaggaaaggaagtgaaccctactgaagccagagaattcaccccggcnnaaagcaggccctctgggtccagcccctcattccacaccacaccagtattgcatccatctactgcagctacacatcctgagggcagcaccacccactctggcctgctggcccatcgcaggactagcccaggcacctgccgggcattgcangatatccagtggggcctgtgactgctccctgatg

SEQ ID NO: 7559 - DNA, 417 bp, Homo sapiens
aaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataata

SEQ ID NO: 7560 - DNA, 437 bp, Homo sapiens
caattcacttaatataaatgaaagctaaacaaaagctgtaaaagtgatatacaaatgaaaaatagtaatactaggattaggatgttaaatgaacactcatgactgaaaggtcttagaaacgagatgaaagaaagctaagaattagccattatggtgtcaattaataaatacaaagatgtactcagaacctagtagaatatatgcttgtatgcttgttttctttcagcggatggtcaagagtgtaggtgagtgtttcaagtgaaactatttgtttgacatacagaaaggtaaaagaacagaatatttgaagctaaaataactataaaaagctcagaacaactcctttgattattcactttgaataagtataataaaaacatttttttccctgtctggtggacaaaggtaaaaaataacatttaattacagtaaaatac

SEQ ID NO: 7561 - DNA, 346 bp, Homo sapiens
gacctgtttgccaacatggtgctgtctggtgacacccccgtgtacctgggcatcacctacatgatgcagaagatcacgaccctggtgcccagctccaagaagatcatcaccttccctgagcgcaagtcccttgtgtggattggcagcaccatcctggccgccttccagcagatgtggatcatcaagcagggagtaggatgaatcaagcccctgcatcacccactgcaaatgcttctaaatggactgcaagcagacgcgtgtcatgtgcttcatggattaatgcagaagtataaatttgcccctggcaaatgcatacacctcatgctagcctcaataaaccagaata

SEQ ID NO: 7562 - DNA, 416 bp, Homo sapiens
ggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcacc

SEQ ID NO: 7563 - DNA, 456 bp, Homo sapiens
aatataaaacagaagaagcttttcccccctcaagattaacatccctaaccgtgctgttctcccacctcttgtttcaattgtgtttcaggtcgtcatgttggcaatgtacaacttgtctctggaaggaagtggacgtcaaggttatttcaggtggaaagaagatatctgtgcttttattgagaaacattggacttttttactagggaataggtaatgtgtttttaaaaaatcttatacttcaaggaatatgtaaagaatgaagtatacaggatttgagacagcctaatgtagacttgttagagatttattttaatttttttgagatagagtctcccaggctggagtgcagtggcatgaccatagctcactgcatcctcaacctcctgggctcaagtagtcctcctgcatcagcctcctgagtagctggggattacaggtgtgcaccaacatgcctgg

SEQ ID NO: 7564 - DNA, 167 bp, Homo sapiens
gaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggcc

SEQ ID NO: 7565 - DNA, 274 bp, Homo sapiens
ctgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaat

SEQ ID NO: 7566 - DNA, 289 bp, Homo sapiens
ccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagt

SEQ ID NO: 7567 - DNA, 131 bp, Homo sapiens
  misc_feature 120: n = A,T,C or G
gctttgtcctgcatgaacagagttgatgaaagtggggtgtgggcaacaagtggctttccttgcctactttagtcacccagcagagccactgggagctggctagtccagcccagccatggngcatgactctt

SEQ ID NO: 7568 - DNA, 435 bp, Homo sapiens
gtcctcattgatttattatctgatataagggacatataaggagacatatcaatctcaaaaattgtctcaaaaggttttattttttttaaccacagataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatattgttctcaggcgctgtggtctcaccttccactggggcaacaatgggc

SEQ ID NO: 7569 - DNA, 310 bp, Homo sapiens
gctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtca

SEQ ID NO: 7570 - DNA, 434 bp, Homo sapiens
aaaatattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctcctcctacaaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcag

SEQ ID NO: 7571 - DNA, 439 bp, Homo sapiens
attgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaat

SEQ ID NO: 7572 - DNA, 434 bp, Homo sapiens
gccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatct

SEQ ID NO: 7573 - DNA, 322 bp, Homo sapiens
aagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 7574 - DNA, 461 bp, Homo sapiens
caacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagca

SEQ ID NO: 7575 - DNA, 101 bp, Homo sapiens
gttttaagttattagtttttaaaatcagtactttttaatggaaacaacttgaccaaaaatttgtcacagaattttgagacccattaaaaaagttaattgag

SEQ ID NO: 7576 - DNA, 388 bp, Homo sapiens
gtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 7577 - DNA, 388 bp, Homo sapiens
tgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatt

SEQ ID NO: 7578 - DNA, 345 bp, Homo sapiens
  misc_feature 137, 262: n = A,T,C or G
gtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgnggcaaaaccaagatgaagagacgagctgtggggatctggcactgtggttcctgcatgaagacagtggctggcggtgcctggacgtacaataccacttccgctgtcacggtaaagtccgccatcanaagactgaaggagttgaaagaccagtagacgctcctctactctttgagacatcactggcctataataaatgggttaatttatg

SEQ ID NO: 7579 - DNA, 437 bp, Homo sapiens
  misc_feature 43: n = A,T,C or G
ggaagatttatagggtagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagt

SEQ ID NO: 7580 - DNA, 423 bp, Homo sapiens
ataaataaggattctgtttttgttgagtactccatccttagcacctaaaacaatgttaaaacaactagatgatactaaaagcatattttttgaatgcatgaatgatcataatgaagaaaagcttactattttatccccttgcaactaaggaataaggaaggggaaaaaaagtccattttcaccttttgacctcttcttgcccttcaccaaaaactgagttccctggtgttttttctctcatatgctgatgtggtgcaaatagcctaggcttgagggtgagggtgaaggtcgagttcctatgattgtatgctccattgcagctcttgacagtctattagaaatccataaccatagatacttctgcttctagggctttctttgtgagcctaagatttaactaccaacacctatgttgtcatgtgg

SEQ ID NO: 7581 - DNA, 207 bp, Homo sapiens
agagactgaagattcgaggctcccctggccaggggcagcccttcaggagctccttagtaaaggacttatcaaactggtttcaaagcacagagctcaagtaatttacaccagaaataccaaggggtggagatgctccagctgctggtgaagatgcatgaatagggtccaaccagctgtacatttggaaaaataaaactttattaaatc

SEQ ID NO: 7582 - DNA, 437 bp, Homo sapiens
  misc_feature 367, 373, 375, 400: n = A,T,C or G
gtgtattaaaaagggatcacaccaaaaaatgaattgcaaaattcatgacctcatgtgaaagatagtgactgtggtagatagaataatggcccctaaagatgaccacatcctagtccttggaacctgtgaatctgctactttacttggtaaaaggggctctacagatatgattaagttaaggattttgagatgggaaggtcatcctggattatctgagtgggtgcagtgtaatcacaagggtcctttaaagatggaggcagactgtcagaggaattggcacaaaagcagaggtcacacacacacacggggggatagagagagagagagagagagaggaagatgttacactgctggctttaaagatggnggaagngnctattaagtcaagcaaggcatgcancctcaaaagctccaaaaaacaaggaaatgaccttcag

SEQ ID NO: 7583 - DNA, 439 bp, Homo sapiens
gtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcatagggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaagggggaatgtgttcaaaaacaagcggattctcatggaacacatccacaagctgaaggca

SEQ ID NO: 7584 - DNA, 204 bp, Homo sapiens
gcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacagg

SEQ ID NO: 7585 - DNA, 125 bp, Homo sapiens
ggcacctgtagtcccagctactcgcgaggctgaggcaggagaatggcgtgaacctgggaggcggagcttgcagtgagcagagattgcgccactgcactccagcctgggtgacagagcgagactcc

SEQ ID NO: 7586 - DNA, 279 bp, Homo sapiens
gtgaaactacatgggcctgtagttttcactgtgggaaggatttcataaattcagtttatttaatagatatagggctacttagatttccagtttcttcttgtgtcagttttggtaagtagtatttttaaagaaatttgttcattgtaatttttccattgattagcataaagttattcaaagtatattatcacaaatgaaaaaggggttaccgcagattatgtagacattaagtaataatatactttgaataactttatgctaatcattgtattttttccc

SEQ ID NO: 7587 - DNA, 395 bp, Homo sapiens
  misc_feature 54, 349: n = A,T,C or G
ggcgagggctgacattgaaggtgaccctggaagttggggccctgctggacatgngtcaggctgtggcgtccagctgtgtgagatggaaaaccattctgttgtcatgactccaacgtgtctttacttctcttataggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaaganggtgttgaagagatgtgcgcaggagtacctgtccccggggtgaaga

SEQ ID NO: 7588 - DNA, 417 bp, Homo sapiens
  misc_feature 84, 214, 320: n = A,T,C or G
gttggggggacccttttctttctagttgtctttaaggaaaattaattttacttttttttttgttctggccgaaatttttatganatatctctcacttgtcttccactttgaaccggttaaagctcatagctgtcagctctgaatgaggaggggagaagcccctgggtctttctttgaaaggaatccgctgcttgagggctgcctccctcatggngtgcgtgtcgtttctcttcctgacgcatcttgtgatatcagaggtaactatgcaaagcatccaggcggttctgaatgtgaagcactacacccagcagagtcccggngccctctgtccccactgccggcccatgttctctctccggaggtcaccaaggaatgcacaggtttcgactaccagaaaggggagtcccttgggttctt

SEQ ID NO: 7589 - DNA, 209 bp, Homo sapiens
agcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttag

SEQ ID NO: 7590 - DNA, 363 bp, Homo sapiens
gcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtg

SEQ ID NO: 7591 - DNA, 458 bp, Homo sapiens
gggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacacc

SEQ ID NO: 7592 - DNA, 437 bp, Homo sapiens
  misc_feature 401, 415: n = A,T,C or G
ggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacntatagaagaacggngctattcagtaagttctctttc

SEQ ID NO: 7593 - DNA, 461 bp, Homo sapiens
ctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagt

SEQ ID NO: 7594 - DNA, 343 bp, Homo sapiens
gtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaattta

SEQ ID NO: 7595 - DNA, 439 bp, Homo sapiens
cttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcatggtttcatgtaagctgtg

SEQ ID NO: 7596 - DNA, 439 bp, Homo sapiens
tggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgc

SEQ ID NO: 7597 - DNA, 439 bp, Homo sapiens
gtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcac

SEQ ID NO: 7598 - DNA, 437 bp, Homo sapiens
  misc_feature 382, 401, 418, 423: n = A,T,C or G
cagcattgatacattattattaacgcaagtccttagtttacattagggtttactctttgtattctacagttttatggtttttcccaaatacatgtcaagtatctactgttaaagtatcatacagaatggttttactggcctaacatcctttgtgctccacctattcatccttcctccccccacttccccaaccccaggtaaccactgatctttttaatcgtttttttactctgcgtttttcacttaacattatatcacaaaaatttcccagggcatattaagtagtctccaaaaaccatagttttgaaattacggtttttggagaatacttgggatgctgaggcgggaagattgcatgagtccaagagttcaaggttattgngaggtattgattgctccantgtactccagcctgggnggcangagcaagacccctg

SEQ ID NO: 7599 - DNA, 206 bp, Homo sapiens
catgaacaaccatgcctggtcttttttattttttattttgagacggagtcttgctctgtcttccaggctggagtgtgtgatcttggctcactgtgacctccgcctgccagcttcaagaaattctcctgcctcagcctcccgagtagctgggattacaggcacctgttaccatacccggctaatttttgtatttttaatagagacag

SEQ ID NO: 7600 - DNA, 341 bp, Homo sapiens
gacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccac

SEQ ID NO: 7601 - DNA, 364 bp, Homo sapiens
cggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaaggggccaggggtggggctggggctggaga

SEQ ID NO: 7602 - DNA, 222 bp, Homo sapiens
ccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactagg

SEQ ID NO: 7603 - DNA, 111 bp, Homo sapiens
cttcaccttgccagcaatttttgtatattgtggcctggtcatatacaaaacttgcttgatactaatattgaaggatcttacagagtttcataatgttaaaataaaacaagt

SEQ ID NO: 7604 - DNA, 437 bp, Homo sapiens
ccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccac

SEQ ID NO: 7605 - DNA, 439 bp, Homo sapiens
caggatcttcctggcaggaatatgataggccacctgcttcttttaggggaaaacattctgttttgagggtaagagaagatttgagtgaggtttgctttggtcatggcttctgaagcttgataattgcagaagttccatctgtaagatgctcgattaaaattctagatgaattgagtaatctccacaaggccaagagaatctaatgttcttgaatttgttccatattcacgatagatctagtaaccatgtgtagtaatcagacaaattctccaaaacatacagccagctggattcctgaactttaacaaagtttttatgctgactgcttctgcaacctcactaactagccagcctagataggaaactcccttcttaattcattcataaagtacctttcgatatatagacccaatctctaataaaccttttggagatcaat

SEQ ID NO: 7606 - DNA, 319 bp, Homo sapiens
gtcatgtggccatcttgagtctactctgtcgctcttgtgccctagcaccccgagaactgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 7607 - DNA, 149 bp, Homo sapiens
  misc_feature 39: n = A,T,C or G
ctctaatggatatgtttatataattccaaaccctcaggngtgtgaatgcatttaaaaacattaatgggaaaataatggctgataatatttaattgatcatgcaattccttcaattatgatggaaagacttgaactttctgaaataaaac

SEQ ID NO: 7608 - DNA, 342 bp, Homo sapiens
  misc_feature 245, 265, 303: n = A,T,C or G
catcttcccattgccagtgcctacgaagggcttgacccattcattgttagacgctcagtaagtgtgtattgaggcagccctctgtgccactccagggctctttccactaaatcatgagtatgttggtttaccagatggaatgagtagcctcttctttggatacataaacacccgatggatattgtgggtcactgtggagggagaatgaacgtatgggatccctgacctgtggttactggaaaacngttgacatttagagagaggntgaattcttgggcttcccgtagcccccatcctgagtgngccaacaggggactagaagcatctctagtctgcaaagcg

SEQ ID NO: 7609 - DNA, 439 bp, Homo sapiens
  misc_feature 400, 438: n = A,T,C or G
ctcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgancacaatgcataatgtctttaaaaagcatgttgtgatgna

SEQ ID NO: 7610 - DNA, 439 bp, Homo sapiens
cggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagcctggtttggggtgaccccataagtgagtctggccttgactcacttttctggcttgtctcacagtagcaggggatctgctgttctccaccc

SEQ ID NO: 7611 - DNA, 274 bp, Homo sapiens
aagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaag

SEQ ID NO: 7612 - DNA, 416 bp, Homo sapiens
gttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatgggtatctatgtctctgaaaaaggaactgttcagcaggctgatgaataagatc

SEQ ID NO: 7613 - DNA, 399 bp, Homo sapiens
gccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggtaggtcgggcgggggaacaatggcccggcggtggccggctttgtgcggcagcgtccgctcactcctcccctgctcgctgcaggcccgggaccgtggcgcttcgagagattcgtcgttatcagaagtcgaccgagctgctcatccggaagctgcccttccagaggttggtgagggaga

SEQ ID NO: 7614 - DNA, 436 bp, Homo sapiens
gtccagcccaccgcctgccgacttgtgtcatgccctacgttggtataatcacatcaagtcttacgaaaaggaaaaggccagcctgccaggagtgaagaaagctttgggcaaatatggtcctgcccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtggggatacgggaattaag

SEQ ID NO: 7615 - DNA, 185 bp, Homo sapiens
ggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatag

SEQ ID NO: 7616 - DNA, 334 bp, Homo sapiens
ctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgctt

SEQ ID NO: 7617 - DNA, 396 bp, Homo sapiens
  misc_feature 198, 379, 386: n = A,T,C or G
tctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgactcaagaaaggtggtgaagcaggcgtcggagggccccctcaagggcatcctgggncctacactggagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatgggcctccaangaataanacccctggac

SEQ ID NO: 7618 - DNA, 377 bp, Homo sapiens
aaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctccctt

SEQ ID NO: 7619 - DNA, 439 bp, Homo sapiens
  misc_feature 413, 438: n = A,T,C or G
cttagatggacctgtgctgcctctttcctcttgtgccactctcccaatcactcaaccctgctccaactgtactggctgctattcttcttgaacaaaccttcctgcatgaccttgggtaagtgacttaccctgagtctcctcatccatagaagagtgaacaatggtactttagaatcgtaaagcacttatatacagagctccctataggaagtgaacagattggatagtaagggttacttgcatttgctgaaggagtgaagagtgaggatactgcctgcattttccataattttttcattatacttaagccatgtacaaatagtgcacagatgttgtcagtcaattgtttggctgtgcacttgttacaaagttcagacttcacagctgaaagtgagtcagttctttatctgggnatggttatcttggaacaagggtcana

SEQ ID NO: 7620 - DNA, 351 bp, Homo sapiens
gcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgagggatcagggcgggaccccgtgaggctcattaaggggagatgggggtctcccctaatgcgggggctggaccaggctgagtccccacagggtcctagtggaggatgtggagg

SEQ ID NO: 7621 - DNA, 257 bp, Homo sapiens
gggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 7622 - DNA, 350 bp, Homo sapiens
  misc_feature 199: n = A,T,C or G
atgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcaggggggcttanaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcagggcc

SEQ ID NO: 7623 - DNA, 392 bp, Homo sapiens
accgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctgggggtggatgatgtgaccttccttgggggactgcggaagggacgagggttccctggagtcttacggtccaacatcaggaccaagtcccatggacatgctgacagggtccccagggagaccgtgtcaagtagggatgtgtgcctggctgtgtacgtgggtgtgcagtgcacgtgagagcacgtggcggcttctg

SEQ ID NO: 7624 - DNA, 330 bp, Homo sapiens
gtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgcc

SEQ ID NO: 7625 - DNA, 212 bp, Homo sapiens
aatctgtacatgtctcccatcagaaagattcattggcatgccacaggggattctcctccttcatcctgtaaaggtcaacaataaaaaccaaattatggggctgcttttgtcacactagcatagaagaatgtgttgaaatttaactttgtaagcttgtatgtggttgttgatcttttttttccttacagacacccataataaaatatcatatt

SEQ ID NO: 7626 - DNA, 245 bp, Homo sapiens
ctttgggaggccgaggcaggctgatcacgaggtctggagatcgggaccatcctggctaacacagtgaaatcacgtctctactaaaaatacagaaaattagccgggcatagtggcgggtgcctgtagtcccagctactcgggaggctgaggcaggagaacggcatgaacccgggaggcggagcttgcagtgaaccgagatggcgccattgcactccagcctgggcaacacagcgagactctgtctc

SEQ ID NO: 7627 - DNA, 309 bp, Homo sapiens
  misc_feature 38: n = A,T,C or G
ccaaaacctagaagatgcttgtgatgacatcatgcttngcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaata

SEQ ID NO: 7628 - DNA, 439 bp, Homo sapiens
ggcccaaagggatctgcaggtaatcctggggaacctggcttgagagggcctgagggaagtcgggggcttcctggagtggaaggaccaagaggaccacctggaccccggggtgtgcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatggattacagaagtcctacttgacaatcacatatagaagaacggtgctattcagtaagttctctttcctttccctttgg

SEQ ID NO: 7629 - DNA, 438 bp, Homo sapiens
  misc_feature 426, 432: n = A,T,C or G
ccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtanaaaggnggagat

SEQ ID NO: 7630 - DNA, 355 bp, Homo sapiens
gcaagattactgatttcatcaagttcgacactggtaacctggtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggatt

SEQ ID NO: 7631 - DNA, 112 bp, Homo sapiens
aaaataattttcgctgataatttgatgattaattctagaagatccaatcgtttcaggaattggagaatggttagaaatggggtcatttgggggatgtagaaagatataaaat

SEQ ID NO: 7632 - DNA, 164 bp, Homo sapiens
caggcactgagcaaatgtctgttaattgaatccatgatttaaatgaaatctggagttggctggattcagggactcatgcctgtaatcccaacactttggaaggttgaggtgggggaattgcttgaagtcagaagtctgagagcagcctgggcaacataatgaga

SEQ ID NO: 7633 - DNA, 228 bp, Homo sapiens
cctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 7634 - DNA, 428 bp, Homo sapiens
caagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagcc

SEQ ID NO: 7635 - DNA, 436 bp, Homo sapiens
gacagagtctcacttaggctgaagggcagtgatgaggtttcactatgttgcccaggctggttattttgttcattagttgatgcagtttcttcctagcctcgatggtctttacaatttggcatgttttgcagtggctggtaccagttgttcctttccatgtttagtgcttctttcaggagctcttttggggcaggcctggtggtgacaaaatctctcagcatttgcttgtctgtaaaggattttctttcttcttcacttatgaaattctgggttgcaaattcttttaagaatgttgaatattggcccccactctcttctggcttgtagagtttctgccaagagatcagctgttagtctgataggcttccctttgtgggtaacccaacctttctctctggctgcccttaacatgttttccttcattgttgatgtgtct

SEQ ID NO: 7636 - DNA, 435 bp, Homo sapiens
gtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcag

SEQ ID NO: 7637 - DNA, 439 bp, Homo sapiens
  misc_feature 316, 336, 426: n = A,T,C or G
ggtgcccccactgcaggtgtaccagctactcacgttgaccatgggaggagccctttataataaaagaatctcagaatcctggaaagctggggatccacaggcagatgcagtagtcagtgatgccgtgcgcaagtgataatttttgtcatggggctttttctagacacttctagtgaaacaaatgtgggtttaggtaagaaataacttttaattctagaccttgaagtcagcttgtcattaaaagaggtcatttaaaaaaaaaaagtctaggtactggacttgtaagtaaaaataaaaagattaaatacctaaaaanggggttgtatataggcttanaaggagtcagtcaaaaattcaggggctgctgggcgtggtggctcatacctgtaattccagcactttggggaggccgaggtcaggagttanagaccattctgac

SEQ ID NO: 7638 - DNA, 407 bp, Homo sapiens
cgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 7639 - DNA, 239 bp, Homo sapiens
cagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaacc

SEQ ID NO: 7640 - DNA, 430 bp, Homo sapiens
  misc_feature 430: n = A,T,C or G
cagcagctgaaggtctcagagaccagtaatcagaaggcatccgactgcattaagtgtgcagcgctgaaaagacatttacaactaggccagggattagccactggtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgccctttggtgaacctgtgtattttccctaaggagggan

SEQ ID NO: 7641 - DNA, 438 bp, Homo sapiens
gtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagtttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgcc

SEQ ID NO: 7642 - DNA, 436 bp, Homo sapiens
tcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattag

SEQ ID NO: 7643 - DNA, 118 bp, Homo sapiens
gaagaaggtgaagaagcggatgagggttatcagctctttgaagaagtcaaaagctgcagtaaacttttccaacgttggctgcagtaactattttcaataaaagctgtctggatgtctc

SEQ ID NO: 7644 - DNA, 444 bp, Homo sapiens
  misc_feature 378: n = A,T,C or G
gccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttganagcttctcagactatccacctttgggtcgctttgctgttcgtgatatgagacagacagttgcggtg

SEQ ID NO: 7645 - DNA, 417 bp, Homo sapiens
ctttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaat

SEQ ID NO: 7646 - DNA, 439 bp, Homo sapiens
gcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcatt

SEQ ID NO: 7647 - DNA, 437 bp, Homo sapiens
atcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaaagattgaggactactttccagaatttgctcgctacactactcctgaggatgctactcccgagcccggag

SEQ ID NO: 7648 - DNA, 316 bp, Homo sapiens
  misc_feature 241, 248: n = A,T,C or G
aagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatattttttncctttgnattcatctctcaaacttagtttttatctttgaccaaccgaacatgaccaaaaaccaaaagtgcattca

SEQ ID NO: 7649 - DNA, 500 bp, Homo sapiens
caaagctggagctcgcgcgcctgcaggtcgacactagtggatccaaagaattcgccacgaggatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgata

SEQ ID NO: 7650 - DNA, 439 bp, Homo sapiens
gtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaaatggggatttccattccttcccccgtcatggaaaacaactttgtggatttgacagaagacactgaagaacctaaaaagacggatgttgctgagtgtggaccctggggggaagttgaggctg

SEQ ID NO: 7651 - DNA, 439 bp, Homo sapiens
gaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccgg

SEQ ID NO: 7652 - DNA, 439 bp, Homo sapiens
ccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctcc

SEQ ID NO: 7653 - DNA, 439 bp, Homo sapiens
caattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggta

SEQ ID NO: 7654 - DNA, 437 bp, Homo sapiens
ggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatggggtattgatcatgtccaacctgctggagccccttcacatggtggatgatgccccatgaccctgtagaaattgaatcctgctcacaacattgttggc

SEQ ID NO: 7655 - DNA, 259 bp, Homo sapiens
gtagcactgtttttgtatcatttttaatgatactcttttcttctcttcttagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctacta

SEQ ID NO: 7656 - DNA, 434 bp, Homo sapiens
  misc_feature 383: n = A,T,C or G
ctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagngaggtaaaataaggcataaatgcaggtaattattcccagctgacctaaagt

SEQ ID NO: 7657 - DNA, 415 bp, Homo sapiens
gagagtttgggttctctccaattccacctttttaatactaaagcagtggttctcaaactttagctacagtagaatcacctggagagtgtgttaaagcatagattttaggctccatcatcagtatttggttctgtaggcctagagtggaccccaaatttgcatttctaacaaattccaatgacactgatgttgctatttcaggcactatgctaacctaacacatgagtctgatcattcaactcaaatatctttatggatcagtcaagagaagttaattcaaaaagccttggaaaataaaatcaataggcagtggtgagaattagataaatagaatgtgctggactaatttaaaggctttctgtctcacatcttttaagacagtgtaatgaggaaatgaaacatgtccaaattcagc

SEQ ID NO: 7658 - DNA, 439 bp, Homo sapiens
ggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagag

SEQ ID NO: 7659 - DNA, 439 bp, Homo sapiens
ctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatac

SEQ ID NO: 7660 - DNA, 436 bp, Homo sapiens
  misc_feature 165: n = A,T,C or G
tggtaccccagatagacatggaaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcanaagtatattgagcggcccctcctcatctttggcaccaagtttgacctcagacagtggttcctgctcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacacc

SEQ ID NO: 7661 - DNA, 437 bp, Homo sapiens
caattggttcctctgagccaaagctgatttaactcctgggccagtatctaaaaaataaagaaacccccaaaacctaaaattgactgagttctttttgaggatttataatctgagaaagttattcgagcataaacaggaaccaaaatcataatgaaattggagaaattgatcatgcagccctcttattttttactttcttttaggggacaatttttttggagggaagtcaccactgtatttagcagttgttgaaatcacacgaaggagtgaaggatatagctattcaaaacttttggaaaggccaggcacggaggctcacacctataatcccagcgttttgggaggctgagacgggcagatcacctgaggtgaggagttcaagaccagcctggccaacatggtgaaaccgtctctactaaaaatacaaaaattagttg

SEQ ID NO: 7662 - DNA, 456 bp, Homo sapiens
ctcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcac

SEQ ID NO: 7663 - DNA, 410 bp, Homo sapiens
gtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaagggggtaggaaggtgctgtgggctggtcccacacatccaggaaagaggccagtagagaattctgcccactttttataaaaacttacagcgatggccccaccaaggcctagacacggcactggcctcccaggagggcaggggcatttgggg

SEQ ID NO: 7664 - DNA, 439 bp, Homo sapiens
ggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccggg

SEQ ID NO: 7665 - DNA, 438 bp, Homo sapiens
tgcatgctcagccgtacacgcacgcgttccttgctactgccatctaaatatatgcaccgacactctatgccctgcaacgtggccggtgtgtttgtcctgatcctacataaaggtaggcaggtatgtgggagagtccaggcaggaacaaacagccacgcgcaatttaactgcagccaaactcaaagagaccttgagcctgccgaattgtttcactcagccaggtgccccccagaaaccggctattctgcaatcagttgtggaatcctgcaattattcataaaatgtgctgaaaatgtattttaggaaacgtaatcttgctatatatggcaaggtaaaggcgaacctgaaggatgaatgtgtttctgctttttaatgtcatacgtgtagccatctgaccactttttattgggtgacatatcatatgagcactttggtgta

SEQ ID NO: 7666 - DNA, 434 bp, Homo sapiens
gttatttcctgcatttcctcctttcgtctttacaaggtagccgtttggcgtcgtgagagattgggtctctccacattgccccggctgctctccaacccctgagttcaagtgattcacctcccttggcctcccaaagtactgggattacaggcgtgagccaccgtgcctggctgagaagatggatttaagacatattttggagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccg

SEQ ID NO: 7667 - DNA, 320 bp, Homo sapiens
aataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttggatctagaaattgccctccttttacccctaccatgagccctacaaacaactaacctgccactaatagttatgtcatccctcttattaatcatcatcctagccctaagtctggcctatgagtgactacaaaaaggattagactga

SEQ ID NO: 7668 - DNA, 366 bp, Homo sapiens
cacatgtataacttaagtatcataaaaagaaagaaatgttttcattaataatatttctcaccttttctagatataaatttaattcacagttgggcagggcatggtgcctcacgcctgtaatcccagcactttgggaggccgagacgggcagatcacgaggtcaggagatcgagaccatcctggctaacacggtgaaaccccgtctctactaaaaatacaaaaattagccgggcatggtgcgcacgcctgtagtcccagctacacgggaggctgcggcaggagaatggcgtgaacccgggaggcggagcttgcagtgagtcgagatcgcgccactgcactccagcctgggcgacagagcgaaactcc

SEQ ID NO: 7669 - DNA, 439 bp, Homo sapiens
ccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatg

SEQ ID NO: 7670 - DNA, 435 bp, Homo sapiens
  misc_feature 366: n = A,T,C or G
atttatttgtttttttgagacagtcttgctcagtcaggcaggctagagtggcacaatctcagctcactgcaacctccgtctcccgggcttaagcagttctcctgccacagcctctggagtagctgggattgcaggcatgtgccaccatgcccagctaatttttgtacttttagtagagatggggattcactgtgttgaccaagctggtcttgaagtcctgacctcaggtaatgtgcccacctcggcctcctgaagtgctgggattgcaggcatgagccactgggcccagcctcttcatatatttttagtcatgaaaatattgtatacacacacataaatatatacatgtattaggcatgctggtanaagcacatcacataagactcataaagatctttttgttttttgccattttaaaaaaaatcttaccctagg

SEQ ID NO: 7671 - DNA, 305 bp, Homo sapiens
cttgcttcaagatagtaggaactgatcagcttataaagctgatgctgcccagttctgttctgagtccagtgtgcatagctctggctcccaccatgcccgttagcctgtgaaattgatttttttaaatggttgtacaggcatttggcctatagccaaagaaatgattgagcaagtgagtcctgtttctgtattgctctatgaataagtagttagaccattcaagactgctgtacatgagtcattcattcccagggacacttatagttcttttacatttggtgcattcagcatcctagaaggccttt

SEQ ID NO: 7672 - DNA, 455 bp, Homo sapiens
gtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacatt

SEQ ID NO: 7673 - DNA, 439 bp, Homo sapiens
aatgagccccttgcctttgcttcctgtggcacagagggatttcggaatgccaagaagggcacaggcatcgcagcacagacagcaggcatagccgcagcggcgagagctaaacaaaagggcgtgatccacatccgagtttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatggggaaggaggcctgcacttggacctgacctcaagcctcagctccagtgggaccttgtaaaatgctccctgtcagagctctccagaatatgcttgttggagatccttcaggcagtaaggggagagttttgcctcctttacacagtggcctttgcttgcacc

SEQ ID NO: 7674 - DNA, 415 bp, Homo sapiens
ggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatg

SEQ ID NO: 7675 - DNA, 341 bp, Homo sapiens
  misc_feature 160: n = A,T,C or G
cttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcanaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaata

SEQ ID NO: 7676 - DNA, 439 bp, Homo sapiens
ctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggtttta

SEQ ID NO: 7677 - DNA, 344 bp, Homo sapiens
  misc_feature 54, 60, 63, 81, 124, 161, 176, 182, 225, 228, 234, 274, 283,302: n = A,T,C or G
tgaacatggttacacaggtgacatgtttatcaaatacattttgggtttttttcngataanaantgcatcaagacaacaggntataaaatgcagcattgatcattttccttataagcttttatcnttaccattgctacctacctccagctgctttccaatcngttggatttgggtancaaacnatattggattgaaacaggaaagcaaataataacagaagactgncantttaangttattttatggcctataaaatctttgcaaaagactctcnagaaccgcnttattcaataaaataatcnctagccatataactattgagcagttgaaatgtggctaatccc

SEQ ID NO: 7678 - DNA, 128 bp, Homo sapiens
gagaaactagtctcgagagtacttctagagcggccgcgggcccatcgattttccacccgggtggggtaccaggtaagtgtacccaattcgccctatagtgagtcgtattacaattcccctggccgtca

SEQ ID NO: 7679 - DNA, 380 bp, Homo sapiens
cccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtccctgcttagaagccagtcaccagccctctgcctgcagccatgggaaaagggggtgtgcacgtgccttctgtgtgtgtggctgagtg

SEQ ID NO: 7680 - DNA, 422 bp, Homo sapiens
tgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataat

SEQ ID NO: 7681 - DNA, 191 bp, Homo sapiens
attaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcg

SEQ ID NO: 7682 - DNA, 319 bp, Homo sapiens
cagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaactccatctc

SEQ ID NO: 7683 - DNA, 272 bp, Homo sapiens
  misc_feature 39, 156, 209, 213, 226, 251: n = A,T,C or G
catgatttggctctctgtttgtctcttattggtgtatangaatgcttgtgattttttgcacattgattttgtatcctgagactttgctgaagttgcttatcagcttaaggagatttggggctgagatgatggggttttctaaatatacaatcatgncatctgcaaacagggacaatttgacttcctcttttcctaattaaatacccttnattnctttctcctgccngattgccctggccagaacatccaanactatgttgaataggagtggt

SEQ ID NO: 7684 - DNA, 439 bp, Homo sapiens
ccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcc

SEQ ID NO: 7685 - DNA, 461 bp, Homo sapiens
  misc_feature 17, 374, 387, 427: n = A,T,C or G
ggaaaacataaaatcgntaaatcaataatccattatagattcaatgagccttcaaggcaaagaatccccaaaggggcatctgtggagccctgcttagtttatttactccttggattcatgcttactgagtggcagctttattccaggcacagtcttaggtgctgaagatgaaggtgagaccagtcattgtctttgcagatttcacatgtaaatgggtacgaagacaattagctaattattgcaataagagccatggagggaattatcttgaggtgtgctgacagtgagaacttcagaagagccaactttggatactgaggtgttagagtcaggaagacatacaagaactgaggtcagaagggtgagaagggtcnaattggagagcanacacagcaggtagaggaaactatgagcactgaggcttganagtgacagccctgggcatgttccagggcccagta

SEQ ID NO: 7686 - DNA, 395 bp, Homo sapiens
ctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggtaaggttgggctggtgctcacagctgtaatcccagcactttgagattggctgggagttcaagaccagcctggccaacatgtcaaaactactaaaaataaagaaatcagccatga

SEQ ID NO: 7687 - DNA, 149 bp, Homo sapiens
  misc_feature 57, 76, 89, 114, 137: n = A,T,C or G
caaaacaacacgatttttcttatttttcaagaaatatctgttgttttgagtgaaatnattacacttggccaagtgntgtgggggtgganataccaggcgagtgctggagattgnaatcgacctaatttttgtctgcngcattaatcact

SEQ ID NO: 7688 - DNA, 187 bp, Homo sapiens
  misc_feature 2, 50, 52, 53, 167: n = A,T,C or G
gnacgaggagaggaacagaaaggataaggatgctaaattccgtctgattntnntacccagccggattcaccgtttggctcgatattataagaccaagcgagtcctccctcccaattggaaatatgaatcatctacagcctctgccctggtcgcataaatttgtctgngtactcaagcaataaaatga

SEQ ID NO: 7689 - DNA, 329 bp, Homo sapiens
  misc_feature 48, 169, 302: n = A,T,C or G
caggacgtgcacttcggggggtgcatgtagagtggtgagtggctctcnctgctgctgcggggagagcccgtcatggacctatggacaggagtaaaaacagcctcagcacctggggcagggcctcaagaccaccctctcctccctgtgtgtaggcaagcccagaggccanagctgggctgcccactcaagctctgagaccccagagttgtcctcaagtttatctccaaacagtatctgcggaaagatcactgaccagggtcaaactgagccagagcttccccgcagcccacaatctctctcantccaagggtagtaggatggcccccctg

SEQ ID NO: 7690 - DNA, 443 bp, Homo sapiens
ggtcagtagaggtaattttcagactgcttaattttaacatgaacagttttgtttttgttcttgtttttgtttttgtttgagacagagtctcattatgttggccaggctggtctcgaactcctgcgcttaagcgatcctcccgccttctcctcccaaattgctgggattacacgcgcgagccaccacacgtggccatgaacagtttttaaatctttataagttaaagcaaataggccaggtgggtggctcatgcctgtaaatcccagcactttgggaggtggaggtggggagatcgcttgagctcaggagtttgagcttagcctaagcaacatagccaaaccccgtctctacaaaaattaaccagggcatggtggtgcatacctgtggtcctagctaccggacaggctgagatgggaggattgcttgagcccaggaggtaaagg

SEQ ID NO: 7691 - DNA, 439 bp, Homo sapiens
agacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgt

SEQ ID NO: 7692 - DNA, 443 bp, Homo sapiens
tgtaattcttattttataaataatgtgatgtagatgtaaccggtgccccctccccgttgtgactgagggcgagtgttatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagcttgtttacctcagttccgcaggcaggacagccggtccgggaaccctgagtgagagtgagtgtggatgtgtacagtacacacactggacggcagcgggaggctgggactttccattacaaatagagacttcattcctgttgagtctagttggaatttttagtatgaatgtgagatttttctcctgcttgtgacattaagaataaaaaactgtgatct

SEQ ID NO: 7693 - DNA, 223 bp, Homo sapiens
  misc_feature 2, 4, 48: n = A,T,C or G
angngcttcccaggaaccttgacagtttagattattacagacacttgnccttaaactttcctaggtcatagtctcattattttcacaatttctgatataaaatttgagattttaacaaattttctaattaagtaagcccaccgtagcttctctaccactgattataactaaaaactctggaccccaaatctccttctcccaaaacaacccaaccaacaaacag

SEQ ID NO: 7694 - DNA, 393 bp, Homo sapiens
  misc_feature 10, 260, 268, 276, 314, 359: n = A,T,C or G
tggggacacncagtatatacattttggtgctgtggaatgtttatacctgcaagaattttgaagattgtcattattttttctctgtaagaaattacagattaaaaacaaatgttttgctattattgatgatgtgttttctcataaacatcaactagcagctggacaatctgctaaagattttttttctgactgaagcttttgcttatcttagttattcatatttaaccttgaaatatttggcaaagtgaacaagtattttnaggggacnaattttgnttttatactaagtgattcttatgtgaacaaagtaaagnatccttacaaactatacctacttgtacacaacataatttcaagcnctttttgaaaaaggcatatctatgatgctggctg

SEQ ID NO: 7695 - DNA, 437 bp, Homo sapiens
tggggacaattaacccaccttaatttacctcatagggttttaatatgatagaaagtgagagtccttttttagcagtaaagccttaaaagatgtaagtttttatttttaaattcaaccaatgattagccttggggcaaaatcacttggatgataactagaatttgtcaatttgttagacttaacattcattctcatatgctattttactatatggtcagccaccatcaattcaactttctatctaacaggtttattaatctgccagtttgctggtgttgatagacggttgttatcagtcagctcactataaattcaaaatgatacactgattttaaaacaaccctgaattatcatctgaaggatcattattcttaaatgaaggcataaagactagcaaatccttttgtattgtgttattattaggcctcatttttttt

SEQ ID NO: 7696 - DNA, 407 bp, Homo sapiens
ctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctcc

SEQ ID NO: 7697 - DNA, 417 bp, Homo sapiens
ggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttat

SEQ ID NO: 7698 - DNA, 468 bp, Homo sapiens
  misc_feature 302: n = A,T,C or G
attcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtanaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggt

SEQ ID NO: 7699 - DNA, 461 bp, Homo sapiens
gcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaaca

SEQ ID NO: 7700 - DNA, 466 bp, Homo sapiens
  misc_feature 20, 26: n = A,T,C or G
agcggctgctgttggttggnggcccncccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgt

SEQ ID NO: 7701 - DNA, 462 bp, Homo sapiens
  misc_feature 44: n = A,T,C or G
atggaatcaaatgaaatcatcatcgaaaggatcgaatgaaatcntccaccaatggaatcgaactgaaccatcaaatggaaactaatggtatcatcatccaatggaaccgagtgcaatcatcatcaaaagaaacctaatggaatcatcatagaaaggaattgaatggaatcagcgaatggaattgaatgcaatcatcatcaaaaggaattgaagtgaatcatcaaatggaatcgatttgaatcatcaaatagaatcaaaaggaataatcattgaatggacttgaattgaatcataatgggattgaatcgaatggaatcatcaaatagtctcaagtggaatgattgattggactagaatggaatcatcatcgaatggatatgaatggaatcatcatcgaatggaatcaaatggaatcatcaatgaatggaagcgaatgcaatcaccattgaaggaaatcagatg

SEQ ID NO: 7702 - DNA, 457 bp, Homo sapiens
ggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacact

SEQ ID NO: 7703 - DNA, 439 bp, Homo sapiens
aacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccata

SEQ ID NO: 7704 - DNA, 462 bp, Homo sapiens
gcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgag

SEQ ID NO: 7705 - DNA, 459 bp, Homo sapiens
  misc_feature 42: n = A,T,C or G
ctttggcagtgcagtggcagactcttttagcaaagggctgcntctctaaataactcgagcaccgtctttggaatcaaggtgtgatgaaaagtgctttggagtcacaagcacctgcggttgggtcctagctgtgtgcttaggagcaaggtgacttgatgtaagttagtctgcctcctcctgctcccgactttctcctatgagtgagagctgaaaatgagatacccggtcttgatttcacagtgtggctgggtgtagtgggcaaggcaggtggttgcagagcacaccgcacatgtctggtaccagtagccgtgaacctgagttcattccctttttctttgtttttcagtgaggatctcaggctctatcctgcttggattgtgtgtgtatctttgtgaggggcctttttctcccctcgtgatatactaagacaccatggcagtacatttaaaatgagggaac

SEQ ID NO: 7706 - DNA, 121 bp, Homo sapiens
ctagtctcgagagtacttctagagcggccgcgggcccatcgattttccacccgggtggggtaccaggtaagtgtacccaattcgccctatagtgagtcgtattacaattcactggccgtca

SEQ ID NO: 7707 - DNA, 143 bp, Homo sapiens
  misc_feature 1, 44, 46, 50, 62: n = A,T,C or G
nctgaagtagtgggttttgattgagttgactgtttttaaaaaantntttngattttaattgngatgcagaagttatagtaacaaacatttggttttgtacagacattatttccactctggtggataagttcaataaaggtcat

SEQ ID NO: 7708 - DNA, 347 bp, Homo sapiens
  misc_feature 10, 210, 220, 347: n = A,T,C or G
ccgcacgagntggtgtggggagtcaaaaccacagatgaaaggtaaggacatatttccacaagggatacagagtgtcagagcctcagcagcatgaagaaggcatctatgtggaagaacagcctggcatgggttgttggaacccaggttgagagaagagagcataaagagaagcttcaagatggggtcagatacttgggtacgcaaggtttngatttattancaggggccttaagtggttttctaaaacgcacaggtagctattgcgttatgccaggtcatacactgtgggttcctggggtgagagagagagtggcagggagaataggagaaagggctgggatcggaan

SEQ ID NO: 7709 - DNA, 500 bp, Homo sapiens
  misc_feature 6: n = A,T,C or G
caagtngacactagtggatccaaagatttccgcacgagggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatttttgcagaaatccagagggaaagaagagaagtggtaagaaaaattgttccaactaccacaaaaagaccacacagtggaccac

SEQ ID NO: 7710 - DNA, 453 bp, Homo sapiens
cggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccac

SEQ ID NO: 7711 - DNA, 254 bp, Homo sapiens
caagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacat

SEQ ID NO: 7712 - DNA, 460 bp, Homo sapiens
caaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagttgacttttagaaagtgtctcagtagttaaggaagctaacagtcttagatctacttttaaaacggatggccttcttaagaataaagcaaaaggtgattttctacataatttttgc

SEQ ID NO: 7713 - DNA, 434 bp, Homo sapiens
  misc_feature 423: n = A,T,C or G
ggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttttgccccccangctgttgattg

SEQ ID NO: 7714 - DNA, 461 bp, Homo sapiens
  misc_feature 45: n = A,T,C or G
gacaaagtgaggtgatgaagtgtggggccactaaaccaaaggcanaggagacgtcggccacttcctgtggacgtgggcagagcgttgctgccagttcctggtagccttgaccacgacgctggggggtctttgtgatggtcatgggtctcatttgcacttgggggtgtgggattcaagttagaagtttctagatctggccgggcgcagtggctcacgcctgtaatcccagcactttaggaggctgaggcaggcggatcatgaggtcaggagatcgagaccgtcctggctaacacagtgaaaccccgtctctactaaaaatacaaaaaagtagtcgggtgtggtggcgggcgcctgtggtcccagccactcaggaggctgaggcaggagaatggcatgaacctgggaggcggagcttgcagtgagctgagatcgcgccactgcattccagcctgggcgacaga

SEQ ID NO: 7715 - DNA, 500 bp, Homo sapiens
  misc_feature 25, 26, 356: n = A,T,C or G
caagtcgacactagtggatccaaanntttccgcacgagctcgggcacgctacgagagtacaaggtagtgggtcgctgcctgctccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagngctaccgagacatgggtgcccggcaccgcgcccgagcccactccattcagatcatgaaggtggaggagatcgcggccagcaagtgccgccggccggctgtcaagcagttccacgactccaagatcaagttcccgctgccccacc

SEQ ID NO: 7716 - DNA, 424 bp, Homo sapiens
  misc_feature 2, 50, 321: n = A,T,C or G
gnacgagggtcgttgtggtgcgctgtcttcccgcttgcgtcagggacctntccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagncgtcagacaaccgatcccgtgggtaccgtggtggctctgccgggggccggggcttcttccgtgggggccgaggacggggccgtgggttctctagaggaggagg

SEQ ID NO: 7717 - DNA, 439 bp, Homo sapiens
gttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagta

SEQ ID NO: 7718 - DNA, 500 bp, Homo sapiens
  misc_feature 61: n = A,T,C or G
tcccgcacgaggtaaaatgcagcatctggtgctgtgggtctctctcaggccttgatggacncttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttt

SEQ ID NO: 7719 - DNA, 209 bp, Homo sapiens
gtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaggcc

SEQ ID NO: 7720 - DNA, 297 bp, Homo sapiens
ccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctt

SEQ ID NO: 7721 - DNA, 287 bp, Homo sapiens
  misc_feature 6, 8, 48, 51, 53, 54, 108: n = A,T,C or G
gaacgngntgagtttcgcacttgattttcaatattttatagtaagaanttncnncctgctttgggtcatttcataaacaaactctgcatttagataactattaaaggntgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatatt

SEQ ID NO: 7722 - DNA, 380 bp, Homo sapiens
  misc_feature 60: n = A,T,C or G
tccgcacgaggctggccaggttttagatattaacctggctgcagagccaaaagtgaaccnaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctgg

SEQ ID NO: 7723 - DNA, 500 bp, Homo sapiens
  misc_feature 22, 23, 81, 87: n = A,T,C or G
gtcgacactagtggatccaaanntttccgcacgaggtcaaagtgaaagacatttcaaatctgtagcataggctagtgggcnggtccncacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcaga

SEQ ID NO: 7724 - DNA, 188 bp, Homo sapiens
gctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacga

SEQ ID NO: 7725 - DNA, 468 bp, Homo sapiens
  misc_feature 50: n = A,T,C or G
gaacctctgaaatatgctgaacaacttcctgtagctcagataatacaccngaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttgg

SEQ ID NO: 7726 - DNA, 282 bp, Homo sapiens
  misc_feature 50, 236: n = A,T,C or G
gtaaaatgcagcatctggtgctgtgggtctctctcaggccttgatggacncttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagancgaatctttagggtgaagagctccccaaagccatctggtgaggtca

SEQ ID NO: 7727 - DNA, 404 bp, Homo sapiens
  misc_feature 99, 155, 177: n = A,T,C or G
atttttttggaaacctctgcgccatgagagccaagtggaggaagaagcgaatgcgcaggctgaagcgcaaaagaagaaagatgaggcagaggtccaagnaaaccgctagcttgttgcaccgtggaggccacaggagcagaaacatggaatgccanacgctggggatgctggtacaanttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatta

SEQ ID NO: 7728 - DNA, 207 bp, Homo sapiens
  misc_feature 22, 23, 36, 51, 82, 101, 112, 118, 151, 156, 189, 194: n = A,T,C or G
gtcgacactagtggatccaaannttcccgcacgagnagaactacaactacnggttcatgtgtcctaaaaatatcaatgactngcacccccaaaagtaattnatttatctgcnaataanaataaaaatgaaggaggattactgagacaccanaagantggctaaaaaaattattttatagctgtcaatancaagngttggtgaggaca

SEQ ID NO: 7729 - DNA, 490 bp, Homo sapiens
  misc_feature 46, 49: n = A,T,C or G
ctggcctaccgcctgacccctggggtgcacgagctgccggtgcatncanccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatat

SEQ ID NO: 7730 - DNA, 498 bp, Homo sapiens
  misc_feature 11, 262, 265, 266: n = A,T,C or G
caggttcaagngattcccctgcctcagcctcccgagtagctgggattacaggcgcctgccaccacccccgcctaattttttgtatttttagtagagacggggtttcaccgtattagccaggatgatctcaatctcctgacctcgtgatccatccgcctcgccctcccagagtgctgggattacaggcgtcagccaccgtgaccggctcagactgtactcttctagccatctgaaatacgttttctaggtagagatagattgngtnngggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcaagtgctgatgcagatgatgccacggcccttagactctctc

SEQ ID NO: 7731 - DNA, 374 bp, Homo sapiens
  misc_feature 44: n = A,T,C or G
tgtaaatttaactgttagtccaaagaggaacagctctttggacnctaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaagg

SEQ ID NO: 7732 - DNA, 347 bp, Homo sapiens
cctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaattt

SEQ ID NO: 7733 - DNA, 414 bp, Homo sapiens
  misc_feature 403, 406: n = A,T,C or G
gaattctgctgctgttattaccccattcaagttgacaactgaggtaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaatttttttttttngcngtcatccc

SEQ ID NO: 7734 - DNA, 499 bp, Homo sapiens
  misc_feature 2, 52: n = A,T,C or G
gnacgagccccattgtatccaggaagtaactaacctgcttttgattttactngctcctaggtggaagggacttgccttgtctcagatgagactttagactgtggacttttgagttaatgctgaaatgagttaagactttgggggactgttagaaaggcatgattggttttgaaatgcgagatcatgagatttgggaggggccaggggcagaatgatatggtttggctgtgtccccatccgaatctcatcttgaatttctgtgtgttgtgggagggacaggtgggaggtcattgaatgatgggggcaagtcttttctgtactgttcttgtgatagtgaataagtctcatgagatctgatggttttaaaaagaggagtttccctgctcaagctctctctctttgcctgctgccatccatgtaagatgtgacttgctcctccttgccatctgccatgatgtgaggcttccccagccacgtggaactgtaagtccaattaaac

SEQ ID NO: 7735 - DNA, 357 bp, Homo sapiens
  misc_feature 4, 8, 53, 58, 59, 64, 66, 319, 325: n = A,T,C or G
aaangagnaacttatatggcttatccttttagcaaatgtatttcataatgttnttccnnaaaantnaaaaattaggcaaagctgccagggtgtggtggctcgcacatgtaatcccaacactttgggagaccaaggcgggtggatcacctcaggtcgggagttcgagaccagcctgatcaacatggagaaaacccgtctctaccaaatatacaaaattacccaggcatggtggtgcatgcctgtaatcctagctactcgggaggcagaggcaggagaatcacttgaacccaggaggtggaggttgctgtgaaccaagatngggccnttgcacaacaagagtgaaactccatccatctc

SEQ ID NO: 7736 - DNA, 157 bp, Homo sapiens
aagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttc

SEQ ID NO: 7737 - DNA, 487 bp, Homo sapiens
  misc_feature 42: n = A,T,C or G
cctgctcatctccaccctgaaggacaagcgcgggacccgctntgacctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatactt

SEQ ID NO: 7738 - DNA, 120 bp, Homo sapiens
  misc_feature 45, 52: n = A,T,C or G
gaaagtcagaagtctctaatatatcatttgtcttttttccagtgnggtaacnataaggcataaatgcaggtaattattcccagctgacctaaagtcaataaaacattctgtttaagtgtt

SEQ ID NO: 7739 - DNA, 277 bp, Homo sapiens
  misc_feature 8, 11, 261, 264, 266: n = A,T,C or G
gccgccgntgnggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgnaananatgttctggtt

SEQ ID NO: 7740 - DNA, 218 bp, Homo sapiens
  misc_feature 6, 10, 52, 53, 59: n = A,T,C or G
cgaaanagantttctacttatttcgtttttggaatcagcttacagattccanntccccnttgaatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtagg

SEQ ID NO: 7741 - DNA, 500 bp, Homo sapiens
  misc_feature 2, 4, 48, 50, 55: n = A,T,C or G
gngntaacacatacacacaaacacacacacacacatacacacaccatntntcccnatctatgaagtcaaagaaactcagttctttccacaatgcaataaaaagttgtacaagaggagaaaatggagttttaaactcatgtaaacctttggaatgttgtcttctttatattaccaatgacacctctagagcctacaagaaaaaagaattgcttggaaagtaaatatcttggacaatgtagctaaaagaatattaaatgttctatttttagcttatcatggttgtgaagaaatatccaccttaatctactggaaggtggccttagtttccaacactgaatttcacattttgaaatttattggctctctggctttcccatgaaatttaaaagaagtgagaatgccttaaaaattttgaatgaatttaaagattaaacccttctggcttttcttgtcacatgaaattaaatagaggcaacttgggaagggtagaaaggccactt

SEQ ID NO: 7742 - DNA, 103 bp, Homo sapiens
  misc_feature 1, 48: n = A,T,C or G
ngcccctccacttctctcccaagccaggtcccggcatgggtgggttangctcatgctggcaatacttgaaacgggtttattaatgctgggtattttgcacatt

SEQ ID NO: 7743 - DNA, 358 bp, Homo sapiens
gtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaaga

SEQ ID NO: 7744 - DNA, 500 bp, Homo sapiens
  misc_feature 2, 7, 55: n = A,T,C or G
angaggncagcttgtctaacttcatgtacatgtagaaccacatgtttgttgtccnactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaac

SEQ ID NO: 7745 - DNA, 287 bp, Homo sapiens
  misc_feature 45, 51: n = A,T,C or G
ctttcattcctatccttgatttaataaagcttcagtacacaaaantgtcanatatttgcttacaattcacaaattctgtggtgccaataatttatgaatagggcataactaagcagcatagagaagtcctgggaaaattggacatagtgtgcctggcctgttaaaagatagctatttgagccgggcacggtagctcatgcctataatcccagcactttaggaggccgagatgggaggatcacttgagatcaggagctcaagaccagcctaggtaacatagggagacc

SEQ ID NO: 7746 - DNA, 170 bp, Homo sapiens
  misc_feature 2, 7, 49: n = A,T,C or G
angaggnggaatgcaagtaggcagccagcccgtctgttccctctccgcnccgccccgccccgcccccgtcactgcgcttctgttataccatctttgcctgactctctccggcttctccattgaatggctaatgtgtatgtgaaataaagaaataaagaaaaacaaacgcg

SEQ ID NO: 7747 - DNA, 500 bp, Homo sapiens
  misc_feature 51: n = A,T,C or G
cgaacgagaaaaagtttcttggccctcgtgggccagtgtggaggggctgtnttttccctcatcaggagcgtcacttggtggtttagggggaaataatctattcttaagattgaagagagtgcaggatttggggggttgactctacatccttcagtatcagggcttatctccttgtcttacctcctaggagaccctcctgttcttaactgtgggcgatgagaaaggtggtggactcttcttactggcagggccacctgcgtctgtggagaccctggggcccaggtaattctttgtggactctcttgcacatgtagtagagcctgtatcctacaaatacattcctttactgagtcaaaggaccatcacatctgcgatctcatttaattcacatcatgggcatgtgaggtgggctgagcagagataattattactactgtcatttccagtttgacagttgaaggtcttttggctccacatctcacatgtatgtttttgttttt

SEQ ID NO: 7748 - DNA, 480 bp, Homo sapiens
  misc_feature 2, 4, 48, 52, 54, 200, 228, 314, 320, 321: n = A,T,C or G
angngggcctcctggccccgtcggtccctctggcaaagatggtgctantttnancccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccnagagagaagggccccgaccccctgcagnacatgcgggccgaccaggcagccggtggcctgagacagcatgacgccgaggtggatgccacactcaagtccctcaacaaccagatngagagnntccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgaga

SEQ ID NO: 7749 - DNA, 302 bp, Homo sapiens
  misc_feature 257: n = A,T,C or G
cgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgngttgtgcagcattaaaaaaaatcaaaataaaaattaaatgtgagc

SEQ ID NO: 7750 - DNA, 315 bp, Homo sapiens
  misc_feature 264, 268, 284, 306, 307: n = A,T,C or G
gtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgnattntagctatttaagtagnatttgttcaataaaaacgcaanntgtaaggt

SEQ ID NO: 7751 - DNA, 239 bp, Homo sapiens
gcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttgg

SEQ ID NO: 7752 - DNA, 417 bp, Homo sapiens
  misc_feature 354: n = A,T,C or G
cggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagngatttgaaatacaataaatgaaggcaatgcatggcccttccaataaaaaatatttgaagactg

SEQ ID NO: 7753 - DNA, 415 bp, Homo sapiens
  misc_feature 185: n = A,T,C or G
acaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctnatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggg

SEQ ID NO: 7754 - DNA, 101 bp, Homo sapiens
cttgaatcagttttgattctatttgtaagtgtttcttgtcgtgaggcacctgccatgtctgttgcgttttcctcggcagcgtgtagggcttcagcttccct

SEQ ID NO: 7755 - DNA, 407 bp, Homo sapiens
gctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaagg

SEQ ID NO: 7756 - DNA, 487 bp, Homo sapiens
  misc_feature 256: n = A,T,C or G
tgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgagntcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcaaaggagctgagttggcagaccgggcccccctga

SEQ ID NO: 7757 - DNA, 207 bp, Homo sapiens
ctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaact

SEQ ID NO: 7758 - DNA, 408 bp, Homo sapiens
  misc_feature 3, 7, 51, 320, 321, 322: n = A,T,C or G
aangagnacagaagagccacagtctccagactcatggcgttccctccaganctccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagnnngttcatgtcatgtggtttgggatgaaccaggggtctggccccatcgggtcacaggtgatggcaaatagaaaagaagcaaatggagg

SEQ ID NO: 7759 - DNA, 457 bp, Homo sapiens
cagcagctgatggacatttaggttgtttccattgaatgatgctgctctgaacactggtgtacatgtttttgtgtaaacatagattttcagttcttttgggtgtatacccaggaatggaattgctagatcatatggtaactttttgaagaacaaccagacagttttccaaagaggctgtaccattttacattcccaccaacgatgtctgagggttccagtttccctatatcctttgcctaaacacttgttattatttgtcttttcaattatagccatcctagtgggtgtgaagcgataagtcactttagtttgatttctgttaccctactgactaatgatgtcgagcattgtttcatgtgcttattagtcatctgtatatcttctttgaggaaatgtctattcacttcctctgcataaaaaaatgggttatttggccttttagtgttgagttttaaga

SEQ ID NO: 7760 - DNA, 206 bp, Homo sapiens
ctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactt

SEQ ID NO: 7761 - DNA, 426 bp, Homo sapiens
ccagcaccatggcggttggtaagaccaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtttgttctgtg

SEQ ID NO: 7762 - DNA, 139 bp, Homo sapiens
atttagggagttacataggtgatgggggaaattgttaactacctttcattttcctgggaagtcaaggttacatcttgcagaggttgttttgagaaaaaagggcccttctgagttaaggagccatagttctatcaatgat

SEQ ID NO: 7763 - DNA, 321 bp, Homo sapiens
ggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgaa

SEQ ID NO: 7764 - DNA, 212 bp, Homo sapiens
caaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgcctt

SEQ ID NO: 7765 - DNA, 498 bp, Homo sapiens
  misc_feature 3, 51, 52: n = A,T,C or G
ggnacgagcacagactcagagagaacccaccatggtgctgtctcctgcctnnaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggc

SEQ ID NO: 7766 - DNA, 303 bp, Homo sapiens
gccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcc

SEQ ID NO: 7767 - DNA, 203 bp, Homo sapiens
gccaaatctgtcaagatcaagaaaaataaggacaacgtgaagtttaaagctcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 7768 - DNA, 350 bp, Homo sapiens
  misc_feature 3, 53, 58, 209: n = A,T,C or G
cgnacgagacagcactcaggccaacgccatcctggccatcgagcagttcgaangtctnctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagntaccgccactcgtggccggagaacctggcctgcgaggagctgccagtgtacgacaggggcgtgtgcatctctcccgaggccatcgttactgcggacggagctgattttcctatggattctagtaacggaaactgtagaggg

SEQ ID NO: 7769 - DNA, 346 bp, Homo sapiens
cccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctg

SEQ ID NO: 7770 - DNA, 321 bp, Homo sapiens
  misc_feature 56, 61: n = A,T,C or G
cctcctccatgcactttaccagctcaacgcatccactctctgttctcttggcaggncgggngaggggggataggaggtcccctttcccctaggtggtctcataattccatttgtggagagaacaggagggccagatagataggtcctagcagaaggcattgaggtgagggatcattttgggtcagacatcaatgtctctgtcccccctgggtccagccaagctgtgccccatcccccaagcctcctgggaggatccagccaaatcttgcgactcctggcacacacctgtctgtaacctgttttgtgctctgaaagcaaata

SEQ ID NO: 7771 - DNA, 461 bp, Homo sapiens
  misc_feature 49: n = A,T,C or G
acgcctccccatcattgacattgcacccatggacataggagggcccgancaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctatt

SEQ ID NO: 7772 - DNA, 307 bp, Homo sapiens
actgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaactttt

SEQ ID NO: 7773 - DNA, 497 bp, Homo sapiens
  misc_feature 4, 11, 53, 55, 324: n = A,T,C or G
ccgnacgaggncgagacagggcgtgttcgctgttcagtgccggtgttgcaggntntgacggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaattnggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcg

SEQ ID NO: 7774 - DNA, 448 bp, Homo sapiens
  misc_feature 32, 35, 37, 40, 49, 299, 301, 302: n = A,T,C or G
aaagcaggtcttgagaaaaatgcttcagctanttntnccngctacaccnggaactcgtgtattcctggacttatcaacaaattaataaattcctttctcactcaagccagtttgagtggtgatcagaaaaggactgatgggcactgggactaacacaggatgtacgtgatttagatagtgacttcctgtgtaaccccgggtaagcccaacaccctcatgaaacattttgtctttgaataaacaggtacccagcataaccccattgaagagctgttccctgggacctggagaggaacacngnnggctgccatgcccactgcaccttcaggtgaggcaaggcagtaaaacagagaggctgtgactatccaggcaaacagttgagagtttgaatttctgctctgctgctcatgggctgtgtaaccctaagacaattatttgacctctctga

SEQ ID NO: 7775 - DNA, 499 bp, Homo sapiens
  misc_feature 2, 52, 61: n = A,T,C or G
gnacgagctgagacagcatgacgccgaggtggatgccacactcaagtccctnaacacccanattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacattcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctg

SEQ ID NO: 7776 - DNA, 424 bp, Homo sapiens
  misc_feature 2, 3, 52, 54, 151: n = A,T,C or G
annagggtcgccgtggctggagccatctctagcttcattgcttaccagattnanaccctatgcttcaaagaaaatgcagaacaaggggaggtggacatggagagccaccggaatgccaacgcagagccagctgttcagcgtactcttttanagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaagg

SEQ ID NO: 7777 - DNA, 286 bp, Homo sapiens
caaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 7778 - DNA, 388 bp, Homo sapiens
  misc_feature 3, 56: n = A,T,C or G
ccncacgagggcagataaactggactgtcctctacagaaggaagcacaaaaagggncagccggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactcta

SEQ ID NO: 7779 - DNA, 419 bp, Homo sapiens
  misc_feature 44, 49: n = A,T,C or G
ctcagggtggccggcattcacaagaaggtggcccggaccatcgntattnctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatc

SEQ ID NO: 7780 - DNA, 179 bp, Homo sapiens
  misc_feature 4, 8, 53, 58: n = A,T,C or G
gaangagncacctactcatgcacctaattggaagcgccaccctagcaatattnacccntaaccttccctctacacttatcatcttcacaattctaattctactgactatcctagaaatcgctgtcgccttaatccaagcctacgttttcacacttctagtaagcctctacctgcacgac

SEQ ID NO: 7781 - DNA, 462 bp, Homo sapiens
  misc_feature 158: n = A,T,C or G
gaattattgtgctgattgtaaatctgttatagcaagaccccctatttaattttagaaaaagataactggaaccttcaggtgaaatgtaattggggaaatacaaattggatatttacatgaaatattttcagattgcttaagcggtgtattgtcagaanaagtatcaatggggttcttttttaaattaattttttaaagaattgggcaacaattccataaaatagaataagtgttccctcaatggggttcttttatgtttaattttttttcctaaaaacaaaacaaaaaaagtgaactgagttttccaggctctgaatgtctgagtgtgatttgtgtggccgcaggagcagtgaacatctccaaaaagacaatatgagcaaagatttccttaaaaatttatatatgacattgaaatttaaaaaaattttgaaatttaaaatttaaattttatgtaagaaattt

SEQ ID NO: 7782 - DNA, 462 bp, Homo sapiens
ccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgccc

SEQ ID NO: 7783 - DNA, 439 bp, Homo sapiens
gtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagag

SEQ ID NO: 7784 - DNA, 389 bp, Homo sapiens
  misc_feature 25, 26: n = A,T,C or G
caagtcgacactagtggatccaaanntttccgcacgagcaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaac

SEQ ID NO: 7785 - DNA, 372 bp, Homo sapiens
ctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagttt

SEQ ID NO: 7786 - DNA, 465 bp, Homo sapiens
  misc_feature 45, 50: n = A,T,C or G
gcaagaacagcattgcctatctggacgaagcagctggcaacctcnagaangccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggca

SEQ ID NO: 7787 - DNA, 462 bp, Homo sapiens
ggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacat

SEQ ID NO: 7788 - DNA, 250 bp, Homo sapiens
gaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 7789 - DNA, 137 bp, Homo sapiens
  misc_feature 43: n = A,T,C or G
aatttcaaagccttcgctagtctccgtatggcccgtgccaacncccggctcttcggcatacgggcaaaaagagccaaggaagccgcagaacaggatgttgaaaagaaaaaataaagccctcctggggacttggaatc

SEQ ID NO: 7790 - DNA, 190 bp, Homo sapiens
caggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaatagg

SEQ ID NO: 7791 - DNA, 485 bp, Homo sapiens
gcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccacacatgacaatggaccaaatgtgccacacgctcgctcttttttacacccagtgcctctgactctgtccccatgggctggtctccaaagctctttccattgcccaggggaggg

SEQ ID NO: 7792 - DNA, 205 bp, Homo sapiens
  misc_feature 45, 48: n = A,T,C or G
ctagaacttgtttttgttaacatgtgctttgatgtaaagaacttnttncgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatg

SEQ ID NO: 7793 - DNA, 492 bp, Homo sapiens
  misc_feature 3, 52, 58: n = A,T,C or G
cgnacgagatgcagagcgccctggacgccgaggtgcggagcaggaatgaatncatccngctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccggggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaagg

SEQ ID NO: 7794 - DNA, 360 bp, Homo sapiens
  misc_feature 5, 295: n = A,T,C or G
gcacncgggcagccggtctctgtagtaccgcgtggtactcactgcggtaagacaaccccagagacctgggcccgatggctggcagtacccagacagtggctggactcaagctcctcctccaggcttctactgtcccccacggaccccctttctgtgctgcacttccgcctcctcggagccaaatcccacgcgtactggccgtcacgtgatgtaggacagcccaatcacgctcacccccttctcgttggcgccccagctccgccgcttggcctttcgggaaagggtggaggaccanaagacggggactaggagcgctctgccgacgtcagcttttgtctccagtattttcgggggctggtg

SEQ ID NO: 7795 - DNA, 181 bp, Homo sapiens
  misc_feature 46, 47, 51: n = A,T,C or G
gaccaatctatcaccctatagaagaactaatgttagtataagtaanntganaacattctcctccgcataagcctgcgtcagattaaaacactgaactgacaattaacagcccaatatctacaatcaaccaacaagtcattattaccctcactgtcaacccaacacaggcatgctcataagg

SEQ ID NO: 7796 - DNA, 235 bp, Homo sapiens
gttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttccccat

SEQ ID NO: 7797 - DNA, 500 bp, Homo sapiens
  misc_feature 2, 3, 49, 54, 57: n = A,T,C or G
annaggatttagtgggccttacaaatttccattcactccacctttaganttttnccncttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcag

SEQ ID NO: 7798 - DNA, 395 bp, Homo sapiens
  misc_feature 45, 50, 313: n = A,T,C or G
gtcgctgcaacctaccctctctctgcctcagccttacacccaagnagtangtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacagggcatatttaagggggcatctttgngtaaaagatgcatggagtcaggagaaaaccaccttcataaactgctctgtgcaaagaggaataaaacattttttccaaactg

SEQ ID NO: 7799 - DNA, 483 bp, Homo sapiens
  misc_feature 50: n = A,T,C or G
gccgggaccgcagccatgagaggaaccgggacagagaccgagatcgggancgggatcgagaccgggatcgagacagagacagagagcgggacaggggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctcc

SEQ ID NO: 7800 - DNA, 418 bp, Homo sapiens
  misc_feature 4, 8, 50, 53, 55, 58: n = A,T,C or G
caanacgngctgacatctgcaggccgaaagagccgtggccttggaaaggnttnanccnccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaagg

SEQ ID NO: 7801 - DNA, 446 bp, Homo sapiens
  misc_feature 59: n = A,T,C or G
ccgcacgagctctagccttcactcctgggctccaaaagctatcccagttgcctgttttncaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttgggg

SEQ ID NO: 7802 - DNA, 500 bp, Homo sapiens
  misc_feature 3, 20, 77: n = A,T,C or G
ganactagtggatccaaagntttccgcacgaggagcgagggacaagactccgactccagctctgacttttttcgcgnttctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagc

SEQ ID NO: 7803 - DNA, 237 bp, Homo sapiens
gcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatc

SEQ ID NO: 7804 - DNA, 439 bp, Homo sapiens
atatctatccataaaacgttctatgatcaggcagtttggcccttgttccctcagaaagtgacagtgatgttccttgcacctttgctgagcaaggtttgatagggatgttccttcaattgggcctttacccaacggggtttcgtaagaaagttgggcaggaaatttctcacggcctgaacccccgtggaatgtttcactttgaccagtgtctgcgaaatggcggggggcttagaaaatggtgcagtttggcagggcgtggtggctcacgcctgtaatcccagcactttgggaggctgaggcgggtggatcacaaggtcaagagatcgagaccatcctggccaacatggtgaaaccctatctctactaaaaatacaaaaaattagccgggcgtggtagcgggtgcctgtagtcccagctactcaggaggctgaggcaggag

SEQ ID NO: 7805 - DNA, 500 bp, Homo sapiens
  misc_feature 2, 4, 50, 53, 61, 108: n = A,T,C or G
anangagcacaaggccttggacagggtggaggagcacccaggctccaggnttnctgctganaaatttctgaacaggctccccaagtttgtgatccggcaaggcgaggngattgacatccggggccccatcagggacaccttgcagaactgctgcccattgcctgcccggatccaggagattgtggtggagacgcccaccttggccgctgagcgagagaggagccaggagtcacccaacacaccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtcca

SEQ ID NO: 7806 - DNA, 499 bp, Homo sapiens
  misc_feature 59: n = A,T,C or G
ccgcacgagcgtaagggctgaggatttttggtccgcacgctcctgctcctgattcaccnctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttggaggtggaagtcaccattgcagatgcttaagtcaactattttaataaattgatgac

SEQ ID NO: 7807 - DNA, 471 bp, Homo sapiens
  misc_feature 3, 57, 59, 352, 442, 459: n = A,T,C or G
cgnacgagaaatcatgttgtcatttatgctttatgtagcctatttttcaatttcctncntttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccattttgactgcaatgatgaaacttgtttatcttccagaggacatatatatatgtgtgtgtgtgtgtattgnacagatacctttaatttgattacactgtttcttgtaaatatgtttctgtataaaatgaaacttttcaagaggattctatgtatatattgnacttattaaataggtantgcctatttacc

SEQ ID NO: 7808 - DNA, 217 bp, Homo sapiens
ctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaacctt

SEQ ID NO: 7809 - DNA, 485 bp, Homo sapiens
gtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgc

SEQ ID NO: 7810 - DNA, 209 bp, Homo sapiens
ctaaccttgtatatacttttattagagtgctgataacaccatattacagcagcatacttacatatctgttttcttaactgtgagctccttgagagcagggactgtgtgtttttgcttttatttcaccagtactcagaactatccacagtatagaaaagcactcaataaatggaataaatgaaaatgaatagataaataaatgatttcac

SEQ ID NO: 7811 - DNA, 340 bp, Homo sapiens
gacacaggtgttctatacattgcaggtaggaagatgcattggtgtatcttctatggagagcaatatgacaagacctttcaaaattatatatacaagtgccttttgacttgggatttttctaggatttctaagatttttttcttttagaaattcttgcacaaaattacaaagatataaatacaagtattttcatgtaacattttgcttatagaaaatgattggaagcaaatccaggtgaggtggcttgtgcctataatcctagctactcaggatggtgaagtggagtgggaggatagcttgagcccagaagttcgagaccagcctgggcaatatagtgaga

SEQ ID NO: 7812 - DNA, 400 bp, Homo sapiens
  misc_feature 71, 214, 222, 226, 269, 381: n = A,T,C or G
gaacatttagctggagctcgcgcgcctgcaggtcgacactagtggatccaaagaattcggcacgagtaggnctacaagacgctacttcccctatcatagaagagcttatcacctttcatgatcacgccctcataatcattttccttatctgcttcctagtcctgtatgcccttttcctaacactcacaacaaaactaactaatactaacatctnagacgctnaggnaatagaaaccgtctgaactatcctgcccgccatcatccctagncctcatcgccctcccatccctacgcatcctttacataacagacgagggtaacgatccctccccttaccatcaaatcaattggccaccaatgggactggaacctacgagtacncccgactacgggggactaa

SEQ ID NO: 7813 - DNA, 221 bp, Homo sapiens
  misc_feature 16, 193: n = A,T,C or G
acaaaatgctgagctngcgcccttgaggtcgacactagtggatccaaagaattcggcacgagcggcacgagcagaggtggaggtgggctgatggcctggctgcctggtggttgatggttttgctccccctaccttttttttttgagtttattctgattgattttttttcttggtttctggataaaccaccctntggggacaggataataaaacatgtaata

SEQ ID NO: 7814 - DNA, 354 bp, Homo sapiens
  misc_feature 18, 22, 30, 33, 260: n = A,T,C or G
gacaataagctggagctncgcncgccctgnggngcgacactagtggatccaaagaattcggcacgaggataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagnggtaccatagtatttggagcttctataggagtggagaggggcagctcattgttgagagttgcatgctgcaccctaatggtcagcaatgaaataa

SEQ ID NO: 7815 - DNA, 400 bp, Homo sapiens
  misc_feature 3, 133, 225, 378: n = A,T,C or G
ganaaaagctggagctcgcgcgcctgcaggtcgacactagtggatccaaagaattcggcacgaggaaaagggaaaagtataaactggccttaaaattgtccaattatagttttataaccagtctattaaaggngtttgtttaaaatggatatagttttagatttgtggtaatgctttggtattttcttggggaagaccttcacctttgcaaacttccctcatgtnaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtnaataagaggagaaggaagagtc

SEQ ID NO: 7816 - DNA, 400 bp, Homo sapiens
  misc_feature 2, 314: n = A,T,C or G
gnaaaagctggagctcgcgcgcctgcaggtcgacactagtggatccaaagaattcggcacgaggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggntggcatcaactaccagcctcccactgtggtgcctggggggagaccctggccaaggtacagagagctgtgtgcatgctgagcaacac

SEQ ID NO: 7817 - DNA, 400 bp, Homo sapiens
  misc_feature 6, 21, 28, 31, 36, 222, 325, 336, 350, 351, 389: n = A,T,C or G
gacccntatttgtgagtcganttaccanttnctggncgctagtggatccaaagaattcggcacgaggtttgtattcacttgacatttggaaatcaatcatgtactgcttcacatctttgatactgctattcaaattttcttactaatacatacattttctatttgttttataagtgccttctctgtaccaggtacagtgcttttgagttctagtgataaagngaaagtgatggatgaaatatgtttttgcgttaaaggtgctcatgtctagtttcagagtcagacatgtaagcagataataataaataataataataagagctgntatttattgancaccttaaggtggnncctgcgctagacccccttttatataaggaaatgctacnttataagtatc

SEQ ID NO: 7818 - DNA, 391 bp, Homo sapiens
  misc_feature 2, 330, 346: n = A,T,C or G
cnaaaaaagctggagctcgcgcgcctgcaggtcgacactagtggatccaaagaattcggcacgagttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggngatgttacttttcagngtactcatatgtctcattttcatctaaaattaaatggcaggaaac

SEQ ID NO: 7819 - DNA, 400 bp, Homo sapiens
  misc_feature 13, 23: n = A,T,C or G
gacattttgctgnagctcgcgcncctgcaggtcgacactagtggatccaaagaattcggcacgagccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagaagcactggcgcgatccccagtcacccaggcctgcctcatgggaggacatc

SEQ ID NO: 7820 - DNA, 399 bp, Homo sapiens
  misc_feature 5, 44, 173: n = A,T,C or G
ctggngctcgcgcgcctgcaggtcgacactagtggatccaaagnaattcggcacgagatgagatgttctccgacatctacaagatccgggagatcgcggacgggttgtgcctggaggtggaggggaagatggtcagtaggacagaaggtaacattgatgactcgctcattggnggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcaca

SEQ ID NO: 7821 - DNA, 112 bp, Homo sapiens
  misc_feature 3, 7, 97: n = A,T,C or G
ganaatntagctggagcttcgcgcgcctgcaggtcgacactagtggatccaaagaattcggcacgaggttttgtacagacattatttccactctggnggataagttcaataa

SEQ ID NO: 7822 - DNA, 169 bp, Homo sapiens
  misc_feature 9: n = A,T,C or G
ttgctggangctcgcgcgccctgcaggtcgacactagtggatccaaagaattcggcacgagtacagtcttagctgacttttttttactctgaactcttatttgaattgttttttgtgcatatatttctgctaccacagagattgtactatacaaataaaaaaattaaaa

SEQ ID NO: 7823 - DNA, 400 bp, Homo sapiens
  misc_feature 16, 27, 28, 36, 40, 93, 275: n = A,T,C or G
gaacaataatactggnaggcctgtgcnncgcactgngggngggacacctagtggatccaaagaattcggcacgagaaaacggctcacattggngtggggatcagtgggcaggaagggatccaggctgtcttggcctccgattactccttctcccagttcaagttcctgcagccgcctcctgctggtgcatgggcgctggtcctacctgcgaatgtgcaagtttctttgctatttcttctacaaaaactttgctttcaccatggtccacttctggnttggcttcttctgtggcttctcagcccagaccgtctatgaccagtatttcatcaccctgtataacatcgtgtacacctccctgccagtcctggctatgggggtctttgatcaggatgtccccgag

SEQ ID NO: 7824 - DNA, 400 bp, Homo sapiens
  misc_feature 223, 224: n = A,T,C or G
gacaataagctggagcctcgcgcgcctgcaggtcgacactagtggatccaaagaattcggcacgagaaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaannattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaat

SEQ ID NO: 7825 - DNA, 400 bp, Homo sapiens
  misc_feature 2, 48, 218, 219, 221, 344, 378: n = A,T,C or G
anctggagctccgcgccgcctgcaggtccgacactagtggatccaaanaattcggcacgagggtgcctcctgcttttatagcagtttatggggagcacttgaaagagcgtgtgtacatgtattttttttctaggcaaacattgaatgcaaacgtgtatttttttaatataaatatataactgtccttttcatcccatgttgcccgctaagtgatattnnanatgtgtggttatactcataataatgggccttgtaagtcttttcaccattcatgaataataataaatatgtactgctggcatgtaatgcttagttttcttgtatttacttctttttttaaatgnaaggaccaaacttctaaactaattgttcttttgntgctttaatttttaaaaattac

SEQ ID NO: 7826 - DNA, 400 bp, Homo sapiens
  misc_feature 149, 223, 226: n = A,T,C or G
gacaatagctggagctcgcgcgccctgcaggtcgacactagtggatccaaagaattcggcacgagtagatatggtataaagtgagactccatagtgtccagaattcttttctttgtatttgtactgatattctctctctcttttccagngtatcaacttttagttatatattttgttcaaaaataacatctgatcatcataaacatcaattatttaaataggntancatgcttcttctgagtgctttaaagtaaacttgagtgtttataagtaagggaattattaagaagaaaccctggtatatccacaagataaatgttaccagtctctaagagtgcgtctcagtggttctcaaacttaaaagtatatcagaatcacctgtaggatttgttataatgca

SEQ ID NO: 7827 - DNA, 184 bp, Homo sapiens
  misc_feature 79, 180: n = A,T,C or G
gacctaagctggagctcgcgcgcctgcaggtcgacactagtggatccaaagaattcggcacgagaattttttttttgcncgtggatacccagttgttccaatatcatttattgaaaagtctatgcttttcctattctgtttttttgttaaccttgtataaaatcaattgactgtaaatgngcag

SEQ ID NO: 7828 - DNA, 399 bp, Homo sapiens
  misc_feature 306, 320, 354, 356, 383, 391: n = A,T,C or G
gacaaaagctggagctcgcgcgcctgcaggtcgacactagtggatccaaagaattcggcacgaggtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggnatgcaaatcttcgngaagaccctgaccgggaagaccatcactctggangnggagcccagtgacaccatcgaaaatgngaaggccnagatccaa

SEQ ID NO: 7829 - DNA, 248 bp, Homo sapiens
  misc_feature 225: n = A,T,C or G
gaaaataagctggagctcgcgcgcctgcaggtcgacactagtggatccaaagaattcggcacgaggacaggcgtgagcccaccgcgcccggcccagcattttatttattaactgtaacaataatcctctttccaaagataacatcactgttagtagtgtctggtatgtttttccagaaaaagaataggcatatactgcatatgaaaatacatatgcttaaatggntttttgcgcaaatcaatttagca

SEQ ID NO: 7830 - DNA, 400 bp, Homo sapiens
  misc_feature 3, 291, 375: n = A,T,C or G
ganaataagctggagctcgcgcgcctgcggtcgacactagtggatccaaagaattcggcacgagagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgnagctcagtaattcctgttactttacagacaggaaagttccagaaactttaagaacaaactctgaaagacctatgagcaaatggngctgaatactttttttttaaagcca

SEQ ID NO: 7831 - DNA, 273 bp, Homo sapiens
  misc_feature 194, 216, 260: n = A,T,C or G
gctggagctcgcgcgccctgcaggtcgacactagtggatccaaagaattcggcacgagctcgtgccgaattcggcacgagtgaaggaggaggcccttgattaggtcagtggtccctgggagccatcggcgagaggcctccagccgggtgacagtctgggctctcgggtactaatctttctaatatggcagtggntggggcacttctgacttgaatngataattctcatatctaataaaaccaagaagtacctcgttgatntcttatagaaaac

SEQ ID NO: 7832 - DNA, 400 bp, Homo sapiens
  misc_feature 5, 222, 223, 224, 225: n = A,T,C or G
gaaantttgctggagctcgcgcgcctgcaggtcgacactagtggatccaaagaattcggcacgagctatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggnnnntggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaa

SEQ ID NO: 7833 - DNA, 385 bp, Homo sapiens
  misc_feature 4, 5, 50, 146, 224, 225: n = A,T,C or G
ttannctggggctccgcgcgcctgcaggtcgacactagtggatccaaagnaattcggcacgaggttcaccacctctatccacccttcattcgcagcgacaccactttccctggaggccagtgaatgttgtttttctctctgtcagnggggtaattcaaccaagcgagagagaagtaggagaagaaaactgtgtgtgtgtgcatgtgtgtgtgtggcgggggggnngggcggtgtttatcaaaacgcaacagtaatttgaactattcagttctggtacaacatagaagcagtgtagtgacctctcgaggctcctttcaggattttggatgtaagaaaggagaattttgatttcaaaaaatggctttgaggtatctattcaaatcta

SEQ ID NO: 7834 - DNA, 362 bp, Homo sapiens
  misc_feature 22, 75, 78, 223, 224: n = A,T,C or G
gacattagctggagctcgcgcncctgcaggtcgacactagtggatccaaagaattcggcacgagctcgtgccganttnggcacgagtcaagatatggaataacagaaactcatatactccttggaaggctaaattgatagaatcatcttggggaaagtttgttattacctatcagcgtatggatccaatactctaagaagacctcataattttacacctaggnnaatattaatattttacaaacttcacatatgtccataaagaaacacaagtaaaaatacttatagcaaaaaactggaaataactaggtccactgataggaaaaataataaaaatggaatgacagtcctgttagaaaataa

SEQ ID NO: 7835 - DNA, 225 bp, Homo sapiens
  misc_feature 26: n = A,T,C or G
gaaaaagctggagctcgcgcgcctgnaggtcgacactagtggatccaaagaattcggcacgagcgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaaaaaaaaaaaaaaaaaaaaaaa

SEQ ID NO: 7836 - DNA, 400 bp, Homo sapiens
gacaataagctggagctcgcgcgcctgcaggtcgacactagtggatccaaagaattcggcacgaggaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtat

SEQ ID NO: 7837 - DNA, 396 bp, Homo sapiens
  misc_feature 194, 199, 297: n = A,T,C or G
tgggacgctagtggatccaaagaattcggcacgagaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccagggngcggnattggtactggtccaggagttatccaggatagattttcacccaccatgggacgtcatcgttcaaatcaactcttcaatggccatgggggacacatcantgcctcccacacaatcgcagtttggagagatgggaggcaagtttatgaaaagccaggggctaagccagctctaccataaccagagtcagggactcttat

SEQ ID NO: 7838 - DNA, 400 bp, Homo sapiens
  misc_feature 3, 28, 223, 224: n = A,T,C or G
ganaataagctggagctcgcgcgcctgnaggtcgacactagtggatccaaagaattcggcacgagattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatnngctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtgg

SEQ ID NO: 7839 - DNA, 400 bp, Homo sapiens
gacaatttgctggagctcgcgcgcctgcaggtcgacactagtggatccaaagaattcggcacgagtgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaaccgttcctccattatttgaatta

SEQ ID NO: 7840 - DNA, 304 bp, Homo sapiens
  misc_feature 6, 303: n = A,T,C or G
aacaanaagctggagctcgcgcgcctgcaggtcgacactagtggatccaaagaattcggcacgaggcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggnc

SEQ ID NO: 7841 - DNA, 400 bp, Homo sapiens
  misc_feature 2, 4, 195: n = A,T,C or G
gngngacactagtggatccaaagaattcggcacgaggtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttntataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttgg

SEQ ID NO: 7842 - DNA, 382 bp, Homo sapiens
  misc_feature 19, 24, 32, 36, 75, 79, 83, 123, 139, 143, 183, 212, 228,247, 268, 360: n = A,T,C or G
gaacaataatgcgtggagnctcgngcgcctgnaggncgacatctagtggatccaaagaattcggcacgagtcttnttcnaggnccggttcatttggcggactgtgacgccacgtgacaagccnatggggcccctgctgntggncactttctggcctgagctcccggaaaagattgatgcggtntacgaggccccacaggaggagaaggctgngttctttgcagggaangaatactggatctactcanccagcaccctggagcgagggnaccccaagccactgaccagcctgggactgccccctgatgtccagcgagtggatgccgcctttaactggagcaaaaacaagaagacatacatntttgctggagacaaattctgga

SEQ ID NO: 7843 - DNA, 357 bp, Homo sapiens
  misc_feature 8, 148, 225, 226, 229, 230, 342: n = A,T,C or G
gaacaatnttgctggagctcgcgcgcctgcaggtcgacactagtggatccaaagaattcggcacgagcaaaaaagcacctggtactaagggtactgctgctgctgctgctgctgctgctgctgctgctgctgctgctgctgctaaagntccagcaaaaaagatcaccgccgcgagtaaaaaggctccagcccagaaggttcctgcccagaaagccacaggccagnnagnngcgcctgctccaaaagctcagaagggtcaaaaagctccagcccagaaagcacctgctccaaaggcatctggcaagaaagcataagtggcaatcataaaaaagtaataaaggnttcttttttgacctg

SEQ ID NO: 7844 - DNA, 400 bp, Homo sapiens
  misc_feature 15, 227, 228: n = A,T,C or G
gaacaataatgctgnagctcgcgcgcctgcaggtcgacactagtggatccaaagaattcggcacgaggcgctgcccactggattggtcccagtggactgaaaggtggtgctctcgagtcaggcgcttagtcccagagagagctgggtgccgcggggcctcgtggtctgtgcctactcagggaaatgacttaggttctcccaggtgctctgttgataaggatggaagnngaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttccta

SEQ ID NO: 7845 - DNA, 400 bp, Homo sapiens
  misc_feature 6, 396: n = A,T,C or G
gaaaantgctggagctcgcgcgcctgcaggtcgacactagtggatccaaagaattcggcacgaggcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggactttgaaagcagctgcagcggaggaaggcgagctcgagagtcaggatgtctcagatttaacaacagttgaaagggaagactcatcattacttaatcctgcagccaaaaaactgaaaatagataccaaagaaaaaaaaaagaaaaaactcgagagtacttntaga

SEQ ID NO: 7846 - DNA, 289 bp, Homo sapiens
  misc_feature 78, 154, 158: n = A,T,C or G
gaacaaaagctggagctcgcgcgcctgcaggtcgacactagtggatccaaagaattcggcacgagtctgccacctgcntccttcagacagttatatcctccttttaaaccattgttgttgagtgtaagatgtccttcatgttttcttataaagncagngtttagaaatgttaccctttctaagttatatacagatcaaatgcttttttctttcacgtacatccatcatttgcaactgctgttcgtacacagaaacaggactgctcaaatgatcctatttgtattttctg

SEQ ID NO: 7847 - DNA, 400 bp, Homo sapiens
  misc_feature 8, 223, 225: n = A,T,C or G
gacaatangctggagctcgcgcgcctgcaggtcgacactagtggatccaaagaattcggcacgaggtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtattncnataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccac

SEQ ID NO: 7848 - DNA, 397 bp, Homo sapiens
  misc_feature 77, 127, 212, 329, 379: n = A,T,C or G
gaacaataagctggagctcgcgcgccctgcaggtcgacactagtggatccaaagaattcggcacgagcaggggtggnagggaattcctggagtgcctggacccccgggacctcctgggcttcccggnttctgtgagccagcctcctgcaccatgcaggctggtcagcgagcatttaacaaagggcctgacccttgaaaggcttactgctgcntggctgtctgcatgaaccacgcctggtgaaggagccttgggtgagaaacaccatccaaagctggggcaaagatgattaccttcagcatgattacaatgtattaccttcagtatgatnacagaagtcctacttgacaatcacatattagaagaacggggctattcagnaaagttctctttcctttt

SEQ ID NO: 7849 - DNA, 152 bp, Homo sapiens
  misc_feature 7, 22, 27, 29, 30: n = A,T,C or G
gaccttntgctgagctcgtgcncctgngnncgcacttgtggatccaaagaattcggacgaggccgagccagcgcctgggcctggaaccgggccgtagcccccccagtttcgcccaccacctccctaccatgggacccccggcaaaagtgaac

SEQ ID NO: 7850 - DNA, 399 bp, Homo sapiens
  misc_feature 216, 217, 218: n = A,T,C or G
ctggagctcgcgcgcctgcaggtcgacactagtggatccaaagaattcggcacgagaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattggggggnnnatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatcttt

SEQ ID NO: 7851 - DNA, 400 bp, Homo sapiens
  misc_feature 6, 7, 120: n = A,T,C or G
gaaaanntgctggagctcgcgcgcctgcaggtcgacactagtggatccaaagaattcggcacgaggaacgcggagagcacgccatgaaggcctcgggcacgctacgagagtacaaggtangtgggtcgctgcctgcccacccccaaatgccacacgccgcccctctaccgcatgcgaatctttgcgcctaatcatgtcgtcgccaagtcccgcttctggtactttgggtctcagttaaagaagatgaagaagtcttcaggggagattgtctactgtgggcaggtgtttgagaagtcccccctgcgggtgaagaactttcgggatctggctgcgctatgactcccgggagcggcaccccacaacatgtaccgggaataccgggacctgaccaccgcaggcg

SEQ ID NO: 7852 - DNA, 141 bp, Homo sapiens
  misc_feature 75, 118: n = A,T,C or G
gaaaaagctggagctcgcgcgcctgcggtcgacactagtggatccaaagaattcggcacgagtgagcgccccgcntcgttcggctgcccccgccccttcccggcccccctcgccgcgngtcctccaaaaaataaaacctta

SEQ ID NO: 7853 - DNA, 400 bp, Homo sapiens
  misc_feature 10: n = A,T,C or G
gaacaatatngctggagctcgcgcgcctgcaggtcgacactagtggatccaaagaattcggcacgagggacaccgggtgtagagggcggtcgcggcgggcagtggccggcagaatgttgactaccagggtatttagcctagttggcaagcgagcaatttccacctctgtgtgtgtaccgagctcatgaaagtgttgtgaagagcgaagacttttcgctcccagcttatgtggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagcttttgctgagatgaacagg

SEQ ID NO: 7854 - DNA, 400 bp, Homo sapiens
  misc_feature 28, 34, 38, 230: n = A,T,C or G
gaacacataatgctggagcctcgtgccnccctgnaggngcgacactagtggatccaaagaattcggcacgaggaaaacttagcacttacctgcccctcccaccccaatgcttccaatctatccccatttctgttaaatcagttttcattgcttacattttcaacactgagcccaatatactgctaggctagtcccatttgctgtctcacgtaagttttttatacttggtnggaattaaaactgactgttccctttgcctcattttctatatagctatcccaaattcatcttgtcccacctaatgggacagcaaaatgcctctcaatgctgttttccacacaaacacatcaggtaatggactggttcgggcagtgtacctcgtgccacctcctactggctg

SEQ ID NO: 7855 - DNA, 220 bp, Homo sapiens
  misc_feature 6, 202: n = A,T,C or G
gaaaangctggagctcgcgcgcctgcaggtcgacactagtggatccaaagaattcggcacgagcatcagacaagagatcattaaaatgtttgatgagagaatggcttactacacctccaggatgcagttccccatggagatggcggcagctccgggacgaccagggcctccagggaaggatggtgctccgggcaggccaggngctccagggtcacctggg

SEQ ID NO: 7856 - DNA, 400 bp, Homo sapiens
  misc_feature 7, 222, 226: n = A,T,C or G
gacaatnagctggagctcgcgcgcctgcaggtcgacactagtggatccaaagaattcggcacgaggctgactctgttagaactctgtccaaaaagtgcatggaatataatttgtaaagcttcccacaattgacaatatatgtgcatgtgtttaaaccaaatccagaaagcttaaacaatagagctgcataatattagtatttattaaagaatcacaattgtnaacntgagaataacttaaggattctagtttagttttttgtaattgcaaattatatttttgctgctgatatattagaataatttttaaatgtcatcttgaaatagaaatatgtattttaagcactcatgcaaaggtaaatgaacactttttaaatgtgtgtgttgcttattttttacat

SEQ ID NO: 7857 - DNA, 193 bp, Homo sapiens
  misc_feature 33, 71, 107, 112, 134, 143: n = A,T,C or G
gaacaatttgctggagctcgcgcgcctgcaggncgacactagtggatccaaagaattcggcacgaggaggnatcaagtgactgatctggaataaatatctcgcagcnctgcngctaacatcacagaacttaagngtgttttgngtgtgtgcccacacgtagacaaatgtgtaccggtgcacacacacagtgca

SEQ ID NO: 7858 - DNA, 104 bp, Homo sapiens
  misc_feature 3, 84, 94: n = A,T,C or G
ganaataagctggagctcgcgcgcctgcaggtcgacactagtggatccaaagaattcggcacgagttttttttttttaattctngggaactatnaagtctttgc

SEQ ID NO: 7859 - DNA, 400 bp, Homo sapiens
  misc_feature 2, 6, 193: n = A,T,C or G
gngacnctagtggatccaaagaattcggcacgaggtttcactgggagaagagtttcccttccttaaggaatatatacttttcagcttgaaaaggggaaataagaggtgattgtgataaatagagtcctccctggaatgctccctcagctcagaatttcacattctgtcctgggataggtcaatctggctttcnggcatctattctcctggctcttgggaggttgggttcattttaaggatgaatctgaaggccaccttgatgggaacttcaggtaaaatcctcagatctctcacaaggtggatccagcacttttaaccagctctagggaaacccagtctcaggtttctatggagggtggaggaaatgacatcttttatagaagtttgctccagattacat

SEQ ID NO: 7860 - DNA, 400 bp, Homo sapiens
  misc_feature 361: n = A,T,C or G
gacaaaagctggagctcgcgcgcctgcaggtcgacactagtggatccaaagaattcggcacgaggcgaaacttgtcattctagatgttctgttgccagtatcaaaaccggcttccaggctgtcacgggcaagcgagcacagctccgtgccaaagctaactaatttgctaatcactgattttgcaaagcttgttgtgggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcanagaaacgtgatatggggtaaagggaggtgcttttttaaa

SEQ ID NO: 7861 - DNA, 400 bp, Homo sapiens
gacaataagctggagctcgcgcgcctgcaggtcgacactagtggatccaaagaattcggcacgagaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtgggggaagaacggtctcagaactgtttgtttcaatt

SEQ ID NO: 7862 - DNA, 378 bp, Homo sapiens
  misc_feature 3, 224: n = A,T,C or G
gancaataagctggagctcgcgcgcctgcaggtcgacactagtggatccaaagaattcggcacgagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgnggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaact

SEQ ID NO: 7863 - DNA, 249 bp, Homo sapiens
  misc_feature 7, 8, 199: n = A,T,C or G
gaaaatnngctggagctcgcgcgcctgcaggtcgacactagtggatccaaagaattcggcacgagtgacacccacaccctcgagctagcagcgtctcctcccttccccgggagagctggctggagacttggagctccgggaagtaggagtcacatttttttctctattctttggggattttttttacatgaataaaagnggatttcagggaaaaaaaaaaaaggggggaaaaaaaaaaaaaaaaaaaaa

SEQ ID NO: 7864 - DNA, 305 bp, Homo sapiens
  misc_feature 2, 3, 164, 173, 176, 219, 221, 222, 225: n = A,T,C or G
annagctggagctcgcgcgcctgcaggtcgacactagtggatccaaagaattcggcacgaggagaatcgcttgaacctgggaggcagatgtttcagtgaactgagatcgtgccactgcactcctgcctggcgacagagcaagactctgtttaaaaaaaaaagcncgggggggnggngcacattctgtaattccagctacttgggaggctgaggcaaggnanntcncttgaacccaggaggcagagtttgcagtaggctgggatcgcaccactgtactccaggttgggtgagcaagactgtcttaa

SEQ ID NO: 7865 - DNA, 351 bp, Homo sapiens
  misc_feature 10, 225, 314, 327: n = A,T,C or G
gaacaatttngctggagctcgcgcgcctgcaggtcgacactagtggatccaaagaattcggcacgaggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccactntgaggcgaggctccaagagtgtggcccgccgggtcctccaagccctggaggggctgaaaatggtggaaaaggaccaagatggcggccgnaaactgacacctnagggacaaaagagatctggacaga

SEQ ID NO: 7866 - DNA, 400 bp, Homo sapiens
  misc_feature 3, 8: n = A,T,C or G
ttnctggncgctagtggatccaaagaattcggcacgagctctctaccaattagcccaggataaatgccatcagaaaaggtatggctttcaagatctagtcattgataaaaagaaatataacttttggaagcccttttgtataaagaaaaagcactcaacttgaagttaaaaggcataggtatgagtcttgactctaccccctgacataggatcaatcatttaacttctctgaggctctgcatctttatctgaaaagccaaggaagaagagggttgttaaaatccaccgaagatcagattctataaacaaaaactctttgttaaattaaccatgacacaaattattctattgtcttccccgaatcccacaaccccctccaacatttaaaattcatctttag

SEQ ID NO: 7867 - DNA, 265 bp, Homo sapiens
  misc_feature 28: n = A,T,C or G
gacaaaaagctggagctcgcgcgcctgnaggtccgacactagtggatccaaagaattcggcacgagctgatgtgtgccttttgttcaacacagtaacccctgcattctgctctgctctaatacactacctggagaaagtcttttccttattttcaataaatgtcagacattattgaaaaaaaaaaaaaaaaaaaaaaaaaaaaaaaaaaaaaaaaaaaaaaaaaaaagaaaaaaaaaaaaaaaaaaaaaaaaaaaaaaaaaaaaa

SEQ ID NO: 7868 - DNA, 400 bp, Homo sapiens
gacaataagctggagctcgcgcgcctgcaggtcgacactagtggatccaaagaattcggcacgaggttgcagacatgggcctactaaactagaaagagcatttgaagagcaaaaggcaaaggttccatcaccatcctgtggaaatacgtgagttgttcatttcagtacacccatagtttctcaacaggtgtagcagatttgtttctaaaggacataggagtgcattttttatatgaaaccagaactggagtggtaatggcacttctgattcaattaacttacttggtgaagctgccagggaaactaaatatgatgaggaagaagaggaatgactggatcaaattaatagaaatagatctttttgcaagcaacataatgattctgatcatcaaccttgaaa

SEQ ID NO: 7869 - DNA, 374 bp, Homo sapiens
  misc_feature 345, 349, 352, 355: n = A,T,C or G
aggacaaaagctggagctcgcgcgcctgcaggtcgacactagtggatccaaagaattcggcacgagatactttcttggttttctaatggagtatatagtttagtcatttcacagactctggcctcctctcctgaaatccttttggatggggaaagggaaggtggggagggtcccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgntggntgntgntggttgtttttctttttct

SEQ ID NO: 7870 - DNA, 400 bp, Homo sapiens
gacaataagctggagctcgcgcgcctgcaggtcgacactagtggatccaaagaattcggcacgagaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaa

SEQ ID NO: 7871 - DNA, 100 bp, Homo sapiens
  misc_feature 7, 68, 71, 76, 80, 81, 86, 94: n = A,T,C or G
gaaaatnagctggagctcgcgcgcctgcaggtcgacactagtggatccaaagaattcggcacgagcgncgntgcanggcnntttcnctatggcntatgca

SEQ ID NO: 7872 - DNA, 400 bp, Homo sapiens
  misc_feature 211: n = A,T,C or G
gacaaaagctggagctcgcgcgcctgcaggtcgacactagtggatccaaagaattcggcacgagaaatgtgactcttctttcatgtagtataattttgtgattcattcatgttgttatctgtattaatacttcgtacatttcccattgtatggatataccacaatttacatatccattcatctgttgatgaacatgtgggctatttccagnggggctgttacagataaaggtgctttgaacattagtgtacaattctttgtatgaacatatgcttcagtttcccttgggtttattctgtttcacctaggagaggagtggctggatcatatggtaggtctatgcttaatattcaagaaactgacaaactgtttccaaagccaatgtgacatttacatttac

SEQ ID NO: 7873 - DNA, 400 bp, Homo sapiens
  misc_feature 226: n = A,T,C or G
gaaaatttgctggagctcgcgcgcctgcaggtcgacactagtggatccaaagaattcggcacgagcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttggagngccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatg

SEQ ID NO: 7874 - DNA, 400 bp, Homo sapiens
  misc_feature 8, 76, 139, 225, 294, 327, 339, 348, 369: n = A,T,C or G
gaacaatnagctggagctcgcgcgcctgcaggtcgacactagtggatccaaagaattcggcacgagccgccgcggnggcggttgctatcgcttcgcagaacctactcaggcagccagctgagaagagttgagggaaagngctgctgctgggtctgcagacgcgatggataacgtgcagccgaaaataaaacatcgccccttctgcttcagtgtgaaaggccacgngaagatgctgcggctggatattatcaactcactgggaacaacagtattcatgctcatcgtatctgggtnggcactgataccagaaaccacaacattgacagntgggggaggggngtttgcacnttgtgacagcagtatgctgtnttgcccgacgggggccctttatttaccggga

SEQ ID NO: 7875 - DNA, 129 bp, Homo sapiens
  misc_feature 7: n = A,T,C or G
gacaatnagctggagctcgcgcgcctgcaggtcgacactagtggatccaaagaattcggcacgaggatttggcacgtcagggtactaagcatgggtgggaactcctgccttataaaaattgtttttgtg

SEQ ID NO: 7876 - DNA, 228 bp, Homo sapiens
gacaataagctggagctcgcgcgcctgcaggtcgacactagtggatccaaagaattcggcacgagatttaattggcatgattttttcatggatgtgtgcttcatttgatctattgtatgtagctcgtgatcacattttctgttggttaacattgttcctagcttatatgatggaattaaatatattctgtgtgaaaaaaaaaaaaaaaaaaaaaaaaaaggggggggg

SEQ ID NO: 7877 - DNA, 190 bp, Homo sapiens
  misc_feature 6, 27, 34, 131, 164: n = A,T,C or G
gaacantttgtctggagctcgcgcgcntgcaggncgacactagtggatccaaagaattcggcacgagctcgtgccgaattcggcacgagataaatacagattccaagctatttagagccttttctacattngggtataattttataactatacagaaatgggcngttttgtttaaatatgtaggacagac

SEQ ID NO: 7878 - DNA, 400 bp, Homo sapiens
  misc_feature 8, 72, 73, 83, 224, 366: n = A,T,C or G
gaacaatnagctggagctcgcgcgcctgcaggtcgacactagtggatccaaagaattcggcacgagacgagnntcaccggagnctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctncatcccaacctggctccctcccacccaaccaactttccccccaacccggaaacagacaagcaacccaaactgaaccccctcaaaagccaaaaaatgggagacaatttcacatggactttggaaaatatttttttcctttgcnttcatctctcaaacttagtttttatctttgacca

SEQ ID NO: 7879 - DNA, 400 bp, Homo sapiens
  misc_feature 2, 7, 91, 126, 202, 204, 222, 226, 254, 262, 312, 318, 352,359, 387, 397: n = A,T,C or G
cntgagntcgacactagtggatccaaagaattcggcacgagcggcacgaggcggtagctgggaccgccgttcagtcgccaatatgcagctntttgtccgcgcccaggagctacacaccttcgaggngaccggccaggaaacggtcgcccagatcaaggctcatgtagcctcactggagggcattgccccggaagatcaagtngngctccttggcaggcgccncccntggaggatgaggccacttctgggccagngcgggggnggaggcccctgactaccctggaagtagcaaggcccgcatgctttggaggnaaaagnccatggtttccctggccccgggcttggaaaaagngaaaggncaaacctcctaagggggccaaacagganaaaaaaaaanaaa

SEQ ID NO: 7880 - DNA, 158 bp, Homo sapiens
  misc_feature 6, 7: n = A,T,C or G
gacaannagctggagctcgcgcgcctgcaggtcgacactagtggatccaaagaattcggcacgagaaaaacatgtcatgtaggttgtctaaaaataaaatgcctttaaactcaaaaaaaaaaaaaaaaaaaaaaaaaaaaaaaaaaaaaaaaaaaaaa

SEQ ID NO: 7881 - DNA, 165 bp, Homo sapiens
  misc_feature 7: n = A,T,C or G
gacaatnagctggagctcgcgcgcctgcggtcgacactagtggatccaaagaattcggcacgagctcgtgccgcatacgtgttcagtgtgaatagtgtttaagttgaaaatattgtaaaaaaattatattttttcaaaaatatttaaaaaaataaataatagtag

SEQ ID NO: 7882 - DNA, 167 bp, Homo sapiens
gacaataagctggagctcgcgcgcctgcaggtcgacactagtggatccaaagaattcggcacgagggaatgagcaaataggcaagtgtttccaaactacttggaggtttacaaaaaatatgtcccagaaaaaaaaaaaatcttaccaagatacgtaaagaaaaaaaa

SEQ ID NO: 7883 - DNA, 400 bp, Homo sapiens
  misc_feature 100: n = A,T,C or G
gaaaataagctggagctcgcgcgcctgcaggtcgacactagtggatccaaagaattcggcacgagcgcagcccagcctcgaaatgcagaacgacgccggngagttcgtggacctgtacgtgccgcggaaatgctccgttagcaatcgcatcatcggtgccaaggaccacgcatccatccagatgaacgtggccgaggttgacaaggtcacaggcaggtttaatggccagtttaaaacttatgctatctgcggggccattcgtaggatggggtgagtcagatgattccattctccgattggccaaggccgatggcatcgtctcaaagaacttttgactggagagaatcacagatgtggaattatttgtcataaataaataaatgaaaacctaaaaaaaaaa

SEQ ID NO: 7884 - DNA, 400 bp, Homo sapiens
  misc_feature 66, 225, 383: n = A,T,C or G
gacaaaagctggagctcgcgcgcctgcaggtcgacactagtggatccaaagaattcggcacgaggngacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgntgaacttgttgctgagggcaacagcaggttcacttacactgttcttgtagatggctgctctaaaaagacaaatgaatgggggaaagacaatcattgaatacaaaacaaataagccatcacgcctgcccttccttgatattgcacctttggacatcggnggtgctgaccaggaatt

SEQ ID NO: 7885 - DNA, 400 bp, Homo sapiens
gaaaataagctggagctcgcgcgcctgaggtcgacactagtggatccaaagaattcggcacgagagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctgggggatggggcccatggccacagagctggagcccctgtgca

SEQ ID NO: 7886 - DNA, 400 bp, Homo sapiens
  misc_feature 67, 136, 222: n = A,T,C or G
gaaaaagctggagctcgcgcgcctgcaggtcgacactagtggatccaaagaattcggcacgagcggnacgaggaacagctctttggacactaggaaaaaaccttgtagagagagtaaaaaatttaacacccatagnaggcctaaaagcagccaccaattaagaaagcgttcaagctcaacacccactacctaaaaaatcccaaacatataactgaactcctnacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacag

SEQ ID NO: 7887 - DNA, 400 bp, Homo sapiens
gacaaaagctggagctcgcgcgcctgcggtcgacactagtggatccaaagaattcggcacgagaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttga

SEQ ID NO: 7888 - DNA, 398 bp, Homo sapiens
  misc_feature 285: n = A,T,C or G
gacaataagctggagctcgcgcgcctgcaggtcgacactagtggatccaaagattcggcacgaggccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgngaaagtgtataactacaatcacctaatgcccacaaggtactctgtggatatccccttggacaaaactgtcgtcaataaggatgtcttcagagatcctgctcttaaacgcaagg

SEQ ID NO: 7889 - DNA, 400 bp, Homo sapiens
  misc_feature 27, 32, 34: n = A,T,C or G
gaaccataatgctgaaggctcgtgccncctgngngcgacactagtggatccaaagaattcggcacgagggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagtt

SEQ ID NO: 7890 - DNA, 397 bp, Homo sapiens
  misc_feature 3, 5, 205, 243, 254, 298, 312, 335, 342: n = A,T,C or G
tgngngcgacactagtggatccaaagaattcggcacgagattctgcaattatttttgagactcccctccgagtggacgttgcagtgctgaaagcgcgagcgaagctgctgcagaaatacctgtgtgacgagcagaaggagctacaggcgctctacgccctccaggccctttgtagtgaccttagaacagcctcccaacctgctgnggatgttctttgacgcacttgtatgacgaggacgtggngaaggaggatnccttctacagttgggagagtaacaaggaccccgctgagcagcangggcaagggtgtgncccttaaatctgtcacagccttnttcaagnggctccgggaagcagaggaggagtctgaccacaactgagggctgggggggccggg

SEQ ID NO: 7891 - DNA, 400 bp, Homo sapiens
  misc_feature 136, 162: n = A,T,C or G
gaaaataagctggagctcgcgcgcctgcaggtcgacactagtggatccaaagaattcggcacgagctcgtgccgaattcggcacgagcatcgatgggcggcggaaaatagcctttgccatcactgccattaagggngtgggccgaagatatgctcatgtggngttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctg

SEQ ID NO: 7892 - DNA, 400 bp, Homo sapiens
gacaataagctggagctcgcgcgcctgcaggtcgacactagtggatccaaagaattcggcacgaggtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccctaaaatactagactattagattcaggcatagtaccattttctagccatggggaaataagataaagagacaatggccatggtacatgcctctctggggtgtcacctcaagacacagagatccagtattccttgcaatagaggagctttgggtatttcactaatctt

SEQ ID NO: 7893 - DNA, 166 bp, Homo sapiens
  misc_feature 3, 20, 90, 91: n = A,T,C or G
tgntgaagctgtgttgcctntagctgggacactagtggatccaaagaattcggcacgagaggaagacccaggaaaggtgtgagctggaannccttgaacctacctcatcctcctggagggtgtggctaccctcgccaccccaaattccatgtcaataaagaacagc

SEQ ID NO: 7894 - DNA, 131 bp, Homo sapiens
  misc_feature 3, 11, 85, 93, 101, 102, 119, 124: n = A,T,C or G
ccntgaaggtngacactagtggatttaaacattcggcacgagcggcacgaggaggagggggaggtgagctgatggcctggttgcntggggggngatggttnngctccccctaccttttnttttngagttta

SEQ ID NO: 7895 - DNA, 349 bp, Homo sapiens
  misc_feature 16, 203, 257, 325: n = A,T,C or G
tgctggagctcgcgcnccctgcagggtccgacactagtggattcaaagaattcggcacgaggataatttatataactagaataatttttttcctttcttttatggacctaaatctgccaattgggaattttgtgcctgaaatatgaagttactttttatagataatcagtgcttttaagtccctaaaaggctcctgctgaagnaatgatgatgttaataataaaagcctttgaaaggctgaaaacctacatagtggnaccatagtatttggagcttctataggagtggagaggggcagctcattgttgagagttgcatgctgcancctaatggtcagcaatgaaataaa

SEQ ID NO: 7896 - DNA, 400 bp, Homo sapiens
  misc_feature 42, 43, 160, 215, 217, 221, 273, 318, 338, 348, 371: n = A,T,C or G
tgctggagctcgcgcgccctgcaggtcgacactagtggattnnaagaattcggcacgaggccacatatgcccctgtcatctctgctgagaaagcctaccatgaacagctttctgtagcagagatcaccaatgcttgctttgagccagccaaccagatggngaaatgtgaccctcgccatggtaaatacatggcttgctgcctgttgtaccgtggngncggnggttcccaaagatgtcaatgctgccattgccaccatcaaaaccaagcgcagnatccagtttgtggattggtgccccactggcttcaaggttggcatnaactaccagcctcccactgnggggcctggnggagacctggccaaggtacaganagctgtgtgcatgcttgagcaacaccaca

SEQ ID NO: 7897 - DNA, 188 bp, Homo sapiens
  misc_feature 3, 28, 34, 69, 76, 78, 79, 80, 130, 185: n = A,T,C or G
cgnacttttgctggagctcgcgcccctncgggtncgacactagtggatttcaaagaattcggcacgagnatgagangnnntccgacatctacaagatccgggagatcgcggacgggttgtgcctggaggnggaggggaagatggtcagtaggacagaaggtaacattgatgactcgctcattggngga

SEQ ID NO: 7898 - DNA, 178 bp, Homo sapiens
  misc_feature 11, 27, 60, 68, 69, 70, 71, 103, 136, 171, 174: n = A,T,C or G
gctggaacctngaagcccctgcacgtngacactagtggtttcaaacaattcggcacgagnaaagagcnnnnaccagctcctaagccctattaagaagaggccnggtcctctaatgccttgtttccatttcagttgntctttgagagacagaatgatgtactaaccattcgngantatt

SEQ ID NO: 7899 - DNA, 191 bp, Homo sapiens
  misc_feature 55, 93, 140, 169, 172, 179, 189: n = A,T,C or G
tgcagggtctgacactagtggatcttaagaattccggcacgaggatgcctcctgntttttatagcagtttatggggagcacttgaaagagcgngtgtacatgtatttcttttttctaggcaaacattgaatgcaaaccgngtattttttttaatataaatatataaacnggnccttttncatcccatgntg

SEQ ID NO: 7900 - DNA, 400 bp, Homo sapiens
  misc_feature 51, 77, 151, 227, 342, 367: n = A,T,C or G
ccgaacaattgctggagctcgcgcccctgcaggtcgacactagtggatccnaagaattcggcacgagtagatatggnataaagtgagactccatagtgtccagaattcttttctttgtatttgtactgatattctctctctcttttccagngtatcaacttttagttatatattttgttcaaaaataacatctgatcatcataaacatcaattatttaaataggatngcatgcttcttctgagtgctttaaagtaaacttgagtgtttataagtaagggaattattaagaagaaaccctggtatatccacaagataaatgttaccagtctctaagagtgcgnctcagtggttctcaaacttaaaagnatatcagaatcacctgtaggatttgttataatg

SEQ ID NO: 7901 - DNA, 400 bp, Homo sapiens
  misc_feature 12, 37, 50, 52, 82, 85, 153, 154, 162, 186, 226, 228, 230,280, 320, 349, 351, 364: n = A,T,C or G
cccgaacattangctggagctcgcgccccctgcaggncgacactagtggntncaaagaattcggcacgagaatttttttttngcncgtggatacccagttgttccaatatcatttattgaaaagtctatgcttttcctattctgtttttttgnnaaccttgnataaaatcaattgactgtaaatgngcaggtttatttttagattatcaattcttagtttatgggngngnttataccaggaccaaatcaaatttaatgagaaaattttttcaatcatggngcctattaccagttatcttatggcataataaaaattaaangtaggagaatatctttaacttcacctttngnatctcaaaggagnctctggccagcttataacttacttactctaagacat

SEQ ID NO: 7902 - DNA, 326 bp, Homo sapiens
  misc_feature 12, 14, 43, 44, 61, 127, 206, 219, 223, 240, 267, 278, 285,312, 320: n = A,T,C or G
tctggagcctcncncgccctgcaggtcgacactagtggatttnnagaattcggcacgaggnctgagaggggggatgcaagatcttcgtgaagaccctgaccggcaagaccatcaccctggaaggggngcccagtgacaccatcgaaaatgtgaaggccaagatccaggataaagaaggcatccctcccgaccagcagaggctcatntttgcaggcaagngggnggaagatggccgcactntttctgactacaacatccagaaggagncgacccctgcncctgggncctgcgtctgagagggtgggattgcanatcttcgntgaaga

SEQ ID NO: 7903 - DNA, 240 bp, Homo sapiens
  misc_feature 16, 40, 214, 218, 220, 222: n = A,T,C or G
agctggagctcgcgcncctgcaggtcgacactagtggatncaaagaattcggcacgaggacaggcgtgagccaccgcgcccggcccagcattttatttattaactgtaacaataatcctctttccaaagataacatcactgttagtagtgtctggtatgtttttccagaaaaagaataggcatatactgcatatgaaaatacatatgcttaaangggntntngcgcaaatcaatttagca

SEQ ID NO: 7904 - DNA, 187 bp, Homo sapiens
  misc_feature 6, 71, 73, 77, 153: n = A,T,C or G
actttngctggagctcgcgccccctgcaggtcgacactagtggattcaaagaattcggcacgagagcgtgngngccngagatgtactgttattagctgggaagaccaattctaacagcaaataacagtctgagactcctcatacctcagtggntagaagcatgtctctcttgagctacagtagaggg

SEQ ID NO: 7905 - DNA, 258 bp, Homo sapiens
  misc_feature 23, 24, 51, 131, 175, 178, 181, 205: n = A,T,C or G
tgcaggtcgacactagtggatcnnaagaattcggcacgagctcgtgccganttcggcacgagtgaaggaggaggcccttgattaggtcagtggtccctgggagccatcgggcgagaggcctccagccgggngacagtctgggctctcgggtactaatctttctaatatggcaggnggntgngggcaccttctgacttgaatgggngaattctcatatctaataaaaccaagaagtacctcgttgatatcttatagaaa

SEQ ID NO: 7906 - DNA, 292 bp, Homo sapiens
  misc_feature 2, 14, 59, 62, 106, 153, 229, 255, 288: n = A,T,C or G
cnggggggcaaggngaatgtggaagatgctggaggagaaaccctgggaaggctcctggntgnctacccatggacccagaggttctttgacagctttggcaacctgncctctgcctctgccatcatgggcaaccccaaagtcaagggggggggnaagaaggtgcttgacttccttgggagatgccataaagcacctggatgatctcaagggcacctttgcccagctgagngaactgcactgggacaagctgcatgnggatcctgagaacttcaagctcctgggaaatgngctg

SEQ ID NO: 7907 - DNA, 124 bp, Homo sapiens
  misc_feature 15, 21, 27, 38, 45, 52, 97, 120: n = A,T,C or G
gaaaaaaaccccaantttaanctgggnccttcgaagcnccctgcnggtgcgnacactcagtggcatccaaagaatcggcacgagggtcaccacctgntatccacccttcattgcgcaagngaca

SEQ ID NO: 7908 - DNA, 377 bp, Homo sapiens
  misc_feature 61, 69, 71, 80, 145, 220, 249, 304, 341, 346, 349: n = A,T,C or G
agctggagctcgcgcccctgcaggtcgacactagtggtttcaaagaattcggcacgagctngggccggntncggcacgantcaagatatggaataacagaaactcatatactccttggaaggctaaattgatagaatcatcttgnggaaagtttgttattacctatcagcgtatggatccaatactctaagaagacctcataattttacacctaggggantattaatattttacaaacttcacatatgnccataaagaaacacaagtaaaaatacttatagcaaaaaactggaaataactaggnccactgataggaaaaataataaaaatggaatgacagncctgntanaaaataacaacagcatgtttataaaaaa

SEQ ID NO: 7909 - DNA, 148 bp, Homo sapiens
  misc_feature 23, 129: n = A,T,C or G
agaattcggcacgagcgcaaagngggtctcattgctgcccgccggactggacgtctccggggaaccaagactgtgcaggagaaagagaactagtgctgagggcctcaataaagtttgtgtttatgcccnaaaaaaaaaataaataaaa

SEQ ID NO: 7910 - DNA, 184 bp, Homo sapiens
  misc_feature 37, 41, 64: n = A,T,C or G
gctggagctcgcgcccctgcaggtcgacactagtggntttnaagaattcggcacgaggaaatanacctaattttcctcaagggaattatggagaatcctattgtaaaatcacttgctaaggctcatgagaggctagaagattccaaactagaagctgtcagtgacaataacttggaattagtca

SEQ ID NO: 7911 - DNA, 400 bp, Homo sapiens
  misc_feature 11, 12, 123, 220, 382: n = A,T,C or G
ctggagctcgnncgcctgcaggtcgacactagtggatcttaagaattcggcacgagattcagctccagtctttacataccatgaataaaacattaaaacatcatatggagaagtttacatggngattgttcacctgcagtactgtggagttttaacattttgtcctcttttcagtgaaacagagtaaaaatattcatctaccattactgttattggctgnttttgttttattttttgatggtaatattctatccttatgacactattgcaaccaaattggctttaccatcttggctttagtaggtatagaagacaatggattaccatctttattgctggaatgtgttaagcattatatgctagtagaatctagtttaattgnttcaggtggaaagtattc

SEQ ID NO: 7912 - DNA, 398 bp, Homo sapiens
  misc_feature 3, 4, 85, 159, 184, 267: n = A,T,C or G
tgnnatgacgatattgatgctgacgtgctgcaaaattaccaagaatacaatctggccaacatcatctactactctctgaaggagnccaccactagtgagcagagtgccaggatgacagccatggacaatgccagcaagaatgcttctgagatgaggggncaaattgacattgacattcaaccgnacccgccaagctgtcatcacaaaagagttgattgaaattatctctggtgctgcagctctgtaaagaaggaaaattcagccagntgattttgtttttagcttactgctgcctttgtccgaagaaaccgttcctccattatttgaattactgaagacagcaagatatttgtaaattatcttaaaataaacaacttaaaataaaaaaaaaaaaaaaa

SEQ ID NO: 7913 - DNA, 313 bp, Homo sapiens
  misc_feature 14, 64, 169, 220, 263, 272, 282: n = A,T,C or G
ctggagctcgcgcnccccgaggtcgacactagtggatccattagtaattcggcacgaggcgggnatgggatcctatgtgccccccaggcggctggcagtgcccacggaagggtccactgaggtccctgagatggatacctctacctgacatggcctgaagatgcagggnagaggaatttgcccatggacagtgacccaaaggactaaggctggggagggngcgggccaaccccctttttgcctctgggtttgggggaagcggnagggcctcnttctttgggngcccctgccccccaataaaaggaactggggc

SEQ ID NO: 7914 - DNA, 123 bp, Homo sapiens
  misc_feature 2, 5: n = A,T,C or G
gngtnttgctcatgactgcagtatgcatgtatttttttccttctctgtgttttctaaacttacactaaaggattcatcaaatcatcttgttcagatggctcaggattgtatttattttgctta

SEQ ID NO: 7915 - DNA, 100 bp, Homo sapiens
  misc_feature 18, 19, 37, 38, 41, 46, 49, 52, 64, 65, 66, 70, 74, 78, 79,81, 89, 93, 94, 97: n = A,T,C or G
tgggacactagtggatcnnttagaattcggcacgagnnttnttcanggnccngttcatttgacnnnctgngacnccanncnacaagccnatgnngcncct

SEQ ID NO: 7916 - DNA, 117 bp, Homo sapiens
  misc_feature 1, 7, 30, 81, 82: n = A,T,C or G
ncctggnttggtcccagtggactgaaaggnggtgctctcgagtcaggcgcttagtcccagagagagctgggtgccgcgggnntcgtggtctgtgcctactcagggaaatgacttagg

SEQ ID NO: 7917 - DNA, 270 bp, Homo sapiens
  misc_feature 17, 40, 41, 43, 68, 76, 148, 154, 219, 220, 235: n = A,T,C or G
ctggagctcgcgcgccngcaggtcgacactagtggatccnnanaattcggcacgagtctgccactgcntccttcanacagttatatcctccttttaaaccattgttgttgagtgtaagatgtccttcatgttttcttataaagtcagngtttanaaatgttaccctttctaagttatatacagatcaaatgcttttttctttcacgtacatccatcatnngcaactgctgttcgnacacagaaacaggactgctcaaatgatcctatttg

SEQ ID NO: 7918 - DNA, 204 bp, Homo sapiens
  misc_feature 44, 45, 68, 69, 73, 74, 94: n = A,T,C or G
ctggagcctccgcgccgccccgcaggtcgacactagtggatccnnagtaattcggcacgagggtgggnngggnnttgctcatgactgcagtatncatgtatttttttccttctctgtgttttctaaacttacactaaaggattcatcaaatcatcttgttcagatggctcaggattgtatttattttgcttaccccgtgctctt

SEQ ID NO: 7919 - DNA, 177 bp, Homo sapiens
  misc_feature 6, 53, 56, 106: n = A,T,C or G
ccctgnaggttcgacactagtggatccattagtaattcggcacgagcaggggnggngggaattcctggagtgcctggacccccgggacctctctgggcttcccggnttctgtgagccagcctcctgcaccatgcagggctggtcagcggagcatttaacaaagggcctgacccttga

SEQ ID NO: 7920 - DNA, 400 bp, Homo sapiens
  misc_feature 16, 17, 37, 42, 45, 47, 48, 118, 195, 201: n = A,T,C or G
cgacactagtggatcnnttttaattcggcacgaggcngagcnagngnntgggcctggaaccgggccgtagcccccccagtttcgcccaccacctccctaccatggacccccgcaaagngaacgagcttcgggcctttgtgaaaatgtgtaagcaggatccgagcgttctgcacaccgaggaaatgcgcttcctgngggagngggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggggtgattgaaccagacactgatgctcctcaaggaaatgg

SEQ ID NO: 7921 - DNA, 400 bp, Homo sapiens
  misc_feature 13, 44, 63, 70, 112, 217, 222, 347: n = A,T,C or G
tctggagctcgcncgccctgcaggtcgacactagtggatccttngaattcggcacgagaaggncctgcgngccaacaatgtcttatctggaggcaccactatgtaccctggnattgctgatcgtatgcagaaggaaatcactgctctggctcctagcaccatgaagattaagattattgctccccctgagcgtaaatactctgtctggattgggggnggggntcctggcctctctgtccaccttccagcaaatgtggattagcaagcaagagtacgatgaggcaggcccatccattgtccaccgcaaatgcttctaagatgccttctctctccatctaccttccagncaggatgacggtattatgcttcttggagtcttccaaaccaccttccctcatct

SEQ ID NO: 7922 - DNA, 147 bp, Homo sapiens
  misc_feature 6: n = A,T,C or G
acgccntgaaggcctcgggcacgctacgagagtacaaggtagtgggtcgctgcctgcccacccccaaatgccgcacgccgcccctctaccgcatgcgaatctttgcgcctaatcatgttttttcctagtcccgcttctggtgctggg

SEQ ID NO: 7923 - DNA, 328 bp, Homo sapiens
  misc_feature 25, 137, 148, 149, 178, 179, 269, 294: n = A,T,C or G
aattcggcacgagggacaccggccnggagagggcggtcgcgccgggcagtggcggcagaatgttgactaccagggtatttagcctagttggcaagcgagcaatttccacctctgtgtgtgtacgagctcatgaaagngttgggaaganntaagacttttcgctcccagcttatggggnncggcgtgaccaccccttgccggagggggccatgtcaagcacctgtctgccagccagaaggcactgaaggagaaggagaaggcctcctggngcagcctctccatggatgagaaagncgaggttgtatcgcatttaagttcaaaggagagc

SEQ ID NO: 7924 - DNA, 400 bp, Homo sapiens
  misc_feature 3, 5, 151, 152, 156, 365, 366: n = A,T,C or G
gtnancacttacctgcccctcccaccccaatgcttccaatctatccccatttctgttaaatcagttttcattgcttacattttcaacactgagcccaatatactgctaggctagtcccatttgctgtctcacgtaagttttttatacttgnngggngggtaaaactgactgttccctttgcctcattttctatatagctatcccaaattcatcttgtcccacctaatgggacagcaaaatgcctctcaatgctgttttccacacaaacacatcaggtaatggactggttcgggcagtgtactcgtgccacctcctactggctgaaagaatctgctgttaaatattcaggaattctataatttagnngctcaacacagcatggggagagccttttacagga

SEQ ID NO: 7925 - DNA, 400 bp, Homo sapiens
  misc_feature 12, 61, 218, 232, 377, 390: n = A,T,C or G
tctggagctcgnacgcctgcaggtcgacactagtggatccttagaattcggcacgaggcgngatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggngtgactcacatcgngcgggaagtcgacaggccgggatccaaggtgaacaagaaggaggtggtggaggctgtgaccattgtagagacaccacccatggtggttgtgggcattgtgggctacgtggaaacccctcgaggcctcccggaccttcaagactgncttttgctgagcncatcaggtga

SEQ ID NO: 7926 - DNA, 400 bp, Homo sapiens
  misc_feature 23, 51, 197, 198, 202, 332, 353, 357: n = A,T,C or G
tgcaggtcgacactagtggatcntaagaattcggcacgaggctgactctgntagaactctgtccaaaaagtgcatggaatataatttgtaaagcttcccacaattgacaatatatgtgcatgtgtttaaaccaaatccagaaagcttaaacaatagagctgcataatattagtatttattaaagaatcacaattgtnnacgngagaataacttaaggattctagtttagttttttgtaattgcaaattatatttttgctgctgatatattagaataatttttaaatgtcatcttgaaatagaaatatgtattttaagcactcatgcaaaggnaaatgaacactttttaaatgngggngttgcttattttttacataagaattgaaacattgaactgaaca

SEQ ID NO: 7927 - DNA, 236 bp, Homo sapiens
  misc_feature 2, 103, 141, 161, 233: n = A,T,C or G
gngtattctcctggctcttgggaggttgggttcattttaaggatgaatctgaaggccaccttgatgggaacttcaggtaaaatcctcagatctctcacaaggnggatccagcacttttaaccagctctagggaaacccagnctcaggtttctatggggggnggaggaaatgacatccttttatagaagtttgctccagattacatgagcctgatttattaaaggacagggccngaa

SEQ ID NO: 7928 - DNA, 400 bp, Homo sapiens
  misc_feature 22, 49, 51, 52, 87, 200, 204, 215, 360: n = A,T,C or G
tgcaggtcgacactagtggatnttaagaattcggcacgaggcgaaactngnnattctagatgttctgttgccagtatcaaaaccggnttccaggctgtcacgggcaagcgagcacagctccgtgccaaagctaactaatttgctaatcactgattttgcaaagcttgttgtggagatgtggctggacaggtttgccatgngagnggatataccgntgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaaggngggtgccttttttaaaatcgttcatagacttctgtaaaat

SEQ ID NO: 7929 - DNA, 129 bp, Homo sapiens
  misc_feature 62, 127: n = A,T,C or G
aagaattcggcacgaggagtacttctagagcggccgcgggcccatcgattttccacccgggnggggtaccaaggtaagtgtacccaattcgccctatagtgagtcgtattacaattcactgggccgnga

SEQ ID NO: 7930 - DNA, 357 bp, Homo sapiens
  misc_feature 23, 85, 177, 271, 307: n = A,T,C or G
aagaattcggcacgagaaaaagntcgcctgcaatggtactgtaattgagcatccggaatatggagaagtaattcagctacagggngaccaacgcaagaacatatgccagttcctcgtagagattggactggctaaggacgatcagctgaaggttcatgggttttaagtgcttggggntcactgaagcttaagtgaggatttccttgcaatgagtagaatttcccttctctcccttgtcacaggtttaaaaacctcacagcttgtataatgnaaccatttggggtccgcttttaacttggactagtgnaactccttcatgcaataaactgaaaagagccatgcaaaaaaaaaaaaaaa

SEQ ID NO: 7931 - DNA, 210 bp, Homo sapiens
  misc_feature 95: n = A,T,C or G
aggaattcggcacaagtgacacccacaccctcgagctagcagcgtctcctcccttccccgggagagctggctggagacttggagctccgggaagnaggagtcacatttttttctctattctttggggattttttttacatgaataaaagtggatttcatggggaaaaaaaaaaagggggagaaaaaaaaaaaaaaaaaaaaaaaaaaaaa

SEQ ID NO: 7932 - DNA, 286 bp, Homo sapiens
  misc_feature 100, 145, 151, 237, 244, 267, 273: n = A,T,C or G
ctgcaggtcgacactagtggattcaaagaattcggcacgaggagaatcgcttgaacctgggaggcagatgtttcaagtgaactgagatcgtgccactgcnctcctgcctggcgacagagcaagactctgtttaaaaaaaaaagcncggggnggggggggcacattctgtaattccagctacttgggaggctgaggcaggaaaatcacttgaacccaggaggcaagagtttgcagtangcttggnatcccaccactgtactccagggngggggngcaagactgtctt

SEQ ID NO: 7933 - DNA, 303 bp, Homo sapiens
  misc_feature 10, 21, 27, 44, 56, 148, 181, 183, 200, 259, 302: n = A,T,C or G
tagaattcgncacgagggggngggccnagagcttgctccctacnatgagaactggntctacacgcgagctgcttccacagcgcggcacctgtacctccggggtggcgctggggttggctccatgaccaagatctatgggggacgtcanagaaacggcgtcattgcccagccactggggggngnggctccaagagtgtggnccgccgggtcctccaagccctggaggggctgaaaatggtggaaaaggaccaaggatggnggccgcaaacttgacacctaagggacaaagagatctggacaana

SEQ ID NO: 7934 - DNA, 219 bp, Homo sapiens
  misc_feature 20, 22, 138: n = A,T,C or G
agaattcggcacgagctgangngcgccttttgttcaacacagtaacccctgcattctgctctgctctaatacactacctggagaaagtcttttccttattttcaataaatgtcaggacattattgaaaaaaaaaaaanaaaaaaaaaaaaataaaaaaaaaaaaaaaaaaaaaagggggggggaaaaaaaaaaaaaaaaaaaaaaaaaaaaaaaaaaaa

SEQ ID NO: 7935 - DNA, 400 bp, Homo sapiens
  misc_feature 15, 40, 41, 60, 67, 188, 218, 219, 220, 244, 395: n = A,T,C or G
gctggagctcgagcncctgcaggtcgacactagtggatcnnaagaattcggcacgagggngcgggcntgggcctactaaactagaaagagcatttgaagagcaaaaggcaaaggttccatcaccatcctgtggaaatacgtgagttgttcatttcagtacacccatagtttctcaacaggtgtagcangatttgtttctaaaggacataggagtgcgnnntttatatgaaaccagaactggagnggtaatggcacttctgattcaattaacttacttggggaagctgccagggaaactaaatatgatgagaagaagaggaatgactggatcaaattaatagaaatagatctttttgcaagcaacataatgattctgatcatcaaccttgaaaagnaaatt

SEQ ID NO: 7936 - DNA, 314 bp, Homo sapiens
  misc_feature 61, 65, 66, 69, 155, 220, 267: n = A,T,C or G
gctggagctcgcgccccctgcaggtcgacactagtggatctttaagaattcggcacgaganactnnctngggtttctaatggagtatatagtttagtcatttcacagactctggcctcctctcctgaaatccttttggatggggaaagggaaggnggggagggtcccgaggggaaggggaccccagcttccctgtgcccgctcaccccactccaccaggncccggtcgccagccggagtctcctctctaccgccactgtcacaccgnagcccacatggatagcacagttgtcaagacaagattccttcagattc

SEQ ID NO: 7937 - DNA, 400 bp, Homo sapiens
  misc_feature 2, 4, 27, 52, 105, 161, 204, 206, 397: n = A,T,C or G
gngnccctgaggtgcgacactagtggnttcaaagaattcggcacgagagggntctcagctacctctgggtcattctgtaatgtaaatgttgttaataagaatggnttttacataaattatgcaaaggttaacaagcagtaacactgcactcctcaaaaagnggcggatgtaatgaaaggcccttttgatatccttgatttttcntngggtatctgtttgggcaccggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgngca

SEQ ID NO: 7938 - DNA, 100 bp, Homo sapiens
  misc_feature 4, 23, 47, 71, 78, 80: n = A,T,C or G
aacnttttgctggagctcgcgcncctgcaggtcgacactagtggatncaaagaattcggcacgagcggcgntgcaggncnctttcactatggcctatcaa

SEQ ID NO: 7939 - DNA, 186 bp, Homo sapiens
  misc_feature 48, 67, 73, 75, 76, 114, 150, 151: n = A,T,C or G
acattttgctggagctcgcgccccctgcaggtcgacactagtggatcnaaagaattcggcacgaganaggggncnnttctttcatgtagtataattttgtgattcattcatgtngttatctgtattaatacttcgtacatttcccattgnntggatataccacaatttacatatccattcatctgt

SEQ ID NO: 7940 - DNA, 400 bp, Homo sapiens
  misc_feature 176: n = A,T,C or G
aaagaattcggcacgagccgccgcgggggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgngaagatgctgcggctggatattatcaactcactggtaacaacagtattcatgctcatcgtatctgtgttggcactgataccagaaaccacaacattgacagttggtggaggggtgtttgcaccttgtgacagcagtatgctgtcttgccgacggggcccttatttaccggaagcttctgttcaatcccagcggtccttaccagaaaaagcctgtgcatgaaaaa

SEQ ID NO: 7941 - DNA, 113 bp, Homo sapiens
  misc_feature 2, 4, 87, 89, 98, 100, 103: n = A,T,C or G
cngncagggtactaagcatgggtgggaactcctgccttataaaaattgtttttgtgttcttaaaaaaaaaaaaaaaaaacctcgggngnccttttagngnggncgggggccct

SEQ ID NO: 7942 - DNA, 146 bp, Homo sapiens
  misc_feature 19, 110: n = A,T,C or G
aagaattcggcacgagctngggccgaattcggcacgagataaatacagattccaagctatttagagccttttctacatttgggtataattttataactatacagaaatgngctgttttgtttaaatatgtaggacagacaaggatt

SEQ ID NO: 7943 - DNA, 400 bp, Homo sapiens
  misc_feature 18, 22, 111, 115, 147, 148, 172, 173, 315: n = A,T,C or G
aagaattcggcacgagangagncccaccggagcctggggcaagacagtgattgaatacaaaaccaccaagacctcccgcctgcccatcatcgatgtggcccccttggacgntggngccccagaccaggaattcggcttcgacgttgnncctgtctgcttcctgtaaactccnngggtcccaacctggctccctcccacccaaccaactttccccccaacccggaaacagacaagcaacccaaactgaaccccctcaaaagccaaaaaatgggagacaatttcacatggactttggaaaatatttttttcctttgnattcatctctcaaacttagtttttatctttgaccaaccgaacatgaccaaaaaccaaaagtgcattcaaccttaccaaaaaaaaa

SEQ ID NO: 7944 - DNA, 255 bp, Homo sapiens
  misc_feature 21, 25, 30, 101, 119, 126, 172, 177: n = A,T,C or G
aagaattcggcacgagcgggncgcnggggnagctgggaccgccgttcagtcgccaatatgcagctctttgtccgcgcccaggagctacacaccttcgaggngaccggccaggaaacggncgcccanatcaaggctcatgtagcctcactggagggcattgccccggaagatnaaggngggctcctggcaggcgcgcccctggaggatgaggccactctgggccagtgcggggtggaggccctgactaccctggaa

SEQ ID NO: 7945 - DNA, 114 bp, Homo sapiens
aagaattcggcacgagctcgtgccgcatacgtgttcagtgtgaatagtgtttaagttgaaaatattgtaaaaaaattatattttttcaaaaatatttaaaaaaataaataatag

SEQ ID NO: 7946 - DNA, 143 bp, Homo sapiens
  misc_feature 21, 38, 61, 62, 65, 68, 97, 100, 137: n = A,T,C or G
tgctggagctcgcgcccctgnaggtcgacactagtggnttcaaagaattcggcacgagggnntgngcnaataggcaagtgtttccaaactacttggnggnttacaaaaaatatgtcccagaaaaaaaaaaaatcttnccaaga

SEQ ID NO: 7947 - DNA, 396 bp, Homo sapiens
  misc_feature 61, 92, 130, 270, 346: n = A,T,C or G
gctggagctcgcgcccctgcaggtcgacactagtggattcaaagaattcggcacgagcgcngcccagcctcgaaatgcagaacgacgccggngagttcgtggacctgtacgtgccgcggaaatgctccgntagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcanatgattccattctccgattggccaaggccgatggcatcgtctcaaagaacttttgactggagagaatcacagatgnggaatatttgtcataaataaataatgaaaacctaaaaaaaaaaaaaaaaa

SEQ ID NO: 7948 - DNA, 399 bp, Homo sapiens
  misc_feature 18, 178, 179, 335, 338, 358: n = A,T,C or G
aagaattcggcacgaggngactcccaaggaaatggctacccaacttgccttcatgcgcctgctggccaactatgcctctcagaacatcacctaccactgcaagaacagcattgcatacatggatgaggagactggcaaccctgaaaaaggctgtcattctacagggctctaatgaggnngaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggnggngctgaccaggaattctttgnggacattggcccagtctgtttcaaataaatgaactcaatct

SEQ ID NO: 7949 - DNA, 158 bp, Homo sapiens
  misc_feature 18, 22, 29: n = A,T,C or G
aagaattcggcacgaganaagncaggggnggggcttcccttgatctgactgggggcctgccagaggttgccaccccggagtctgaggaggccttcaccctgcctctcctcaatgaccctgagcccaagccctcagtggaacctgtcaagagcatcagc

SEQ ID NO: 7950 - DNA, 400 bp, Homo sapiens
  misc_feature 45, 48, 76, 83, 138, 225, 313, 371, 389: n = A,T,C or G
aatttttgctggagctcgcgccccctgcaggtcgacactagtggnttnaaagaattcggcacgagcgggacgaggnacagctntttggacactaggaaaaaaccttgtagagagagtaaaaaatttaacacccatagnaggcctaaaagcagccaccaattaagaaagcgttcaagctcaacacccactacctaaaaaatcccaaacatataactgaactcctgncacccaattggaccaatctatcaccctatagaagaactaatgttagtataagtaacatgaaaacattctcctccgcataagcctgcgncagattaaaacactgaactgacaattaacagcccaatatctacaatcaaccaacaagncattattaccctcactgncaacccaacac

SEQ ID NO: 7951 - DNA, 384 bp, Homo sapiens
  misc_feature 2, 14, 38, 42, 383: n = A,T,C or G
gngacactagtggnttcaaagaattcggcacgagaggntacnttgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaant

SEQ ID NO: 7952 - DNA, 398 bp, Homo sapiens
  misc_feature 1, 5, 64, 121, 145: n = A,T,C or G
ngggnggagcttacatgctaatgtataagggcgctaatcgtactgaaacagtcacgtcttttanaaaacgagaaagtaaagtgcctgctgatctcttaaagcgggccttcgtgaggatgantacaagccctgaggctttcctggngggggggtcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatc

SEQ ID NO: 7953 - DNA, 287 bp, Homo sapiens
  misc_feature 11, 46, 47, 48, 53, 109, 118, 139, 201, 207, 210, 247, 270,281, 287: n = A,T,C or G
gcccctgagtncgacactagtggattcaaagaattcggcacgagannntgcgnttatttttgagactcccctccgagtggacgttgcagtgctgaaagcgcgagcgaanctgctgcanaaatacctgtgtgacgagcanaaggagctacaggcgctctacgccctccaggcccttgtagtgaccttaaaacagcctcccancggtgntgnggatgttcttttgacgcactgtatgacgaggacgtgnagaaggaggatcccttctacagntgggagagtancaaggn

SEQ ID NO: 7954 - DNA, 400 bp, Homo sapiens
  misc_feature 21, 112, 114, 135, 138, 398: n = A,T,C or G
ctgcaggtcgacactagtggnttcaaagaattcggcacgagctcgtgccgaattcggcacgagcatcgatgggcggcggaaaatagcctttgccatcactgccattaagggngngggccgaagatatgctcatgnggngttgaggaaagcagacattgacctcaccaagagggcgggagaactcactgaggatgagggggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcactttctggggccttcgngt

SEQ ID NO: 7955 - DNA, 400 bp, Homo sapiens
  misc_feature 48, 69, 71, 73, 74, 222, 224, 226, 227: n = A,T,C or G
ccgacttttgctggagctcgcgcccctgcaggtcgacactagtggatncaaagaattcggcacgagggngnannagggatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcnantnnattattccctaaaatactagactattagattcaggcatagtaccattttctagccatggggaaataagataaagagacaatggccatggtacatgcctctctggggtgtcactcaagacacagagatccagtattccttgcaatagaggagctttgggtatttcactaatctt

SEQ ID NO: 7956 - DNA, 164 bp, Homo sapiens
  misc_feature 36, 117: n = A,T,C or G
ctggagctcgcgcccctgcaggtcgacactagtggnttcaaagaattcggcacgagaggaagacccaggaaaggtgtgagctggaagcactgaacctacctcatcctcctggagggngtggctaccctcgccaccccaaattccatgtcaataaagaacagcta

SEQ ID NO: 7957 - DNA, 209 bp, Homo sapiens
  misc_feature 30, 71, 80, 150: n = A,T,C or G
gacattttagctggagcctcgcgcgcctgnaggtcgacactagtggatccaaagaattcggcacgagccgncgggcgcgncatcatggacaccagccgtgtgcagcctatcaagctggccagggtcaccaaggtcctgggcaggaccggntctcagggacagtgcacgcaggtgcgcggggaattcatggacgacacgagccgatccat

SEQ ID NO: 7958 - DNA, 116 bp, Homo sapiens
  misc_feature 8, 13, 32, 41, 46, 52, 59, 86, 105: n = A,T,C or G
gccccctncaggntcgacactagtggatcttnaagaattcnccacnaggggnggggggngggcctaatactgacttactcattcantaaacgctgagcacacagngtgcctgtgct

SEQ ID NO: 7959 - DNA, 368 bp, Homo sapiens
  misc_feature 118, 200, 206, 225, 226, 273, 291, 311: n = A,T,C or G
gacaatttgctggagctcgcgcgcctgcaggtcgacactagtggatccaaagaattcggcacgagctcgtgccgaattcggcacgagcttttgtggcccagcctcctacctgtgaagngaagccaaagcccagtgttaaaagaatggacaaacagacggaagagatacttggagatgaagttcaacttttttcacttgangaagantttgattatgacaatgggnngctaacctccaagtttagtcctgcagagatagagaacatcaaagagntatgcaagcagcagaaanagaaaggacaccagcccagnacttagagaaatcctgggactgattcacagaggcatttttgggggggggggcttatt

SEQ ID NO: 7960 - DNA, 310 bp, Homo sapiens
  misc_feature 38, 39, 57, 59, 65, 68, 92, 263, 297: n = A,T,C or G
gctggagctagaccccctgcggtcgacactagtggatnnaaagaattcggcacgagngnggccgngantattgcaaaatacatgaagcttcntgcgcttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcaaaaaaaaaagagtncttctagagcggccggggccccttcgattttccncccgggggggggt

SEQ ID NO: 7961 - DNA, 400 bp, Homo sapiens
  misc_feature 7, 47, 75, 295, 384: n = A,T,C or G
gactttnagctggagctcgcgcgcctgcaggtcgacactagtggatncaaagaattcggcacgagcccctctggntgttaatctgtatccttagtaatattctttatgataaaatggcaagtgtaaataaagtgtttccctgaatcctatgagccactccagctaattaagcaaacctgagggggttctagaaaacaccaatttatagcccatcagtcagaagttctagaggcccatacttgtgattagcatctggagcgaggggcagtcttgcggtgctgagtcctcaccttgngagatctgactccaactccaggtaggtattgtcagaatcgagttaaattgtaggacaccccattagtgtccactggagaactgcttgcngggtaaggggaaaatc

SEQ ID NO: 7962 - DNA, 140 bp, Homo sapiens
  misc_feature 6, 8, 37, 43, 61, 64, 66, 67, 96, 97, 98, 122: n = A,T,C or G
aggggngntcaaagaaggcggcacgaggggggggcgngggccnagggccaccggctccccnccncnnatggggaagaagagcgacacactaacatnnngggaaggggaggcacataactgtncgcaacatgggggaacca

SEQ ID NO: 7963 - DNA, 190 bp, Homo sapiens
  misc_feature 42: n = A,T,C or G
gctggagcctcgcgcccctgcaggtcgacactagtggattcnaagaattcggcacgagaaaaaaccttccagaatcaataatccgtggcaacatatctctgtaaaaacaaacactgtaacttctaaataaatgtttagtcttccctgtaaccttcaaaaaaaaaaaaaaaaaaaaaaaaaaaaaaaaaaa

SEQ ID NO: 7964 - DNA, 135 bp, Homo sapiens
  misc_feature 4, 6, 66, 73, 93, 96, 106, 114: n = A,T,C or G
ttanangggaaccgaaaaaaccctgcactgcgagactagggggtttaaaaaattcggcacgagcgnggggggngggggggacgagggcctggngangcggggaccnaccgcggnctgggcaaaccctatgtgcga

SEQ ID NO: 7965 - DNA, 261 bp, Homo sapiens
  misc_feature 8, 9, 27, 32, 184, 185, 188, 227, 258, 260: n = A,T,C or G
gtggatcnnagaattcggccgagcccnctccnccttactaccaaacaaccttagccaaaccatttacccaaataaagtataggcgatagaaattgaaacctggcgcaatagatatagtaccgcaagggaaagatgaaaaattataaccaagcataatatagcaaggactaacccctataccttnngcntaatgaattaactagaaataactttgcaaggagagccanaaggcctaaggaccccccccccgggaaaaancnc

SEQ ID NO: 7966 - DNA, 137 bp, Homo sapiens
  misc_feature 41, 63, 75: n = A,T,C or G
tgctggagctcgcgccccctgcaggtcgacactagtggatntcaaagaattcggcacgagggngtacttaatagngtatcatgttttccctgttggcatgtagcctggataaatgctcttaattataaaaaaaaaaa

SEQ ID NO: 7967 - DNA, 352 bp, Homo sapiens
  misc_feature 41, 42, 66, 67, 69, 70: n = A,T,C or G
ctggagcctcgccgcgcctgcaggtcgacactagtggatcnnaagaattcggcacgagggctaggnngnnctggaactcttgacctcagacaatccgcccacctcggattcctaaagtgctgggattagagatgtgagctgttgcgcctggccccccaaaatgagtttattttaatcctagtaagtttaaactatgtattcaaaattatttaatagctgggtatggtggcgggcatctgtaatcctagctactcgggatccgggacaatcgcttgaacctgggaggccgaggttgcggtgagccgaaatcacgccactgcactccagcctgggtgacagagcaagactctgt

SEQ ID NO: 7968 - DNA, 380 bp, Homo sapiens
  misc_feature 3, 152, 220, 224: n = A,T,C or G
ganattagctggagctcgcgcgcctgcaggtcgacactagtggatccaaagaattcggcacgagattcatcccaccctctcacagtttggacttttctcccctctctttctaagagacctgaactgggcagactgcaaaataaaatctcggngttctatttatttattgtcttcctgtaagaccttcgggtcaaggcagaggcaggaaactaactggtgngagncaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagat

SEQ ID NO: 7969 - DNA, 400 bp, Homo sapiens
  misc_feature 4, 19, 43, 142, 220, 344, 346, 388: n = A,T,C or G
tttngctggagctcgcgcncctgcaggtcgacactagtggatncaaagaattcggcacgagcgagtttttttttaagccctaaatttgtggtaatttgttacagcagcaataggaaactaacaccctttcaatttcaacagngtcttgtttgtacaatacttataagatgatagacctcagaccaagctctgaccttgaaaagccagcacaccctccaanggaaaagcctccatgtcagtctcttcctgggcttggtttcaggggtctctgaggcccagtcaagctcatttcctgtgctttctgtggatggctatagatttactgctctggattcaataatggngncagggtaataaagaatagaaatacataaacacttctcaaagncttgtaagattt

SEQ ID NO: 7970 - DNA, 400 bp, Homo sapiens
  misc_feature 5, 48, 69, 76, 144, 223, 225, 227, 311, 316, 335, 375: n = A,T,C or G
gaacntttagctggagctcgcgcgcctgcaggtcgacactagtggatncaaagaattcggcacgagctngcttacncccgaatattggtaagatcgatcaatggcttcaggacatgggttctcttctcctgtgatcattcaagngctcactgcatgaagactggcttgtctcagtgtttcaacctcaccagggctgtctcttggtccacacctcgctccctgngngngccgtatgacagcccccatcaaatgaccttggccaagtcacggtttctctgtggtcaaggttggttggctgattggtggaaagnagggnggaccaaaggaggccacgngagcagtcagcaccagttctgcaccagcagccgcctccgncctagggggggttcctgtttctcct

SEQ ID NO: 7971 - DNA, 400 bp, Homo sapiens
  misc_feature 2, 3, 57, 83, 203, 215, 262, 264, 280, 281, 360: n = A,T,C or G
tnnaatatattaagttgtataaactatcaaggccacaaaatactaatgtcatttggncataatgactactgataaggcatcangaatggattttcagggctaccagaaaaatgtttccagatggttttagaatgtaggacttatgggggggttcaccaaaagattaaatgaaaccaccctgtgttttaaaatatatataatgntcaacctaatgnatatgcaacatttattctattctaattatttgacagggaactgcagngntaaattgtaaatgtgnnttctttatgttaccaaaacagcaatttgaaattagaactagtgggtttagagaactcaggtattctttcctgacattgntttcagaataaagaatatttttcataatattttaagatac

SEQ ID NO: 7972 - DNA, 183 bp, Homo sapiens
  misc_feature 22, 47, 48, 67, 80: n = A,T,C or G
cgcaggtcgacactagtggatnttaagaattcggcacgagctagganncgatttatatcatttaggntatccaatttgtnggcatacaattgtgtatagtactctcataatctttttttatttctgtagaatcaataataatgtcctcactttcatttttgattttagtaatttgaatcttcg

SEQ ID NO: 7973 - DNA, 398 bp, Homo sapiens
  misc_feature 31, 48, 50, 53, 55, 133, 205, 206, 225, 351, 393: n = A,T,C or G
cccctgcggtcgacactagtggttttaaagnaattcggcacgaggggnangcngngaaaactcccatcttcaagcctgcctgctaaagcttctttgccttcctgattgtgattatggtaacaatttatatcangacagttgtactttttgataacttagggaaaacagaaatgacttgaacaagggattgcctgcctcactgcgnngcggagatacaatttctgnaaagaacacaaatagcagttgtgaatattaaggtgtgattatctttccctgtccatgtgcttattgaaagaagatagtgaacaaatgattatattgaggatttttttaatttataagatctaatgngaaatccacacttggaactttttagatctggctggtgcttgnttaat

SEQ ID NO: 7974 - DNA, 137 bp, Homo sapiens
  misc_feature 4, 8, 29, 30, 55, 58, 62, 65: n = A,T,C or G
gccncctncggtcgacactagtggatccnnagaattcggcacgagctcgtgccgnttncggnacnagtaattttaggattgactttctctttctgaatgacttcataaagtttggggggaattttgaagacttgggt

SEQ ID NO: 7975 - DNA, 396 bp, Homo sapiens
  misc_feature 2, 5, 107, 157, 236, 260, 276, 300, 314, 316, 330, 366, 392,393: n = A,T,C or G
ancgnaataaagagcttgccttctttgcaaatgctttggaagaagtctctattgagacaattgaggctggcttcatgaccaaggacttggctgcttgcattaaaggnttacccaatgtgcaacgttctgactacttgaatacatttgaggggagggntaaacttggagaaaacttgaagatcaaactagctcaggccaaactttaagttcatacctgagctaagaaggataattgncttttggtaactaggtctacaggnttacatttttctgggntacactcaagggttaaggcaaaancaattttgtaattngnttagaagccagagnttatcttttctataagtttacagcctttttcttatntatacagggtattgccacccttttgnngaa

SEQ ID NO: 7976 - DNA, 216 bp, Homo sapiens
  misc_feature 16, 68, 112, 120: n = A,T,C or G
ctggagctccgcgccnccccgcaggtcgacactagtggatccattagaattcggcacgagaacctgtnagcccagcatttgagagaaggtagggtgtgtatatataaaaggntgtgtacnacctccacgaggggaaaaatattcagtaacttgtttacatagcatttgtgtaaagactatgatctcatcccaataaaatgatatattaaaccttca

SEQ ID NO: 7977 - DNA, 400 bp, Homo sapiens
  misc_feature 14, 15, 42, 43, 64, 65, 70, 72, 225, 343, 391: n = A,T,C or G
ctggagctcagcgnnccctgaaggtcgacactagtggatttnntagtaattcggcacgagggcnnggggnangcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggggagnggttggtctgaagtccttgcaagacgctgatgctcaagctgttgacatactcattgcctactttaacacctgtcagagaaacgtgatatggggtaaggaggtgcttttttaaaatcgntcatagacttctgtaaaatgcaagataaattaaaggtattataacagngaaaaaaaa

SEQ ID NO: 7978 - DNA, 135 bp, Homo sapiens
  misc_feature 3, 5, 60: n = A,T,C or G
gcntnagaaaactgattttcctaaaaaatataaatctgtgaaatcactctggtttgccgngctgacgttagttttgcatttgaaagtcatattattttcttgtgtttcctttcaatggtatatgaaaaaggccca

SEQ ID NO: 7979 - DNA, 398 bp, Homo sapiens
  misc_feature 8, 16, 37, 61, 63, 67, 98, 182, 210, 239: n = A,T,C or G
agctcganagccccgnggtcgacactagtggatcctnagtaattcggcacgagccaggggncncggnctcaaggggccatcctgtcccaccatgcagngccctagcttagagcctccctcaattccccctggccaccaccccccactctgtgcctgaccttgaggagtcttgtgtgcattgntgtgaattagctcacttggggatatgtnctatattggctaaattgaaacctggaatnggggggcaatctattaatagctgccttaaagtcagtaacttacccttaggaggctgggggaaaaggttagattttgtattcaggggttttttgtgtactttttgggttttttaaaaattgtttttggaggggtttatgctcaatccatgttctatttca

SEQ ID NO: 7980 - DNA, 400 bp, Homo sapiens
  misc_feature 2, 39, 42, 44, 49, 51, 55, 199, 202, 288, 309, 373, 387: n = A,T,C or G
gnggtcgacactagtggatccttagaattcggcacgagngcngngttancnctgngtctcagatttcctagtccatgacatttaatagtgagtatagagtaggatattctatacattttagtatttggcccttggaaacaaagttaaataccatgtcactcagaagactctcaaagtttgtgtataaatggccgaaggntgngctatgagagattctaatccattcacatcattcttgagttgtgcaaatacacttggctttgatttcacttggggatctaaatttgnttatttaagctgcaagaaagntacattaatttggaatgtgtcatcacttggacccagtatatcagatttttattgagtaaaatgntaaaaataataagngaactcagattct

SEQ ID NO: 7981 - DNA, 168 bp, Homo sapiens
  misc_feature 2, 4, 152, 154, 160: n = A,T,C or G
angngggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaaaaaaaaaaanangggggnaaaaaaaa

SEQ ID NO: 7982 - DNA, 400 bp, Homo sapiens
  misc_feature 5, 6, 32, 177, 257, 264, 399: n = A,T,C or G
tgccnntgaatggttgtcttgaaatacctggngtatatactgcagaaaaggaatgcagctgttttccacagtgtttgtccccaacttctgtttgtactcaagaatcgttgaacatatgaagattttggtcccataatccttaaactatagcggggggggcacctgattacatagagnttggatggagcaaagaaaaatccaatagcattttgcagagtaatgtatataattatgggctcacttcctactggagatgntgaaagnctaaatcggtttgaccattttgattgatggcacaatctgggttagaaaactttggtaagatcaatgacataaccctgctgcctctgcctgccctttcccctcccttctcccatccccttttcccctatctggggnc

SEQ ID NO: 7983 - DNA, 400 bp, Homo sapiens
  misc_feature 2, 5, 41, 63, 149, 157, 180, 276, 284, 286, 348, 356: n = A,T,C or G
cnggntctccgccctacctcacaagcacccgaagcttgtcntccaatgtctggactttttggntccatctgggccccgaaagggatgtgtatgaaaattgctgccccatcaaccccaccacggaacattcgacccacatggaaaaccangggggcgngtgcaaggaatactacccggggntcaacccgtttcgcgcctatatgaacctggacatatggactaccacagcgaataggaatgcaaatttcccactgtctagagactcgagttacctgngggaatgngngaaaataattgggatttttaaacaatgtgaataaagaggcttggggttttgattactagggnaaactggntatttgagatagattatgacatttggggggatattttggcactt

SEQ ID NO: 7984 - DNA, 244 bp, Homo sapiens
  misc_feature 1, 4, 25, 165, 171: n = A,T,C or G
ncgnaggccccgtgcgccgagggcnacgtgctcacccttttggagtcagagcgagaagccccggaggttgcgcttgagcttggcttgctcgcttgggtctttggatgtcggggttcgaccactttggcccgatgggaatgggcctgtcacagtctgctccttgtnttttgnccgccacacgtaactgagatgctcctttaaataaagcgtttgggttttaaaaaaaaaaaaaaaaaaaaaaaaa

SEQ ID NO: 7985 - DNA, 100 bp, Homo sapiens
  misc_feature 12, 46, 48, 63, 89, 93: n = A,T,C or G
ctgttgtgacanacacggggagctccgcggtgcccaaccctgtggntnccctgctgtgggggncctggggccggcggagccctttaaantctngttctgg

SEQ ID NO: 7986 - DNA, 195 bp, Homo sapiens
  misc_feature 18, 29, 175, 177, 182: n = A,T,C or G
tagaattcggcacgagcnggggagcgganacaaaaagaggagcagaagaaactcgaggagctaaaagcgaagcgccgcggggaaggggcccttggccccagggggaattaagaaatctggcaaaaagtaagctgttccttgggcctgaggagatgggggaccctttatttcatcngnggggnaaacctctctatt

SEQ ID NO: 7987 - DNA, 399 bp, Homo sapiens
  misc_feature 3, 47, 154, 159, 195, 209, 229, 245, 283, 373, 378: n = A,T,C or G
gcnccaaactaaaaccttatctgtctgcattttgaatgcattttggncaaaagtatacgttttaaagatttttaaagataaaaatgtggcacaactggtttttttagcttgctgaaaatgaccatatctctaaattaatctttctctccagagnggggncttcaccagtatttgtaactaggagaagctaacagngaatgtttaattgngaattttaatcattgcttgntaggaataatgactgngatactagaatgggcttttgaaacctgcatgtcccagngtgaaatttcagcacggcattttctgcatcctttcatggccatccaaaggattccgctgcagaaattattgatgggctattttttgctgncttgngatgcaaggctgcttttgggc

SEQ ID NO: 7988 - DNA, 163 bp, Homo sapiens
  misc_feature 10, 25, 48, 51, 53, 54, 90, 119: n = A,T,C or G
ccctgcaggncgacactagtggatnttaagaattcggcacgaggatgngangnnaagaagaagctgtactgtatttatgttgctattggncaaaagagatccactgttgcccagttggngaagagacttacagatgcagatgccatgaagtacaccattgtgg

SEQ ID NO: 7989 - DNA, 400 bp, Homo sapiens
  misc_feature 19, 41, 63, 66, 68, 69, 73, 186, 213, 222, 307: n = A,T,C or G
tctggagctcgaaaacccngcaggtcgacactagtggatcnttagaattcggcacgagctggnaancnngcgnggcaatccctgacgcaccgccgtgatgcccagggaagacagggcgacctggaagtccaactacttccttaagatcatccaactattggatgattatccgaaatgtttcattgngggagcagacaatgtgggctccaagcngaggggggnggatccgcatgtcccttcgcgggaaggctgtggtgctgatgggcaagaacaccatgatgcgcaaggccatccgagggcacctggnaaacaacccagctctggagaaactgctgcctcatatccgggggaatgtgggctttgtgttcaccaaaggaggacctcactgagatcaggggac

SEQ ID NO: 7990 - DNA, 399 bp, Homo sapiens
  misc_feature 6, 77, 228: n = A,T,C or G
cgacanttagctggagctcgcgcgcctgcaggtccgacactagtggatccaaagaattcggcacgaggagagatggncaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgntaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatcttaaaaaaaaaaaaaaaaa

SEQ ID NO: 7991 - DNA, 176 bp, Homo sapiens
  misc_feature 5, 6, 35, 54, 56, 57, 62, 135: n = A,T,C or G
gcgcnncctcgcaggtcgacacctagtggatccanagtaattcggcacgagcantnnacagngaagtagtcatggaatcgatctcgtgaagcccgcaaggcccgaacacccccaccccgatttagacctgcgggngctgccccacgtcccccaccaaagcccatgtaaggagctga

SEQ ID NO: 7992 - DNA, 251 bp, Homo sapiens
  misc_feature 21, 46, 54, 201, 208, 219, 246: n = A,T,C or G
ctgcaggtcgacactagtggnttcaaagtaattcggcacgagccangagccggnggattcaagaggaggactccagctagctgggtaaggggttccttcctctcaacctaagtgtttatgtaagcctgctgggggccaggaactgcgtaaaactcagtaagctcagtacttctcagcacagaatccagtcccaaggaagcncccagcnaaaatttaggntgaattttctttaaaataaaataaagnaaaaa

SEQ ID NO: 7993 - DNA, 141 bp, Homo sapiens
  misc_feature 11, 74, 80, 85: n = A,T,C or G
cgaacaatttntctggagctcgcgcgccctgcaggtcgacactagtggatccaaagaattcggcacgaggcagncggagnaccgnatcctgaaggtgtccatgaaagagctcaacaagaaaacccctctcctcaccgaggg

SEQ ID NO: 7994 - DNA, 397 bp, Homo sapiens
  misc_feature 14, 18, 39, 63, 131, 162, 174, 215, 216, 263, 329, 340, 357,361, 373: n = A,T,C or G
ctggagctcgcgcncctncaggtcgacactagtggatcnaaagaattcggcacgagctcgtgncgagttcggcacgaggatgggtccaagctgcagtccatgagcaataacagactaccccagatactgcngtttacgcagggcttagtaaatgagatttgnggaactaagttnttaagttacctgaggcttcttaagaaagtcttcttttttgnncgggtgatgtgaaagagggagcatgtgacacagccagtatggggggngtgctagggttatcctgtttacaataaatcgcctgaatttcaaaaaaaaaaaaaaaaaaacctggngggtttttttnggggggccgggggcccntttnttttccccccgnggggggggccccggggaaggggcc

SEQ ID NO: 7995 - DNA, 235 bp, Homo sapiens
  misc_feature 40, 64, 69, 72, 177, 180, 181, 184, 233: n = A,T,C or G
gctggagctcgcgcgccctgcaggtcgacactagtggatncaaagaattcggcacgagcgcagnatggnggnaggcagcgggagcccgggagctttccctgcgtccctcccgcagcgggggccccaacagctcgaggaggaaggcccaatggaggaggaggaggcccagccaatggnggnnccngaggggaaacggggccctttgttacggggcccaacggtgggggccaccnag

SEQ ID NO: 7996 - DNA, 400 bp, Homo sapiens
  misc_feature 17, 20, 68, 69, 71, 76, 221, 224, 226, 265, 335, 365: n = A,T,C or G
tttgctggagcctcgcngcncctgcaggtcgacactagtggatccaaagaattcggcacgaggggggnntntatgntatctaccattcaaaaacttttttaaaaagtttaaagtttctagcaataaatacaattgggacagacattttgtgtatcatttttttgtttcttaatccaatattcctttacaaattaaatgccttgaaaaatataatggagggnggngngattttgatgctttggtctaacttctacattcctactgntaaaaaggccagtatatcttaaacaaatgaataggcatgaggcatattcagttgacttacaatgaaaagntatacagacaacagtaataactaaaagggngaatctgctaaatccttttgaaatgctgcagattt

SEQ ID NO: 7997 - DNA, 370 bp, Homo sapiens
  misc_feature 40, 62, 63, 66, 218, 220, 246, 262, 315: n = A,T,C or G
ctggagctcgcgcgccctgcaggtcgacactagtggatcntaagaattcggcacgaggacgnncgntgggagaacatcaggtgcactgtggacgtgggtctgggggtctcacccgcccagcgagagcagaaccaatccagtcaggatgtcactgactctaaatcagggtgattcaagatgcccaaaaatgatggatagagaaacagaaatctctgagngncaggaaccctgtcttttaaaaaggcngtcactgccttcaggngatgctgccccagaaacttaaaatttagtcgaggcagtttcaattgttactgnggaccgaattaggatcacaataaacgataatgcaggttcttcaaaaaaaaaaaaa

SEQ ID NO: 7998 - DNA, 182 bp, Homo sapiens
  misc_feature 12, 39, 69, 96, 125, 165: n = A,T,C or G
tggagctccgcncgccccgaggtgcgacactagtggatnttaagaattcggcacgagattgaactgggnacagaatgccggaaaatactacagagngtgcacacctggctatcattgatccaggngactctgacatcattagaagcatgccaagaacagactggngaaaagtaaaccttttc

SEQ ID NO: 7999 - DNA, 399 bp, Homo sapiens
  misc_feature 3, 55, 124, 200, 204, 205, 339: n = A,T,C or G
ccnccccgcggtcgacactagtggatccaaagaattcggcacgaggaaaataagncactaaatgtaatgtgatatcctggattatattctggaagataaaaagctcattagtggaaaagttggngaaatctgaataaagtttgaaatttacttaatagcaatataccagtgttaatgtctagcttagacaaatgtaacgngggnnatgtaagatttacttagtctagttttccaacattatatgggaactttgtatttttttataactgtctataaatttaaaattattaaaaggtaaagattttaaaaatgaaaataggaaaattagccgggtatggnggcgtgtaccctgtaatctcagctactcggggctgaggtaggagaattggttgaaaccgg

SEQ ID NO: 8000 - DNA, 190 bp, Homo sapiens
  misc_feature 25, 34, 50, 75, 77, 149, 155: n = A,T,C or G
acccaactttgctggagctcgcgcncctgcaggncgacactagtggatcntaagaattcggcacgagagcggggnanacaaacaaaaagcacagtgttacgcttgcaagtttccatttgttttaataccacgcaatctttcacactcgngcgtgngcgcgcacacagagcttacctgacttgctctgctt

SEQ ID NO: 8001 - DNA, 312 bp, Homo sapiens
  misc_feature 7, 22, 46, 66, 221, 222, 224: n = A,T,C or G
aacattngctggagctcgcgcncctgcaggtcgacactagtggatncaaagaattcggcacgaggngcactcctgaggatgagactctgggggccctagccggggtccacgggagggctgtccttggggactctaggatggcttcgttctggcccggctcacttctggagctgtgagacccaagacaaaaggggctgagggatttctcattgacaagagtnngngcgggaaaaccacctgatccctagggatttgtcatcttaagactcaaaaggcttaataccaggaaccaccttggcaagatatttaccc

SEQ ID NO: 8002 - DNA, 400 bp, Homo sapiens
  misc_feature 7: n = A,T,C or G
gacaatnagctggagctcgcgcgcctgcaggtcgacactagtggatccaaagaattcggcacgaggtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttg

SEQ ID NO: 8003 - DNA, 400 bp, Homo sapiens
  misc_feature 2, 9, 28, 29, 32, 33, 43, 111, 180, 184, 241, 270, 302, 357,394: n = A,T,C or G
tngtgatcnaagaattcggacaagattnnaanngggggaggangctggactacccacgttctcacacccaccgtccgccctgctcctccctggctgccctggccctgaggngtgggggctgagatgttgctgaggagtgaggaatagttgagccccaagtcctgaagaggcgggccagcngggngggctcaaggaaagggggtccaagtgggaggggcaggctgacatctgtgtttcaagnggggctcgccatgccgggggttcataggncactggctctccaagggccagagggggcaggnggtggcactgagcccccccaacactgtgccctgggggagaaagcactgacctgtnatgccccccctcaaaaccttctcttcttgacgggccnttttgc

SEQ ID NO: 8004 - DNA, 185 bp, Homo sapiens
  misc_feature 3, 16, 30, 57, 72, 75, 77, 84, 149, 179: n = A,T,C or G
ttnagaattcggcacnataggcaggaagangagcagaagaagaagcggaccttccgnaagttcacctaccgnggngnggacctngaccagctgctggacatgtcctacgagcagctgatgaagctgtacagtgcgcgccaggggggggntttaaaccgggccttggggaaaaaaaaatngggggt

SEQ ID NO: 8005 - DNA, 169 bp, Homo sapiens
  misc_feature 9, 15, 47, 165: n = A,T,C or G
aggggatgncggggnctggtctcctcagcctcctcatctgggggagnggaatagtatcctccaggtttttcaattaaacggattattttttcaggacaaaaaaaaaaaaaaaaaaaaaaaaaaaaaaaaaaaaaaaaaaaaaaaaaaaaaaaaaaaaaaaaaaangggg

SEQ ID NO: 8006 - DNA, 169 bp, Homo sapiens
  misc_feature 2, 17: n = A,T,C or G
tngctggagcttcgcgngccctgcaggtcgacactagtggatccaaagaattcggcacgaggctcccccaaaaatttgaatttttttttcaacactcttacacctgttatggaaaatgtcaacctttgtaagaaaaccaaaataaaaattgaaaaataaaaaccataaa

SEQ ID NO: 8007 - DNA, 265 bp, Homo sapiens
gacaatagctggagctcgcgcgcctgcaggtcgacactagtggatccaaagaattcggcacgaggttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaaaaaaa

SEQ ID NO: 8008 - DNA, 400 bp, Homo sapiens
  misc_feature 9, 167, 226, 227, 230, 366: n = A,T,C or G
cgacatttngctggagctcgcgcgcctgcaggtcgacactagtggatccaaagaattcggcacgagcttccatttgcactaggaaatgaaggtagtgatgggattggcaatgttcctggcagatgtttcagcccaaaagctcttctacagaccggtttagagctggngccctatgagaatattagggagcttttattttaaattgaactttacccttgtccatgcnnggnattcctcctgaatgcatccatgaatttgtttacttttgcgtcaaacatatgagccattgtcatgctcagcctgtgccaccattgctctgtctgatgtatgtaatcatacaagacctgattttggttctaacacagnggtctttgactatcaacattgatgtttttagaga

SEQ ID NO: 8009 - DNA, 142 bp, Homo sapiens
  misc_feature 70, 71: n = A,T,C or G
gaacaattagctggagctcgcgcgcctgcaggtcgacactagtggatccaaagaattcacgagcgggccnnaaagggaccagactccagcacacctgtctcctcctgcctggggtggccatggggatggaagggggtggaat

SEQ ID NO: 8010 - DNA, 311 bp, Homo sapiens
  misc_feature 5, 8: n = A,T,C or G
gacanttngctggagctcgcgcgcctgcaggtcgacactagtggatccaaagaattcggcacgagaatacgtggggggctgagtattaaactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaa

SEQ ID NO: 8011 - DNA, 400 bp, Homo sapiens
  misc_feature 5, 7, 125: n = A,T,C or G
gacantnagctggagctcgcgcgcctgcggtcgacactagtggatccaaagaattcggcacgaggttaatatttagttgcctatattatgtaaccttttaactatatataaagtacttttttggnttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagc

SEQ ID NO: 8012 - DNA, 134 bp, Homo sapiens
  misc_feature 6, 9, 32, 37: n = A,T,C or G
tgtggntcnaagaattcggcacgagaatctgngatgnccgctgtattttttattaaaatcctgtcaagaaaaaaaaaaaaaaaaaaaaaaaaaaaaaaaaaaaaaaaaaaaaaaaaaaaaaaaaaaaaaaaaaa

SEQ ID NO: 8013 - DNA, 400 bp, Homo sapiens
  misc_feature 6, 9, 47, 67, 70, 77, 133, 136: n = A,T,C or G
ccgacnttngctggagctcgcgcccctgcggtcgacactagtggatncaaagaattcggcacgaggncgnactttgnctgactacaatattcaaaaggagtctactcttcatcttgtgttgagacttcgtggnggngctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagac

SEQ ID NO: 8014 - DNA, 400 bp, Homo sapiens
  misc_feature 10, 18, 47, 72, 222, 223: n = A,T,C or G
aacttttggntggagctngagcccctgcggtcgacactagtggattnaaagaattcggcacgagcggcacgnggtttggagacattggtttccccaaaactgccttccctggaagccccaacctctgcctctaacgtaatgactgcttttgccaccacaccacccatttcgtccataccccctttgcaggaacctcccagaacaccttcaccaccactgagnnctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtga

SEQ ID NO: 8015 - DNA, 400 bp, Homo sapiens
  misc_feature 4, 16, 29, 44, 63, 65, 66, 67, 68, 70, 71, 72, 131, 177,179, 218, 222, 223, 368, 388: n = A,T,C or G
tggntggagcctgagngcccttgaggtgngacactagtggtttnaaagaattcggcacgaggngnnnngnnngaacccaggaggtggaggttgagtgagccgagatcacgccactgcactccagcctgggngacagagtaagactgtctcaaaaataaaaataaaaataaaagtgtntnaatttaaaatttttattttccatgtccactgaatatgangggnnaaactttttgatattactagatgctttcagaatctgataaaagcctcagacactttctccccaaaatataaacacccaccaaatgtagcctacaatatctattggctactttatccctcagaagtctttctataaaccccctagntttccatgggtcctgactgnaaaactaaaaat

SEQ ID NO: 8016 - DNA, 203 bp, Homo sapiens
  misc_feature 3, 18, 64, 68, 72, 132: n = A,T,C or G
ttngctggagctcgcgcncctgcaggtcgacactagtggatccaaagaattcggcacgagcccngggnagangactgcttcctggaaagcagttctattccttctccaaagcaaggaacagaactggctggngagtgctgggcctcatgaccccagctgcctgagcttctttctatcttgaagtcatttgaaaagagacagag

SEQ ID NO: 8017 - DNA, 400 bp, Homo sapiens
  misc_feature 5, 24, 33, 48, 73, 223: n = A,T,C or G
gaacnttttgctggagctcgcgcncctgcaggncgacactagtggatncaaagaattcggcacgagccgaggnctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgnggatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaac

SEQ ID NO: 8018 - DNA, 168 bp, Homo sapiens
  misc_feature 6, 33, 140: n = A,T,C or G
gaacantaagctggagctcgcgcccctgcaggncgacactagtggatccaaagaattcggcacgaggggggttcaccttgttagccaggatggtttccatctcctgacctcgtgatctgcccgtctcggcctcccaaagngctgggattacaggcatgagccactgcg

SEQ ID NO: 8019 - DNA, 398 bp, Homo sapiens
  misc_feature 3, 10, 208, 312: n = A,T,C or G
ccnttgaagntgggacactagtggatccaaagaattcggcacgagctcccaccctgagcagagccgccgaggatgataaacacccaggacagtagtattttgcctttgagtaactgtccccagctccagtgctgcaaggcacattgttccagggcctctgtggtgctccttgatgcccctcacccactgtcgaagatccccggggggngagggggcggcaagggatccttctctctcagctctaatatataaggacgagaagctcactgtgacccaggacctccctgtgaatgatggaaaacctcacatcgnccacttcctcagacctttctcgcttctgagcttgggggcctgttccctccatctctccgaacctggcttcgcctgtccctttcact

SEQ ID NO: 8020 - DNA, 400 bp, Homo sapiens
  misc_feature 68, 71, 74, 75, 223, 224, 269, 387: n = A,T,C or G
gacaataagctggagctcgcgcgcctgcaggtcgacactagtggatccaaagaattcggcacgagggnggnganncagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaactttnnctccctgaacctgagggaaactaatctggattcactccctctggntgatacccactcaaaaaggacacttctgattaagacggttgaaactagagatggacaggttatcaacgaaacttctcagcatcacgatgaccttgaataaaaattgcacacactcagngcagcaatatatt

SEQ ID NO: 8021 - DNA, 399 bp, Homo sapiens
  misc_feature 3, 39, 45: n = A,T,C or G
tgngacactagtggatccaaagaattcggcacgagggtngcgccntttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgcttggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaa

SEQ ID NO: 8022 - DNA, 400 bp, Homo sapiens
  misc_feature 9, 23, 33, 36, 223, 334: n = A,T,C or G
ccttaatantgagtcttattccncttcactggnacnctagtggatccaaagaattcggcacgagccaggaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagnggactcccaggagagaggggtgctgctggcatacctggaggcaagggagaaaagggtgaacctggtctcagaggtgaaattggtaaccctggcagagatggtgctcgtggngctcctggtgcttgtaggtgccccttggttcctgctggagccacaggtgaccggggccaaagctgg

SEQ ID NO: 8023 - DNA, 400 bp, Homo sapiens
  misc_feature 76, 77, 225, 226, 227, 360: n = A,T,C or G
gaacaataatgctggagctcgcgcgcctgcaggtcgacactagtggatccaaagaattcggcacgagcactcaagnncctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgcnnngaaggttttctgcaacatggagactggcgagacttgcgtctaccccaatccagcaaacgttcccaagaagaactggtggagcagcaagagcaaggagaagaaacacatctggtttggagaaaccatcaatggnggcttccatttcagctatggagatgacaatctggctccca

SEQ ID NO: 8024 - DNA, 120 bp, Homo sapiens
  misc_feature 69: n = A,T,C or G
aaggacaaaagctggagctcgcgcgcctgcaggtcgacactagtggatccaaagaattcggcacgaggnggaagtcaccattgcagatgcttaagtcaactattttaataaattgatgac

SEQ ID NO: 8025 - DNA, 398 bp, Homo sapiens
aaaataagctggagcctcgcgcgcctgcaggtcgacactagtggatccaaagaattcggcacgagatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaata

SEQ ID NO: 8026 - DNA, 400 bp, Homo sapiens
  misc_feature 3, 221, 311: n = A,T,C or G
ganaaaagctggagctcgcgcgcctgcaggtcgacactagtggatccaaagaattcggcacgaggttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggngtgaaatcacttcatatatcatgtgctgtaaaataagaactagctgaagagacaaccaaagaagcattaaggcaggttgatgctgatggnaccataaaatatttttacactcaacctgagcggttattcttgacactcttaacagaattttttcaattgttttccagaactttagtata

SEQ ID NO: 8027 - DNA, 380 bp, Homo sapiens
  misc_feature 215, 220, 221, 287, 303, 322, 358, 359: n = A,T,C or G
agctggagctcgcgcgcctgcaggtcgacactagtggatccaaagaattcggcacgagcgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacanggggnngtacctggctttcctccgcaagcggatgaacaccaacccttcccgaggcccctaccactttccggnccccccagccgcattnttctggcggaccgtgcgangttatgcttcccccacaaacccaagcgaaggcccanncccgcttttggaaccgtctaa

SEQ ID NO: 8028 - DNA, 400 bp, Homo sapiens
gacaataagctggagctcgcgcgcctgcaggtcgacactagtggatccaaagaattcggcacgaggtttgtgagtattttgttgaggatttttgtgtctatgttcatcagggatattggcctgtagttttctttttttgttgttgtatttttgcgagattttggtaccaggatgatattggactcatagaatgatgaggagcccctccccctcaactttttgaaatagtttcaataggattgtatgtctggtagagttcagctgtgaatctatgtggcctgtggctttttctggttggtaggtattttattactgattcaatttgattactcattggtctgttcaggatttctgtttattcctggtttcataaagcaaatctcaataaattaaaatcatg

SEQ ID NO: 8029 - DNA, 222 bp, Homo sapiens
  misc_feature 6: n = A,T,C or G
ctgggnctcgcgcgcctgcaggtcgacactagtggatccaaagaaattcggcacgagcttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgc

SEQ ID NO: 8030 - DNA, 400 bp, Homo sapiens
  misc_feature 3, 10: n = A,T,C or G
aangaacaanaagctggagctcgcgcgcctgcaggtcgacactagtggatccaaagaattcggcacgaggtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaac

SEQ ID NO: 8031 - DNA, 399 bp, Homo sapiens
  misc_feature 15, 227, 246, 282, 352, 376: n = A,T,C or G
cctcgcgcgcctgcnggtcgacactagtggatccaaagaaattcggcacgagctcgtgccgaattcggcacgagatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagngcaggaaagcagcactganaaacttttgattgttttcaatttcttcttttatgtncacaccaccacattcccattcactttgattttctacatgtaattaccttcttttgtttatcattagattngatggggccaaagttgagatagantaggagggtgatgacgggtaaga

SEQ ID NO: 8032 - DNA, 400 bp, Homo sapiens
  misc_feature 34, 37: n = A,T,C or G
accgaacaatttgtctggagcctcgcgcgcctgnggncgacactagtggatccaaagaattcggcacgaggcagcacctaccccctcctcctttcccacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgcca

SEQ ID NO: 8033 - DNA, 215 bp, Homo sapiens
  misc_feature 2, 8, 46, 108: n = A,T,C or G
anctgggnctcgcgcgcctgcaggtcgacactagtggatccaaagnaattcggcacgagcggcacgagcgggaacctctcctgccggaagccggacggcagggatggnccccaacttcgccctgcccacttgacttcaccaaatcccttcctggagactaaacctggtgctcaggagcgaaggactgtgaacttgtggcctgaagagccagagct

SEQ ID NO: 8034 - DNA, 400 bp, Homo sapiens
  misc_feature 8, 9: n = A,T,C or G
gaacaatnngctggagctcgcgcgcctgcaggtcgacactagtggatccaaagaattcggcacgagcggaagtacggaccgtgaactggagtggaatcgcgactatgggagctccggggggaaagatcaaccggccccgaacggtgactgtgagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccagg

SEQ ID NO: 8035 - DNA, 400 bp, Homo sapiens
  misc_feature 7, 8, 28, 342: n = A,T,C or G
tgcagtnngacactagtggatccaaagnattcggcacgagcaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggngatgcaggattgcagggggttaccaggtgtaccttggaattcctggggcaaagggtgt

SEQ ID NO: 8036 - DNA, 167 bp, Homo sapiens
  misc_feature 3, 8: n = A,T,C or G
gancaatnagctggagctcgcgcgccctgcaggtcgacactagtggatccaaagaattcggcacgagttctgacttaaaacattccttgtacctttatttacacgatccaagttgcagtgtgcctagattttcctccaaggacaaaaatgtgaataaagcaatattt

SEQ ID NO: 8037 - DNA, 169 bp, Homo sapiens
  misc_feature 4, 35, 50, 56, 78, 84, 103, 136: n = A,T,C or G
aagnaaaataatctggggctcgcgcgcctgaaggntcgtaactagtgganccaaanaatcggcacgagaccttccagnagatgnggatcagcaagcaggagtntgaccgagtccggcccctccatcgtccaccgcnaaatgcttgtaggcggactatgacttagcccgc

SEQ ID NO: 8038 - DNA, 400 bp, Homo sapiens
  misc_feature 5, 7, 111, 166: n = A,T,C or G
gacantnagctggagctcgcgcgcctgcaggtcgacactagtggatccaaagaattcggcacgaggtcgaatatcaaaaaatatttgttattgtttttattgttatttggngatttttcataaacaaactgacaactggggttggcctgattcatgagatattggnggagttctttgaaatgccccagttctcttaccttcagaagtccaaagctttccacagaatttctgccagttcccatggaggtttgcattttcacagtcccttctggcataatcatttgctgctgaattagttcacgttgcagatcgactcaccatccgtttatgtgtcattgtcttgtggcacagctcttccttaattacctagctcttccttaattactctcccctcctccaa

SEQ ID NO: 8039 - DNA, 400 bp, Homo sapiens
  misc_feature 3, 5: n = A,T,C or G
ganantaagctggagctcgcgcgccctgcaggtcgacactagtggatccaaagaattcggcacgaggttgatgtgaaaattgtataacagacaattgttgaacacggttcatgtcaactatttcacgttcaaacagtgttaagtaacttgcactttttccctctcttcttcccattatagccatattaaatgtggcttttttttctggaagtaaaagtgttggaaatcactaatcggcttgttaattgttaattcacggctagaggctccattgttcttagtgcctgcacttgaaaagaaagtcagatgtggcaaagttggatttttttttctaatacgatgcaatgtgctcccaaattcttcaggatgtgctaattttctgcctagaacaagcctcaga

SEQ ID NO: 8040 - DNA, 400 bp, Homo sapiens
  misc_feature 226, 266, 286, 304, 309, 381, 383: n = A,T,C or G
gacaataagctggagctcgcgcgcctgcaggtcgacactagtggatccaaagaattcggcacgaggctgccgctgctagccgcgacaactccggaccacggccgccaccgaaggctgcttctgctgccgctactgctgttcctgctgccggctggagctgtgcagggcttgggagacagaggagaggccccggactcgcgaagaggagtgccacttctacgcgggnggacaagtgtaccccggggagaggcatcccgggtatcggncggccgaccacttccttgcnccttaagcaaagcgaaanatttnccaagcccagcgccctactggggaaggaacagcttgggattcgatgggagaattttaagggagcctgaaagntnacctgattatttcgggg

SEQ ID NO: 8041 - DNA, 394 bp, Homo sapiens
gaacaataagcctggagcctcgcgcgcctgcaggtcgacactagtggatccaaagaattcggcacgaggtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactta

SEQ ID NO: 8042 - DNA, 246 bp, Homo sapiens
  misc_feature 71, 72: n = A,T,C or G
gaacaataagctggagctcgcgcgcctgcaggtcgacactagtggatccaaagaattcggcacgagctcanngccgagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctatta

SEQ ID NO: 8043 - DNA, 117 bp, Homo sapiens
gaaaaaagctggagctcgcgcgcctgcaggtcgacactagtggatccaaagaattcggcacgagcttccctctgagctgtattgttctttaatggctgtcttgcccttccaaaaaaa

SEQ ID NO: 8044 - DNA, 400 bp, Homo sapiens
gaacaataagctggagcctcgcgcgcctgcaggtcgacactagtggatccaaagaattcggcacgagcccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgccttggaggtggaggggaaagatggtcagtaggacagaaggtaacattgatgactcgctcattggtggaaatgcctccgctgaaggccccgagggcgaaggtaccgaaagcacagtaatcactggggtcgatattgtcatgaaccatcacctgcagga

SEQ ID NO: 8045 - DNA, 302 bp, Homo sapiens
  misc_feature 22, 24, 27: n = A,T,C or G
gacaaaagctggagctcgcgcncntgnaggtccgacactagtggatccaaagaattcggcacgagtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgattttt

SEQ ID NO: 8046 - DNA, 309 bp, Homo sapiens
  misc_feature 76, 242, 266, 285: n = A,T,C or G
gaacaaaagctggagcctcgcgcgcctgcaggtcgacactagtggatccaaagaattcggcacgaggcagccaggngaggctctctagtttaataaaaatgatggaaagactcttaatgcagactcttcttaagtgttatagggattttttcagcttattttgggtgcagtttccaatttttaaaaatgttgaggtaatctttcccaccttcccaaacctaattcttgtagatgcattatgngttgaaccaatgctttctcatgtntcaattctttgtatatgcnttcttttcagatgtattaaacaaa

SEQ ID NO: 8047 - DNA, 400 bp, Homo sapiens
  misc_feature 24, 29, 92: n = A,T,C or G
gacaataagctggagctccgcgcncctgnggtcgacactagtggatccaaagaattcggcacgagctcttttggggccctgggcaacacttnagcctccagggtaaattgagtaagaaaaaattagggttgctttcctgtttatttgtttttgcttctagaaggcttttatttggttttgtggatagttattttgtttcctgtgcatttctagcaagtcatcatttgttccatttaactggaattcctaggctaccctttgtcagacccacaggagttaatggaacacatcagctttttaaccttaaactaactttttggagtttaggcttattgatattttaagtatgttgagtataccttttgtaaacagaatttaagtcatatttctctctctgcct

SEQ ID NO: 8048 - DNA, 400 bp, Homo sapiens
  misc_feature 10, 17: n = A,T,C or G
aaaaaccganctttatntctggagctccgcgcgccctgcaggtcgacactagtggatccaaagtaattcggcacgaggaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaa

SEQ ID NO: 8049 - DNA, 400 bp, Homo sapiens
  misc_feature 24, 352: n = A,T,C or G
gaacaataagctggagctcgcgcncctgaggtcgacactagtggatccaaagaattcggcacgagcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgcttcttcggcagtctagccggcctgggtgcttaccagctgtatcaggatccaaggaacgtttggggtttcctagccgctacatctgttacttttgttggngtatgggaatgagatcctactactatggaaaattcatgcctgtaggtt

SEQ ID NO: 8050 - DNA, 400 bp, Homo sapiens
  misc_feature 15, 16, 43, 64: n = A,T,C or G
aaagcgcaacatttnnctggagcctgcgccgcgccctgcaggncgacactagtggatccaaagnaattcggcacgaggtcttgtgggaggaaaaaagatttattctaagagatttattcaaaggtcttttacctacaaggagtttacacttctgcaggttataaacatgtcaacaattctttggcacttaatttttattcttcagcctagattaaggtttttttacatacttatcaactactacacaaaaatcaaaacccctccattcttaacttttaaatacgtcctcagtaaaggagacaagaccagaaattatttcacagaagatatttacaaaaattatagccaagacataggagacaatttagatatgctacactataaaaatggctaccatggg

SEQ ID NO: 8051 - DNA, 389 bp, Homo sapiens
gacaaaagctggagctcgcgcgcctgcggtcgacactagtggatccaaagaattcggcacgagctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcttttttttgctgttccaccaaatacaattcaaatgctttttgttttatttttttttaccaattccaatttcaaaatgtctcaatggtgctataataaataaacttcaacactctttat

SEQ ID NO: 8052 - DNA, 400 bp, Homo sapiens
  misc_feature 357: n = A,T,C or G
gacaataagctggagctcgcgcgcctgcaggtcgacactagtggatccaaagaattcggcacgagctgtgcctcagcgctccacattgccttactaaatgacataaagtgaacagcacacacacaaaagacctattgcaccagttaggataagccaacttcaaacatctgtcacccggagacagagcagttctggagctggctaattcagcagctcaaagtaatttttatagcgatactgtctgccattcttaacatgtaaacaatgacactatcctagtctcaggtgatggcagcagtttgaggagacaccagtggattttctatatctctttttatcttataaaagagggggagntccttccctacccccacacaggcacctctgtagatcccattgg

SEQ ID NO: 8053 - DNA, 400 bp, Homo sapiens
gaaaaagctggagctcgcgcgcctgcaggtcgacactagtggatccaaagaattcggcacgagcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtggggaggatcacttgagccttgggaggtgggagggttgca

SEQ ID NO: 8054 - DNA, 400 bp, Homo sapiens
  misc_feature 214, 298, 317, 327, 338, 378: n = A,T,C or G
gaaaaaagctggagctcgcgcgcctgcaggtcgacactagtggatccaaagaattcggcacgagctcgtgccgaattcggcacgagccccgctcccccaaaaatttgaatttttttttcaacactcttacacctgttatggaaaatgtcaacctttgtaagaaaaccaaaataaaaattgaaaaataaaaaccataaacatttgcaccacttgnggcttttgaatatcttccacagagggaagtttaaaacccaaacttccaaaggtttaaactacctcaaaacactttcccatgagngtgatccacattgttaggngctgacctanacagagatgancctgaggtccttgttttggttttgttcataatacaaaggngctaattaataagtatttttca

SEQ ID NO: 8055 - DNA, 393 bp, Homo sapiens
gaaaaagctggagctcgcgcgcctgcaggtcgacactagtggatccaagaattcggcacgagttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttc

SEQ ID NO: 8056 - DNA, 397 bp, Homo sapiens
  misc_feature 6: n = A,T,C or G
gaaaangctggagctcgcgcgcctgcaggtcgacactagtggatccaagaattcggcacgagctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggt

SEQ ID NO: 8057 - DNA, 312 bp, Homo sapiens
  misc_feature 106: n = A,T,C or G
gaaaataagctggagctcgcgcgcctgcaggtcgacactagtggatcaaagaattcggcacgagctcgtgccgaattcggcacgagaaactttgtgcctttgaccntctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccact

SEQ ID NO: 8058 - DNA, 113 bp, Homo sapiens
  misc_feature 2, 79: n = A,T,C or G
gnaaaagctggagctcgcgcgcctgcaggtcgacactagtggatccaagaattcggcacgagctcgtgccgaattcggnacgaggaagagagaagatagtctcgagttttttt

SEQ ID NO: 8059 - DNA, 400 bp, Homo sapiens
  misc_feature 276: n = A,T,C or G
gaaaaagctggagctcgcgcgcctgcaggtcgacactagtggatccaaagaattcggcacgagcccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggntggaagtaccaggcagtgacagccaccctggagggagaagaggaaagagaaagccaagatccacctaccggaagaagaaacagctcatgaggctacggaaacaggccgagaagaacgtggagaa

SEQ ID NO: 8060 - DNA, 400 bp, Homo sapiens
  misc_feature 254: n = A,T,C or G
gacaaaagctggagctcgcgcgcctgcggtcgacactagtggatccaaagaattcggcacgagctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagngtgggatattgaattatgggaggctctgactgtctcgggtgtcagcttaacattccacagatggggggttaagtttttatatcctataatacaaagcatattaaatggcaatatgggagtcagtcctgcatttaatgtcttgaaca

SEQ ID NO: 8061 - DNA, 400 bp, Homo sapiens
  misc_feature 7, 28, 31: n = A,T,C or G
gaccaantgctggagctcgtgcgcctgnggncgacactagtggatccaaagaattcggcacgagacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagt

SEQ ID NO: 8062 - DNA, 400 bp, Homo sapiens
  misc_feature 2, 3, 371: n = A,T,C or G
gnncgacactagtggatccaaagaattcggcacgagcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccggggaccgtggcgctttcgagagattcgtcggttatcagaagtcgaccgagctgctcatccggaagctgcccttccagaggttggtgangggagatccgcgcaggatttcaaaaaccg

SEQ ID NO: 8063 - DNA, 185 bp, Homo sapiens
gctggagctcgcgcgcctgcaggtcgacactagtggatccaaagaattcggcacgagctatctcatgtgcaaagacacacataggctcaaagcgatggaggaaaatttaccaagcaaatggaaagcagaaaaaagcaggggttgcaatcttagtttctgacaaaacagactttgaatcaacaaag

SEQ ID NO: 8064 - DNA, 400 bp, Homo sapiens
  misc_feature 9: n = A,T,C or G
gaacaatangctggagctcgcgcgcctgcaggtcgacactagtggatccaaagaatcggcacgagcggcacgagcaaatacaaagttaacaagaaaaaggaacattaacagaaatctctaaaagttagaaatgtacaggtaaagactaaaaattgataggaggtttagttgtgtttcctacccggaaatcaaaatttgaaaagcagtaaaggcatttgccctgctctgcctccttcacataggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgac

SEQ ID NO: 8065 - DNA, 241 bp, Homo sapiens
  misc_feature 185, 221: n = A,T,C or G
gaacaataagctggagcctcgcgcgcctgcaggtcgacactagtggatccaaagaattcggcacgaggcaaggcggcggcaggagaggttgtggtgctagtttctctaagccatccagtgccatcctcgtcgctgcagcgacacacgctctcgccgccgccatgactgagcagatgacccttcgnggcaccctcaagggccacaacggctgggtaacccanatcgctactaccccgcagtt

SEQ ID NO: 8066 - DNA, 341 bp, Homo sapiens
gacaaaagctggagctcgcgcgcctgcaggtcgacactagtggatccaaagaattcggcacgagctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaag

SEQ ID NO: 8067 - DNA, 358 bp, Homo sapiens
  misc_feature 337: n = A,T,C or G
gaaaaagctggagctcgcgcgcctgcaggtcgacactagtggatcaaagaattcggcacgagtcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaanaaagggagaatggaaaaaaga

SEQ ID NO: 8068 - DNA, 312 bp, Homo sapiens
  misc_feature 14, 24, 224, 284: n = A,T,C or G
gaacaatttgctgnagctcgtgcncctgagttcgacactagtggatccaaagaattcggcacgagggggaaggtgggagagccaggcaggggcggccttgggaatcctgccacagacaggggcgagggccctgtggagctggcccatctggccgggcccgggagcccagaggctgaggagtggggcagccccccatggaggccctgaaggaagtgggagccacntgtaagggtcctgtccccaagtgggtcttgtgccaggtcttccccgccgggggaaacctntttggcctttccaatggcaagcagggaa

SEQ ID NO: 8069 - DNA, 400 bp, Homo sapiens
  misc_feature 9: n = A,T,C or G
gaacaatangctggagctcgcgcgccctgcaggtcgacactagtggatccaaagaattcggcacgaggttttgaggcttgttccttcgtggaaacatctggatgcagaagttaggctgtacaactatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaagggaagattggaatagcacaggcagccgaataaggattttaatgaaacattggagaatggcttcaagttaatctgtgaatgctttgtcattgtcccatccct

SEQ ID NO: 8070 - DNA, 400 bp, Homo sapiens
  misc_feature 8, 358: n = A,T,C or G
gaacaatnagctggagctcgcgcgcctgaggtcgacactagtggatccaaagaattcggcacgagcggaagtaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggngtccaactttccaggaatcgtcaccagctttatccgcttctg

SEQ ID NO: 8071 - DNA, 400 bp, Homo sapiens
gaacaataagctggagctcgcgcgcctgcaggtcgacactagtggatccaaagaattcggcacgaggtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggcccgtt

SEQ ID NO: 8072 - DNA, 399 bp, Homo sapiens
  misc_feature 264: n = A,T,C or G
gacaaaagctggagctcgcgcgcctgcaggtcgacactagtggatccaaagaattcggcacgagctcgtgccgaattcggcacgagagcaagtgagaatttggtataacatctgtgtttctgaagtttgtatttttaagccgtatatgaaaactcagttgcctttccatatgatgcgttactttgcacacattttgaagaggaattcttagaaacaattaataagagcatatatggtaattgagactacagaatttaaaatggnctgtgtaagtctttattttctcgtaacatgacttgggtaccaattcaggctaatgactggtaaagaaaagaacagacactaatttgcaagtagctcctgaagttgattgctttaagaaaaaccttagcctttatt

SEQ ID NO: 8073 - DNA, 104 bp, Homo sapiens
gacaataagctggagctccgcgcgcttgcggtcgacactagtggatccaaagaattcggcacgagctcagaaattggctttaaaaaaaacaaccaccaaaaaaa

SEQ ID NO: 8074 - DNA, 400 bp, Homo sapiens
  misc_feature 175: n = A,T,C or G
gaaaaagctggagctcgcgcgcctgcaggtcgacactagtggatccaagaattcggcacgaggctcgggatgccttccgagttttctgcaacttcacagcagggggtgagacctgtgtgacgcctagggatgacgtcacgcagttctcttacgtggactcagagggctccccagngggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgcttggaggtgccaacgccctgtgctggag

SEQ ID NO: 8075 - DNA, 400 bp, Homo sapiens
gaacaaaagctggagctcgcgcgcctgcaggtcgacactagtggatccaaagaattcggcacgagccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaattttgaagaattgggggcctgaaaaagcggctcatcccagatggctgggggggtc

SEQ ID NO: 8076 - DNA, 400 bp, Homo sapiens
gacaaaagctggagctcgcgcgcctgcaggtcgacactagtggatccaaagaattcggcacgagccagttaagtgcataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatataccttgctttaattcttaagcataagtaaacatgatataaaaatatatgctgaattactt

SEQ ID NO: 8077 - DNA, 298 bp, Homo sapiens
  misc_feature 291: n = A,T,C or G
gacaataagctggagctcgcgcgcctgcaggtcgacactagtggatccaaagaattcggcacgagcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatcctttttttctttgcacaaataaacagtgaattctcgttnaaaaaaa

SEQ ID NO: 8078 - DNA, 347 bp, Homo sapiens
acaaaagctggagctcgcgcgcctgcaggtcgacactagtggatccaaagaattcggcacgagtcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatggtttctgttttatgttttactgttaatatgaaaataaaagaatttgctatgtaaaaaaaa

SEQ ID NO: 8079 - DNA, 399 bp, Homo sapiens
gacaaaagctggagctcgcgcgcctgcaggtcgacactagtggatccaaagaattcggcacgagggctcttgcctaatgggatatattttctctttgaatgatttggcaagatatcagatgagagaagttgaataaatgttagaagaacatagaaaaaataggttatacacattgggtttctgaagaaatgatgtcattggagaaacaaaacttttattgatttctggaaacatttagggccaattttttgtgtaagtaatttgaatttatgatgatatctctgaccactttttgatattttttctggttcaggtgagtggtgtcattgagcaaacacaaagtcgggctcatccaaggatgagattttgccagagaaaggatgagcagcaagtcaggga

SEQ ID NO: 8080 - DNA, 399 bp, Homo sapiens
gacaaaagctggagctcgcgcgcctgcaggtcgacactagtggatccaaagaattcggcacgagagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaaatggccgagacggtgagcgaggccccccaggggtggcaggaattcctggagtgcctggacccccgggacctcctgggcttcccggtttttgtgaacccaccctcctgccccatgcagggttggtcagcgaagcattt

SEQ ID NO: 8081 - DNA, 374 bp, Homo sapiens
  misc_feature 2: n = A,T,C or G
angaacaaaagctggagctcgcgcgcctgcaggtcgacactagtggatccaaagaattcggcacgaggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagctttccatgctgactgatggttaaataatgtgattg

SEQ ID NO: 8082 - DNA, 400 bp, Homo sapiens
gacaataagctggagctcgcgcgcctgcaggtcgacactagtggatccaaagaattcggcacgagtgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttg

SEQ ID NO: 8083 - DNA, 400 bp, Homo sapiens
gacaaaagctggagctcgcgcgcctgcaggtcgacactagtggatccaaagaattcggcacgagggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgat

SEQ ID NO: 8084 - DNA, 400 bp, Homo sapiens
  misc_feature 3, 12: n = A,T,C or G
ttnagtgggacnctagtggatccaaagaattcggcacgagagacgctgtagctttgtgagcattccagcttggccgctgcttcccttgcagaaaagaacattgagagagaattccagggaccacccaagaggtcttcagttctttcactttctttacagcttcaatgttgttaccacccttccctgtcctgtactccagtccctgtacgtaacagcaacaaaccctgatatgtacaaagtccttgaaaattattgaaattaaaatttttttctcctaagtctaggctttaaatacctaaacaatagggctatgttttataaaatttattttgtaggagtatttagatccttctagattttaacaaatatagaattgaaataatgggttttaaaaatttat

SEQ ID NO: 8085 - DNA, 181 bp, Homo sapiens
  misc_feature 113: n = A,T,C or G
aaggacaaaagctggagctcgcgcgcctgcaggtcgacactagtggatccaaagaattcggcacgaggagtacttctagagcggccgcgggcccatcgattttccacccgggnggggtaccaggtaagtgtacccaattcgccctatagtgagtcgtattacaattactggggcccgggaa

SEQ ID NO: 8086 - DNA, 192 bp, Homo sapiens
gaacaataagctggagctcgcgcgcctgcaggtcgacactagtggatccaaagaattcggcacgaggcctgtaatcccagctacttgggaggctgagacacaggaatcgcttgaaccagggaggcagaggttgcagtgagccaagaccgcaccactgcactccagcttggatgacagagtgagactccatat

SEQ ID NO: 8087 - DNA, 399 bp, Homo sapiens
  misc_feature 303: n = A,T,C or G
gacaaaagctggagctcgcgcgcctgcggtcgacactagtggatccaaagaattcggcacgagcatgggcccgcgttcgcacccaaaaccgtgaagaaggcggcccgggtcatcatagaaaagtactacacgcgcctgggcaacgacttccacacgaaacaagcgcgtgtgcggaggagatcgccattatccccagcaaaaagctccgcaacaagatagcaggttatgtcacgcatctgatgaagcgaattcagagaggcccagtaagaggtatctccatcaagctgcaggaggaggagaganaaaaggagagacaatttatgttccttgaggtctcagccttggatcaggagatttttggaagtagatcctgacacttaagggaaatgctgaagcttt

SEQ ID NO: 8088 - DNA, 352 bp, Homo sapiens
  misc_feature 51: n = A,T,C or G
gacaaaagctggagctcgcgcgcctgcaggtcgacacctagtggatccaangtcttcggcacgagtggaggtggtggcggtggaggacagcagcgagctggtgactggaagtgtcctaatcccacctgtgagaatatgaacttctcttggaggaatgaaatgcaaccagtgtaaggcccctaaaccagatggcccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaa

SEQ ID NO: 8089 - DNA, 399 bp, Homo sapiens
  misc_feature 10, 136: n = A,T,C or G
cttgaggtgngacactagtggatccaaagaattcggcacgagactccatttcccacttccacccccgttagcttcctgcaggactctatccctggcttccccttcagaccttgcaatcacaaaaggttcttctggngagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagc

SEQ ID NO: 8090 - DNA, 348 bp, Homo sapiens
gacaaaagctggagctcgcgcgcctgcaggtcgacactagtggatccaaagaattcggcacgagaattcaaggtgaattaaaagtttgaatgttagacctaaaaccataaaaaccctagatgaaaacctaggcaataccattcaggacataggcacgggcaaggattttatgactaaaataccaaaagcaaaggcaacaaaagccaaaatagacaaatgggatctaattaaactaaagagcttctgcacagcaaaagaaactacaatcagagtgaataggcaacctacagaataagagaaaatttttgcaatctacccatctgaatctacaaagaactcaaaccaatt

SEQ ID NO: 8091 - DNA, 400 bp, Homo sapiens
  misc_feature 3: n = A,T,C or G
ganaataagctggagctcgcgcgcctgcaggtcgacactagtggatccaaagaattcggcacgagcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagca

SEQ ID NO: 8092 - DNA, 400 bp, Homo sapiens
  misc_feature 2: n = A,T,C or G
gnaaaagctggagctcgcgcgcctgcaggtcgacactagtggatccaagaattcggcacgagggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctca

SEQ ID NO: 8093 - DNA, 142 bp, Homo sapiens
gacaataagctggagctcgcgcgcctgcaggtcgacactagtggatccaaagaattcggcacgagagagagtgtgtgtttgtgtgtttcaaggtcagaacaggtttttttgtttttgttttttgttctttgttttttttttt

SEQ ID NO: 8094 - DNA, 306 bp, Homo sapiens
  misc_feature 26, 54, 151: n = A,T,C or G
gaacaataagctggagctcgcgcgcntgcggtcgacactagtggatccaaaganttcggcacgagcatcctaaaatccaaataatcttgtaacctctttctctagtgattcctctccgattctgttgaaaaagcataacataaatgttggngagtctagactctaatggatatgtttatataattccaaacactcaggtgtgtgaatgcatttaaaaacattaatggaaaataatgctgataatattttaaattgatcatgcaattccttcaattatgatggaaagacttgaactttctgaaataa

SEQ ID NO: 8095 - DNA, 310 bp, Homo sapiens
  misc_feature 5, 172, 262, 269, 280, 298: n = A,T,C or G
gacantaagctggagctcgcgcgcctgcaggtcgacactagtggatccaaagaattcggcacgaggagctattgatgtgcaatcttagaaaggagacatgaaaaaaggagaaaaggaaagacagaagtgtatatatatattatttaaacaaacaaaaagaaggtgcgttacntatttttttttcacccgggaaagaggtgagaggatgggaaggagcagcccaggcgtgggaagcggcgagatcctcggggctggggggggncccccgntttgctacctncccctgggaaaaacgccnggggccccccaa

SEQ ID NO: 8096 - DNA, 298 bp, Homo sapiens
  misc_feature 1, 6, 45, 240, 292: n = A,T,C or G
ntgganctcgcgcgcctgcaggtcgacactagtggtatccaaagnaattcggcacgagcggcacgaggctaagtaatctttcatttcttacagaagacgatcaccttctccttattatagtcgatatagatcacgatcaagatctcgttcctacagcccaagtatgtgaactttacttttgtagcataaaaaacctcatttctaattaatggcttactttagaatattagagtataaggnggaagggggcagttaatagttggaaaaatatgaggcaaattaaactataatnggtaac

SEQ ID NO: 8097 - DNA, 396 bp, Homo sapiens
acaataagctggagctcgcgcgcctgcaggtcgacactagtggatccaaagaattcggcacgaggtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaa

SEQ ID NO: 8098 - DNA, 400 bp, Homo sapiens
  misc_feature 2, 21: n = A,T,C or G
anaagctggagctcgcgcgcntgcggtcgacactagtggatccaaagaattcggcacgaggaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcaccgatgccatccttgaggacttggtcttcccaagcgaaattgtgggcaagagaatccgcgtcaaactagatggcagccggctcataaaggttcatttggacaaagcacagcagaacaatgtggacacaaggttgaaactttttctggtgtctataagaagctcacgggcaaaggatgttaa

SEQ ID NO: 8099 - DNA, 400 bp, Homo sapiens
  misc_feature 6, 26, 157: n = A,T,C or G
gaacantaagctggagctcgcgcgcntgcaggtcgacactagtggatccaaagaattcggcacgaggctgcttgaggctctggactgcatcctaccaccaactcgtccaactgacaagcccttgcgcctgcctctccaggatgtctacaaaattggnggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgcttggtgacagcaaaaaatgacccaccaatggaagcag

SEQ ID NO: 8100 - DNA, 281 bp, Homo sapiens
acaaaagctggagctcgcgcgcctgcaggtcgacactagtggatccaaagaattcggcacgagaaaaaagcatgttttaaactctaggctaacaactaaaaattctttttaaatgtaacttaatagaaggaaaatggaatcatgtagaaacatttgattaatccaaaggaagtcaagggaagataaaggtacataaaagtagagcacaaatagtacaatggcgaatatagacccaagcacatcagtagttacatggaggaagactgtgtaacttaagaatt

SEQ ID NO: 8101 - DNA, 265 bp, Homo sapiens
  misc_feature 5, 77, 132, 201, 218, 221, 229: n = A,T,C or G
gacanttatgctggagctcgcgcgcttgaggttcgacactagtggatccaaagaattcggcacgagctcgtgccganttcggcacgagcggcctccgagttcttcaggtctgggaagtatgacctggacttnaagtctcccgatgaccccagcaggtacatctcgcctgaccagctggctgacctgtacaagtccttcatnaaggactacccaggggngtntatcgaanatccctttgaccaggatgactggggagcttggaaaa

SEQ ID NO: 8102 - DNA, 111 bp, Homo sapiens
  misc_feature 23, 52: n = A,T,C or G
acaaaagctggagctcgcgcgcntgcaggtcgacactagtggatccaaaganttcggcacgagctcgtgccgaattcggcacgagagagagagagagagagagagaagaga

SEQ ID NO: 8103 - DNA, 268 bp, Homo sapiens
  misc_feature 251, 255: n = A,T,C or G
gacataagctggagctcgcgcgcttgcggtcgacactagtggatccaaagaattcggcacgagcggcacgaggaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtaaaaaaaaaaaaaaaaaancctngggccgaattcgg

SEQ ID NO: 8104 - DNA, 398 bp, Homo sapiens
  misc_feature 231: n = A,T,C or G
aaaaccgaacattaagctggagctcgcgcgcctgcaggtcgacactagtggatccaaagaattcggcacgagccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagngacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgtttt

SEQ ID NO: 8105 - DNA, 400 bp, Homo sapiens
  misc_feature 6, 8: n = A,T,C or G
gaacantnagctggagctcgcgcgcctgcaggtcgacactagtggatccaaagaattcggcacgagccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctacttcagctgcttaagctggcccacaagtacagaccagagacaaagcaagagaagaagcag

SEQ ID NO: 8106 - DNA, 400 bp, Homo sapiens
  misc_feature 2, 7, 100, 181, 208, 212, 237, 261, 274, 296, 304, 305, 348,350: n = A,T,C or G
cncctgnggtcgacactagtggatccaaagaattcggcacgagtgagaaccactggagtggctggggctggccagaggtcaccgtttctccttcctgtgngctccagtggcttttgaagacactgggttgggacctttttcctgaagagagctggtttgtagccaggagctactggcaccntaccccgagcatctctctctggaagcngctncagggggcatgtccggtttctctgngcttctgaaacccccttctcacgnttcaggccccagnttttaactcaaggccctggggncaggggcnntttaatttgatgattgacaggaggacacagggtttttggccancnaaaaagggaaaaaccaaggcttgggggggaaggggaaagggtggtggtgg

SEQ ID NO: 8107 - DNA, 193 bp, Homo sapiens
  misc_feature 3: n = A,T,C or G
tcngacactagtggatccaaagaattcggcacgaggttgggagctatcctgaaggttaagtttattaaaatttagggtaaagtagtaagtagttccaagttcaggagatacacctgaataattctgaccacagtataaattttgcaatatgtcgaaaatgaaatcccaagcataagcgtaacataatggagta

SEQ ID NO: 8108 - DNA, 399 bp, Homo sapiens
  misc_feature 5, 24, 90, 390: n = A,T,C or G
gacantaagctggagctcgcgccncctgaggtcgacactagtggatccaaagaattcggcacgagccccgtttccagtttcttatagtgnatgcttgggaaacaagatttaaggagcctctgttttggaagggctgtctgtgattgaacgtgaaatgtgtagtgccattgggaccacgaagggaattcttgcacatgctcgtgcttggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgngtgtgattg

SEQ ID NO: 8109 - DNA, 112 bp, Homo sapiens
  misc_feature 2, 3, 67: n = A,T,C or G
gnnggagctcgcgcgcctgcggtcgacactagtggatccaaagaattcggcacgagcggaggtgcanggtcctggtgcttgatggtcgaggccatctcctgggccgcctggc

SEQ ID NO: 8110 - DNA, 200 bp, Homo sapiens
  misc_feature 172: n = A,T,C or G
gaaaataagctggagctcgcgcgcctgcaggtcgacactagtggatcaaaagaattcggcacgagcagctctgacagcccctcctccaggaaggccttccaggacttcctcctctgggtcctctagctctgaccctacagggactccagatctcaacctgttccctggaagnagggcctgctctccatcccagtgaaata

SEQ ID NO: 8111 - DNA, 237 bp, Homo sapiens
  misc_feature 24, 113, 125, 127, 173, 176, 180: n = A,T,C or G
gaacaataagctggagctcgcgcncttcgcgggtcgacactagtggatccaaagaattcggcacgagcccgtcccacggaggcccgcggggtgggggctggggggggggcccncgaccgttccgntnttccggccaggtgcttttctgtcaatttctatggaatgcaaaaggnggntttngttttattttgtttttttggaaagcttaagaaaaaaatctacatcttatacttgagc

SEQ ID NO: 8112 - DNA, 154 bp, Homo sapiens
  misc_feature 7, 29, 30: n = A,T,C or G
gaaatangctggagcttcgcgcgccctgnnggtcgacactagtggatccaaagaattcggcacgagccccaggggcctccacaggccgctgatgacagcgatacagtacttaagtgtctgtgtagacaaccaaagaataaatgattcatggttt

SEQ ID NO: 8113 - DNA, 400 bp, Homo sapiens
  misc_feature 128, 370, 375: n = A,T,C or G
gaacaataagctggagctcgcgcgcctgcaggtcgacactagtggatccaaagaattcggcacgagctcgtgccgaattcggcacgaggtcaagagcaggggtgggccggggaggggtcctttgcggngagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtattgttttgcaaattcaaaatataggnttggnaattttttttttccaggggattttt

SEQ ID NO: 8114 - DNA, 328 bp, Homo sapiens
  misc_feature 9: n = A,T,C or G
gctggagcntcgcgcgccctgcaggtcgacacctagtggatccaaagaattcggcacgaggaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggttttttttt

SEQ ID NO: 8115 - DNA, 400 bp, Homo sapiens
  misc_feature 8, 236, 343, 345, 374, 390, 395: n = A,T,C or G
gaaaattnagctggagctcgcgcgcctgcaggtcgacactagtggatccaaagaattcggcacgagccatcccccaccaggtgagcctgggaactgtttgtagcggctgagggagggaggagggctggtgggtctgtgggaagaggtgcccaaagccctgtgccctggggctctgtgaacaggaagacatgagcctcagggctgagggtgggaagcccccgcccagcccaggcctncgcctacccccctggctgccccctcaccataccgcaacgggcacaagccacagcccccttggagtaactgaggctctcgtctgtgcagaaaaagacagcttgcaggngntccaggcaggggtggatcaggagcccatncttagggtctcagagnggggngacag

SEQ ID NO: 8116 - DNA, 400 bp, Homo sapiens
  misc_feature 18, 124: n = A,T,C or G
gacaataagctggagctngcgcgcctgcaggtcgacactagtggatccaaagaattcggcacgagttatactcctgttcccaggatcttgagctttagtgtgctatacctatgtgtcttatcgngggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtat

SEQ ID NO: 8117 - DNA, 236 bp, Homo sapiens
  misc_feature 5, 19, 37, 43, 60, 213: n = A,T,C or G
ctggnactcgcgcgcctgnggtcgacactagtggatncaaagnaattcggcacgagccgnttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctntgggcttctggaggcaaggatgg

SEQ ID NO: 8118 - DNA, 160 bp, Homo sapiens
  misc_feature 51: n = A,T,C or G
gaaaataagctggagctcgcgcgcctgcaggtcgacactagtggatccacnagaattcggcacgagatcaagtcggtgaactgcccctggcctgtgtcccccagagcagcccagggtcctgccagagtctgcaggggacagccctcgttttttaagtctt

SEQ ID NO: 8119 - DNA, 400 bp, Homo sapiens
gaacaataagctggagctcgcgcgcctgcaggtcgacactagtggatccaaagaattcggcacgagggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagttt

SEQ ID NO: 8120 - DNA, 400 bp, Homo sapiens
  misc_feature 105: n = A,T,C or G
gacaaaagctggagctcgcgcgcctgcaggtcgacactagtggatccaaagaattcggcacgagctcgtgccgaattcggcacgagcaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagt

SEQ ID NO: 8121 - DNA, 342 bp, Homo sapiens
  misc_feature 29, 223: n = A,T,C or G
gaacaataagctggagctcgcgcgcctgnagggtcgacactagtggatccaaagaattcggcacgagacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggngtcattgctcaagaaaaactggcagaatgtccgggccttatatatcaagagcaccatgggcaagccccagcgcctatattaaggcacatttgaataaattctattaccagttcaaaaaa

SEQ ID NO: 8122 - DNA, 400 bp, Homo sapiens
  misc_feature 107: n = A,T,C or G
gacaataagctggagctcgcgcgcctgcaggtcgacactagtggatccaaagaattcggcacgaggtttcattaaagggaacggttatcatcattgcaaatcatggngacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaataggagttttctgcagtatgcttttagtctaagaaaagcacagatggagcaatactttccttctttgaagagaatcccaaaagttagttcat

SEQ ID NO: 8123 - DNA, 400 bp, Homo sapiens
  misc_feature 6, 317, 323, 360, 385, 386: n = A,T,C or G
aacaanaagctggagctcgcgcgcctgcaggtcgacactagtggatccaaagaattcggcacgagtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaagnggtctnctctgacttcaacagcgacacccactcctccaccttngacgctgggggctggcattgccctnnaacgaccacctttg

SEQ ID NO: 8124 - DNA, 400 bp, Homo sapiens
  misc_feature 3: n = A,T,C or G
ganaataagctggagctcgcgcgcctgcaggtcgacactagtggatccaaagaattcggcacgagggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaac

SEQ ID NO: 8125 - DNA, 400 bp, Homo sapiens
  misc_feature 3, 369: n = A,T,C or G
ganaataagctggagctcgcgcgcctgcaggtcgacactagtggatccaaagaattcggcacgagcaattttggaagattcatggaaataatgcataggaactacttagcactctgcatggtacatagaaactgctcaaatatccttaactctcattatcattaccagctgtcctattgttttaggaggataaaatacatatcttaagttaaaatgtttttttatttggttgtgtcgttttgcacggaatagtagggagaagcctcctgatttgtttctctcgtggaaatttgatctgtatctgctaaaaaatgtttatcccttcttctgtaaaagggactctttcccctacggtgagtagtatatagngaatatcaatgctgatacatttaaactgtgg

SEQ ID NO: 8126 - DNA, 375 bp, Homo sapiens
gacaaaagctggagctcgcgcgcctgcaggtcgacactagtggatccaaagaattcggcacgagctcgtgccgaattcggcacgaggctgtttgaatcttgaatttaccattcacaatctgtgtggcctggttgagcttcttaccaccctgagcctcggttttctcatctgtaaaatggagctaataagatctttcttgtatgactttggtgaattaaataagaaaatgaatgtgaagtgcctggtacattttggttgttcaatatgtcctgataaatttcctcattctgtcctgataaatacttgattctgacttagtcatttttgaaaatgttcaggtctgattgggagataaactggattaagggtgccatt

SEQ ID NO: 8127 - DNA, 400 bp, Homo sapiens
  misc_feature 3, 119: n = A,T,C or G
ganaataagctggagctcgcgcgcctgcaggtcgacactagtggatccaaagaattcggcacgagctcgtgccgaattcggcacgagataaattccaaagtttttatttgctccatggngtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttggggattcatcattaagaactgaggctcactgt

SEQ ID NO: 8128 - DNA, 313 bp, Homo sapiens
  misc_feature 6, 118, 166, 271, 285, 299: n = A,T,C or G
gaacanttagctggagctcgcgcgcctgcaggtcgacactagtggatccaaagaattcggcacgagccgcggcgcgcccctcgccaaggtggtcttccgggatccgtatcggtttaanaagcggacggagctgttcattgccgccgagggcattcacacgggccantttgtgtattgcggcaagaaggcccagctcaacattggcaatgtgctccctgtgggcaccatgcctgagggtacaatcgtgtgctgcctggagaaaaacctgganaccgggcaagctgncccggcattagggnaactttgcccccgt

SEQ ID NO: 8129 - DNA, 400 bp, Homo sapiens
  misc_feature 3: n = A,T,C or G
ganaataagctggagctcgcgcgcctgcaggtcgacactagtggatccaaagaattcggcacgagtctcgctctagggagattcttcaagcaatcactatgtcaacagacacaggtgtttcccttccttcatatgaggaagatcagggatcaaaactcattcgaaaagctaaagaggcaccattcgtacccgttgtttttggagacagtcccgctctgtcgcccaggctggagtgcagtggcaggatctcggctcactgcagcctctgcctcctgggttcaagtgattctcctacctcagcttcctgagtagctgggactactcccgccaccacaccaggctgatttttgtgtttttagtagagacggggtttcaccattttggccaggctagtctcgaa

SEQ ID NO: 8130 - DNA, 399 bp, Homo sapiens
  misc_feature 2: n = A,T,C or G
tngctggagctccgcgcgcctgcaggtcgacactagtggatccaaagaattcggcacgagctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactct

SEQ ID NO: 8131 - DNA, 377 bp, Homo sapiens
  misc_feature 24, 29, 31, 32, 323, 339, 376: n = A,T,C or G
gaacaataagctggagctcgcgcncctgngnncgacactagtggatccaaagaattcggcacgaggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggagggggttgttatctcatgagagctgtgatccttttaaaagaaaacctaaacatttcataagactttttggcnccaattgggcagaatngcagtttaaggggggttttaaaggggggggttaaccnt

SEQ ID NO: 8132 - DNA, 240 bp, Homo sapiens
  misc_feature 12, 15, 227: n = A,T,C or G
gctggagctccnccnccttcgcggtccgacacctagtggatccaaagtaattcggcacgaggtaaagtctccctcagccctttcaaaaaataataaatttcctgtgaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggaaaaaaaaaaa

SEQ ID NO: 8133 - DNA, 400 bp, Homo sapiens
gacaataagctggagctcgcgcgcctgcaggtcgacactagtggatccaaagaattcggcacgagggcatttctagagtgtcattgctaaaacctcactgaacagacgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaaga

SEQ ID NO: 8134 - DNA, 400 bp, Homo sapiens
  misc_feature 26, 59, 60, 63, 64, 74, 84, 92, 93, 98, 106, 132, 391: n = A,T,C or G
agtgagtcgtattacaattaactggncgctagtggatccaaagaattcggcacgagggnnttnntagagatgtnattgcttaanccttactnnacagncgcagccnaagggctgcgggcagcacttggtctntgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctcccccttaaatcgtggcaggagagattaaggtaattacaacactcagttctatgtcttacaagcactttgtcttgtctctgcnagaaaattc

SEQ ID NO: 8135 - DNA, 400 bp, Homo sapiens
  misc_feature 10: n = A,T,C or G
cgaacaatantgtctggagctcgcgccgcctgcaggtccgacactagtggatccaaagaattcggcacgagaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgaaaaaaaaaa

SEQ ID NO: 8136 - DNA, 400 bp, Homo sapiens
accacaattttctggagctcgcgcgcctgaaggtcgacactagtggatccaaagaattcggcacgaggaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaa

SEQ ID NO: 8137 - DNA, 400 bp, Homo sapiens
  misc_feature 319: n = A,T,C or G
gaaaaagctggagctcgcgcgcctgcaggtcgacactagtggatccaaagaattcggcacgaggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaaggggggggngggtcacgtggcccaagatttatgctatccgtcagtccatctccaaagcccctggggggcctattaccagaaatatggggg

SEQ ID NO: 8138 - DNA, 400 bp, Homo sapiens
  misc_feature 2, 24, 323, 389: n = A,T,C or G
cnacaattttctggagctcgcgcncctgcaggtccgacactagtggatccaaagaattcggcacgagaaagacttgttgattgggttcagtggacaaagagacggaagcagtttcaaatactcactttccctaaaatctccttggtcattcagaaagtcaagtagtttttcttagaatgaatgtggctctggatagtggctgtgtgtgatggtaagtgataccttttgaaaatgacttggctatgttgggaccttttcatggatatttttaaaaagagtagtggtagaaaaagctggaaggacaagttagattaaatcctggngggagagtttttcacggacacccacatggagcgagtaggatctcattgtatcgcttaaacagtggngagggaaaaaa

SEQ ID NO: 8139 - DNA, 325 bp, Homo sapiens
  misc_feature 3, 67, 226: n = A,T,C or G
ganaataagctggagctcgcgcgcctgcaggtcgacactagtggatccaaagaattcggcacgaggnggctttttgtgtctggcttttttcatttagcataatgttttcaaggtttatccatgttgtaacatgtattcttttaaaaaaattttaatgtgtaaaatatacatatcataacatttaccttttaatcattcataagtacacaaatcagtggcatgaggnggtcccttcccaatgttgtgctgtcatcaccactgtctgttttcagaactttgtcatcatcatccccaacagaaaccctgtacccattaaacagtaact

SEQ ID NO: 8140 - DNA, 330 bp, Homo sapiens
  misc_feature 265: n = A,T,C or G
gacaatattgctggagcctcgcgccgcctgcaggtccgacactagtggatccaaagaattcggcacgagcttacaaactgcaacgcagaagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctcttcctgtgtctcacgcaagntttatactctaatatttatatggcttttttttcttcgacaaaaaaataataaaacgtttcttctg

SEQ ID NO: 8141 - DNA, 307 bp, Homo sapiens
  misc_feature 11: n = A,T,C or G
gaacaatattnctggagcctcgcgcgccctgcaggtcgacactagtggatccaaagaattcggcacgaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctctt

SEQ ID NO: 8142 - DNA, 400 bp, Homo sapiens
  misc_feature 8, 69, 226, 313, 380: n = A,T,C or G
gacaatangctggagctcgcgcgcctgcaggtccgacactagtggatccaaagaattcggcacgagagnggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcnaaggagtctcagcgtagtgggaatgtagctgaactggctctgaaagctactctggtggagagttctacttcaggtttcactcctggnggaggaggctcttcagtctccatgattgccagtagaaagccaacagacggtgcttcctcatcaaatngtgtgacttgatatttccca

SEQ ID NO: 8143 - DNA, 400 bp, Homo sapiens
  misc_feature 8, 9: n = A,T,C or G
gacaatannctggagctcgcgcgcctgcaggtcgacactagtggatccaaagaattcggcacgaggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatata

SEQ ID NO: 8144 - DNA, 399 bp, Homo sapiens
  misc_feature 2: n = A,T,C or G
tnctggagctcgcgcgcctgaggtcgacactagtggatccaaagaattcggcacgagtgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagg

SEQ ID NO: 8145 - DNA, 400 bp, Homo sapiens
  misc_feature 304: n = A,T,C or G
gaacaaaagctggagctcgcgcgcctgcaggtcgacactagtggatccaaagaattcggcacgagagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgagggagtnggatgccatgatgaaggaagccaagcggtcccatcaacttcaccgtcttcctgaccatgttcggggagaagctcaaggggtgccgacccttgagga

SEQ ID NO: 8146 - DNA, 400 bp, Homo sapiens
  misc_feature 8, 23, 87, 174, 192, 313, 315, 346, 355, 372: n = A,T,C or G
gacaatangctggagctcgcgcncttgcaggtcgacactagtggatccaaagaattcggcacgagagaaccccgtgctgcaagcagnactttcaggaacctggaggccttggccttggatttgatggagccggaacaagcagtggacctgacattgcccaaggttgaagcaatnaataaaagactggcctcnttgggggatgagtttaaggagcttgtttacccaccagattacaatcctgaagggaaagttaccaagagaaaacacgataatgaaaggttctggaagcaaaaaggcccaaggtggagtattnanaaagagggagcttgaagacccacatcagcangggtacccntggcaaagttcacttgngcccatgctgaaagaggcctgcccgggc

SEQ ID NO: 8147 - DNA, 400 bp, Homo sapiens
  misc_feature 396: n = A,T,C or G
gacaatatgctggagctcgcgcgcctgaggtcgacactagtggatccaaagaattcggcacgagcggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaacctcctggatctccaggacaaggtgattcaaggcagaaggtagcaacntcca

SEQ ID NO: 8148 - DNA, 287 bp, Homo sapiens
  misc_feature 2, 11: n = A,T,C or G
tntgcccctgngtgcgcactagtggatccaaagaattcggcacgagctcagaactgtttgtttcaattggccatttaagtttagtagtaaaagactggttaatgataacaatgcatcgtaaaaccttcagaaggaaaggagaatgttttgtggaccactttggttttcttttttgcgtgtggcaagttttaagttattagtttttaaaatcagtactttttaatggaaacaacttgaccaaaaatttgtcacagaattttgagacccattaaaaaagttaaatgaga

SEQ ID NO: 8149 - DNA, 338 bp, Homo sapiens
gaacaataagctggagctcgcgcgccctgcaggtcgacactagtggatccaaagaattcggcacgagtgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcatt

SEQ ID NO: 8150 - DNA, 345 bp, Homo sapiens
  misc_feature 3, 8, 184, 210, 231, 233, 236, 294, 306, 310, 326, 337: n = A,T,C or G
ganaatangctggagctcgcgcgcctgcaggtcgacactagtggatccaaagaattcggcacgagggcagatgggaaacgcatcatattctgattcctacctggaaggaattttgttgaaaggggttttcacctgtgagccttggtctgtctcggtagggtggtcaacttcagtggactgtggntggtttcagagcgcctggctgagganttccactgaggggagcactgnancanccctttggcataggctgaggagggagatggaccagcccacgcctggcacctggctccntggcctaagganaggnacatgctggcctgtgncctcctggtgncttttcct

SEQ ID NO: 8151 - DNA, 100 bp, Homo sapiens
  misc_feature 65, 68, 73, 76, 86, 94, 96, 99: n = A,T,C or G
aaaaaagctggagctcgcgcgcctgcaggtcgacactagtggatcaaagaattcggcacgagctngcnccganttnagcacgaggnctccctgntnggnc

SEQ ID NO: 8152 - DNA, 398 bp, Homo sapiens
  misc_feature 29, 298, 323, 336, 345, 384: n = A,T,C or G
gaacaataagctggagctcgcgcgcctgnggtcgacactagtggatccaaagaattcggcacgaggcaggatttctctgcctcttccaaacttttcctccctgaacctgagggaaactaatctggattcactccctctgggtgatacccactcaaaaaggacacttctgattaagacgggtgaaactagagatggacaggttatcaacgaaacttctcagcatcacgatgaccttgaataaaaattgcacacactcagtgcagcaatatattaccagcaagaataaaaaagaaatccntatcttaaagaaacagctttcaagngcctttctgcagnttttcaggngcgcaagatagatttggaatagggaataagctctagttnttaacaacccgaca

SEQ ID NO: 8153 - DNA, 258 bp, Homo sapiens
gacaataagctggagctcgcgcgcctgcaggtcgacactagtggatccaaagaattcggcacgaggaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccag

SEQ ID NO: 8154 - DNA, 400 bp, Homo sapiens
gaaaataagctggagctcgcgcgcctgcaggtcgacactagtggatccaaagaattcggcacgagggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaccaaaataccaagtctcccctcttcatgggaaaag

SEQ ID NO: 8155 - DNA, 400 bp, Homo sapiens
  misc_feature 9, 10: n = A,T,C or G
gaacaatanngctggagctcgcgcgccctgcaggtcgacactagtggatccaaagaattcggcacgagtctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaac

SEQ ID NO: 8156 - DNA, 348 bp, Homo sapiens
gaaaataagctggagctcgcgcgcctgcaggtcgacactagtggatccaaagaattcggcacgagcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaat

SEQ ID NO: 8157 - DNA, 308 bp, Homo sapiens
gacaataagctggagctcgcgcgcctgcaggtcgacactagtggatccaaagaattcggcacgagcaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaa

SEQ ID NO: 8158 - DNA, 400 bp, Homo sapiens
  misc_feature 3: n = A,T,C or G
ganaataagctggagctcgcgcgcctgcaggtcgacactagtggatccaaagaattcggcacgagctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatg

SEQ ID NO: 8159 - DNA, 400 bp, Homo sapiens
  misc_feature 105: n = A,T,C or G
gacaataagctggagctcgcgcgcctgcggtcgacactagtggatccaaagattcggcacgaggtaatctaatctagtttaagatttttgtttaatcctcatggnggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgctttt

SEQ ID NO: 8160 - DNA, 234 bp, Homo sapiens
  misc_feature 3, 214: n = A,T,C or G
gancaaaagctggagctcgcgcgcctgcaggtcgacactagtggatccaaagaattcggcacgagctctacaaaaaaattaaaaattagctgggagtggtagtgcatgcctgcaatcccagctaactcaggaggttgagtctggaggatcccttgagcccatgagtttgaggctgcagtgggctgtgatcgcaccactgcactccagcctcggngagtgagtgagatcctgtct

SEQ ID NO: 8161 - DNA, 100 bp, Homo sapiens
  misc_feature 68, 91, 93: n = A,T,C or G
gctggagctcgcgcgcctgcaggtcgacactagtggatccaaagaattcggcacgagagagaaggtantgtttttaagtggaaatgagaanantaaatgg

SEQ ID NO: 8162 - DNA, 336 bp, Homo sapiens
  misc_feature 7: n = A,T,C or G
gaacaantagctggagctcgcgcgcctgcaggtcgacactagtggatccaaagaattcggcacgagggcacaacaaagattattagcagatttctcagcagaacccgtacaagctgggagaacatggaatgatatagtaaaagtgctacaagaagaaaaaaagaaaactgctggccaaaaatactatactcagcagagtgatccttcagaagtgaaggagaaataaagtccttcccatacaagcacaagctgagggaattcatcaccactagactggcgaagatcttaagtaaccaataacattgcaccacaaggaactaagaaaaaagggcaaac

SEQ ID NO: 8163 - DNA, 399 bp, Homo sapiens
  misc_feature 7: n = A,T,C or G
tgggacnctagtggatccaaagaattcggcacgaggaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggcttgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaaatgctaccaaagaaaaaaatggacaagagcaatgaggagc

SEQ ID NO: 8164 - DNA, 400 bp, Homo sapiens
  misc_feature 3: n = A,T,C or G
ganaataagctggagctcgcgcgcctgcaggtcgacactagtggatccaaagaattcggcacgaggcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcaca

SEQ ID NO: 8165 - DNA, 389 bp, Homo sapiens
gaacaataagctggagctcgcgcgcctgcaggtcgacactagtggatccaaagaattcggcacgaggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcgggggttggtccgcattggggtgcttggatgagggcaagatgaagctggatta

SEQ ID NO: 8166 - DNA, 400 bp, Homo sapiens
gacaaaagctggagctcgcgcgcctgcaggtcgacactagtggatccaaagaattcggcacgagatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttga

SEQ ID NO: 8167 - DNA, 400 bp, Homo sapiens
  misc_feature 355: n = A,T,C or G
gaacaataagctggagctcgcgcgcctgcaggtcgacactagtggatccaaagaattcggcacgaggagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaaggatacntcatcaacagggcccgggtgggagtgccaaaaccaccggctgact

SEQ ID NO: 8168 - DNA, 388 bp, Homo sapiens
  misc_feature 6, 22, 30, 341, 377, 380: n = A,T,C or G
gacaanaagctggagctccgcncgcttcgnggtcgacactagtggatccaaagaattcggcacgagcctgaatgacaaccagccattgaaagaaagcagccctcacaccatagcatctacaccaagagctacaaccaaaatgaggggctcgggggcctggggttttaatctgttggtttaatacttaactcatgtattattttattttgattcaagtattaaaacccaccaaaagtaaagtgagtggtgcctatgaaatataataaaacccatttctgaaaatgttaaaaaaaaagagtacttctagagcggccgcggccccttcgattttccacccgggnggggtaccaggtaagtgtacccaattcgcctatagnggncgatacaa

SEQ ID NO: 8169 - DNA, 400 bp, Homo sapiens
gacaaaagctggagctcgcgcgcttgaggtcgcactagtggatccaaagaattcggcacgagccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccaagagcaaggccgggtttggcaccaagggcttggctatcacatttgtgtccgatgagaatgatgccaagatcctcaatgatgtgcaggatcgcttttgaggtcaatattagtgagctgcctgatgagatagacatctcctcctacattgaacagacacgg

SEQ ID NO: 8170 - DNA, 400 bp, Homo sapiens
  misc_feature 18, 22, 395: n = A,T,C or G
gacaataagctggagctngcgngcttgaggtcgacactagtggatccaaagaattcggcacgagggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcaagggcagtatctctctgcctatttattggggtgctatttattggggatctgcattccccgctgcccaatcatttgcaatgccctaattagggcatcctgccccttcgccttttaggctcaggacggaaggtcaggttgccattggttacccgaggacccttggntactc

SEQ ID NO: 8171 - DNA, 109 bp, Homo sapiens
  misc_feature 1, 2, 12, 29, 34: n = A,T,C or G
nncgaacaatangtctggagctcgtgcgncctgnaggtgcgacactagtggatccaaagaattcggcacgagggattacagtcgtgagccactgcacctggctgcaatt

SEQ ID NO: 8172 - DNA, 400 bp, Homo sapiens
  misc_feature 397: n = A,T,C or G
gaaaaagctggagctcgccgcctgcggtcgacactagtggatccaaagaattcggcacgagatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcaggggttcagcactgagtcatgcttgcttctgctacgacttgattttgttctattccagtttcacgtacatcgttttggggacatctctgcgntat

SEQ ID NO: 8173 - DNA, 185 bp, Homo sapiens
  misc_feature 3, 25, 79: n = A,T,C or G
ganaataagctggagctcgcgcgcntgcaggtcgacactagtggatccaaagaattcggcacgaggtcaacttcttggngtcattgctcaagaaaaactggcagaatgtccgggccttatatatcaagagcaccatgggcaagccccagcgcctatattaaggcacatttgaataaattctatta

SEQ ID NO: 8174 - DNA, 400 bp, Homo sapiens
  misc_feature 13, 20, 360: n = A,T,C or G
taagctggagctngcgcgcntgcggtcgacactagtggatccaaagaattcggcacgagcctatacaaaaaagaatagcagcatttttatcttcaatgacaaagaattgagtccaagaaaatactgtataaaccttgttaaaaatcactcttgtcttttggtcctactcacataattcagcacactttcacagttaactattttttgttcaatttagtgcactggtgagtgactcaaactgctttatcccaaatttgatttacagcctttataagattgcctattaaaaaagcttaaagcttatccttagcccattttgtcagaaaaataatttgcatctaatcatttttataaactggngaatttacggtgttttactatatcatgactaaaattctaa

SEQ ID NO: 8175 - DNA, 223 bp, Homo sapiens
gacaaaagctggagctcgcgcgcctgcaggtcgacactagtggatccaaagaattcggcacgagctggtttctggagataacccatcaataaaagctgcttcctctggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttttt

SEQ ID NO: 8176 - DNA, 400 bp, Homo sapiens
  misc_feature 148, 150, 235, 245, 253, 311: n = A,T,C or G
gacaataagctggagctcgcgcgcctgcaggtcgacactagtggatccaaagaattcggcacgagctgggttacagagcacaccctatctcaaaaaagaaagaaaaaaaaatgaagttttcccctaaaatttcatcattcaataaccngngttattggcttgctatatattttctctagattttataaagtcatagcctacatatgtatacatgttagtatatattaataggttngcacttctgngtacttgngtgaaagaataatcttctgttcctagctaaaaataaattgctatatataatatatagngcttgcagtttttttctctaaatttacaatatttatcatggacatctttttatgtcagtacacaaggatctatcttgctgttattaaca

SEQ ID NO: 8177 - DNA, 96 bp, Homo sapiens
gacaataagctggagctcgcgcgcctgcaggtcgacactagtggatccaaagaattcggcacgagctttaataaagctggatacagtttggcttgg

SEQ ID NO: 8178 - DNA, 281 bp, Homo sapiens
gaacaataagctggagctcgcgcgcctgcaggtcgacactagtggatccaaagaattcggcacgagaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactt

SEQ ID NO: 8179 - DNA, 400 bp, Homo sapiens
  misc_feature 2, 5: n = A,T,C or G
gnaanagctggagctcgcgcgcctgcaggtcgacactagtggatccaaagaattcggcacgagccaaagtctcgcttctgccgaggtgtccctgatgccaagattcgcatttttgacctggggcggaaaaaggcaaaagtggatgagtttccgctttgtggccacatggtgtcaagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggcttgacaggctccaaacaggcatgcgaggtgcctttggaaagccccagggcactgtggccagggt

SEQ ID NO: 8180 - DNA, 232 bp, Homo sapiens
gacaataagctggagctcgcgcgcctgcaggtcgacactagtggatccaaagaattcggcacgagtctgtgtcaaacacctctgtattttttaaaacatcaattgatattaaaaatgaaaagattattggaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8181 - DNA, 400 bp, Homo sapiens
  misc_feature 25: n = A,T,C or G
gaaaataagctggagctcgcgcgcntgcaggtcgacactagtggatccaaagaattcggcacgagggaaagtccacgtttgtgaagttactcacgaaaacttacccagaatggcacgtagcctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacaggtgacaggctccactttgaggctctgatgaacattccagtgctg

SEQ ID NO: 8182 - DNA, 400 bp, Homo sapiens
  misc_feature 8, 28: n = A,T,C or G
gacaattngctggagctcgcgcgcttgnaggtcgacactagtggatccaaagaattcggcacgagtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgt

SEQ ID NO: 8183 - DNA, 188 bp, Homo sapiens
  misc_feature 8, 14: n = A,T,C or G
tccaaagnaattcngcacgagctttaatggaaagcaaaaacaactttctgttctcatttactaatgaatttcaataaactttcttactgatgcaaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8184 - DNA, 263 bp, Homo sapiens
  misc_feature 138: n = A,T,C or G
gacaataagctggagctcgcgcgcctgcaggtcgacactagtggatccaaagaattcggcacgagctttaatggaaagaaaaacaactttctgttctcatttactaatgaatttcaataaactttcttactgatgcgnactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8185 - DNA, 400 bp, Homo sapiens
agaaaaagctggagctcgcgcgcctgcaggtcgacactagtggatccaagaattcggcacgagctcgtgccgaattcggcacgagcgagcggcccaagctgctgctttgctctcacttcactctggatttggcttgaagtcttcctgtgtgaggtccaagcaccctctcttggagtctggattgggacccctttccagtaatatactcctggtgaaccatgaaaggacgatattgaggagacccctgaactaaaggaaatagaccgcaacaccaattggctgactttgggtgggaagtccaagaatccgagtggaggctcaccgaggcgaaggggccaaccatgggaaaggagagtggatgggactcaggggcagctggactctctgtgacatctaaagt

SEQ ID NO: 8186 - DNA, 381 bp, Homo sapiens
gaaaataagctggagctcgcgcgcctgcaggtcgacactagtggatccaaagaattcggcacgaggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatc

SEQ ID NO: 8187 - DNA, 214 bp, Homo sapiens
gacaaaagctggagctcgcgcgcctgcaggtcgacactagtggatccaaagaattcggcacgaggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaa

SEQ ID NO: 8188 - DNA, 355 bp, Homo sapiens
  misc_feature 24: n = A,T,C or G
gacaaaagctggagctcgcgcgcntgcaggtcgacactagtggatccaaagaattcggcacgagtggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtt

SEQ ID NO: 8189 - DNA, 126 bp, Homo sapiens
  misc_feature 6, 7, 14, 17, 44, 59, 63, 116: n = A,T,C or G
atggannctcgtgnccntgcagtgcgacactagtggatccaaanaatcggcacgagggnaagnggggcaagactgttatcgagtaccggtcacagaagacctcacgcctccccatnattgacattg

SEQ ID NO: 8190 - DNA, 131 bp, Homo sapiens
gaacaataagctggagctcgcgcgcctgcaggtcgacactagtggatccaaagaattcggcacgagcatgtttgaaaaatagaaactggatttaccctccaaccttaagcaactagaaaaccaaacaaact

SEQ ID NO: 8191 - DNA, 347 bp, Homo sapiens
  misc_feature 301, 326, 337, 345: n = A,T,C or G
gaaaaaagctggagctcgcgcgcctgcaggtcgacactagtggatccaaagaattcggcacgaggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtncctattttgtatatgtgagatgttnaaataaattgngaaaaaantg

SEQ ID NO: 8192 - DNA, 400 bp, Homo sapiens
  misc_feature 3, 55, 73, 335, 345, 346, 347, 389: n = A,T,C or G
ganaaaagctggagctcgcgcgcctgaggtcgacactagtggatcaaagaattcngcacgaggtcactgagcnggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgnctcagttcannnttcctccacctggcttccactgcacagggcccaggaaggtanaaagggccaag

SEQ ID NO: 8193 - DNA, 345 bp, Homo sapiens
  misc_feature 16, 20, 30, 150, 192, 200, 307, 310, 312: n = A,T,C or G
gctgaagtcttgtgcncctncagtgggacnctagtggatccaaagaattcggcacgagagacaagcaggtgcaggcagcagcagtccagaggcccccctgagatctgaggatagcacctgcctccctcccagccctggcctcatcactgngcggctcaaattcctcaatgataccgaggagctggctgtggntaggccangaggataccgtgggtgccctgaagagcaaatacttccctggacaagaaagccagatgaaactgatctaccagggccggctgctacaagacccagcccgacactgcgnttntnttgaacattacccgacaactgtctgattcactg

SEQ ID NO: 8194 - DNA, 314 bp, Homo sapiens
  misc_feature 241, 275, 305: n = A,T,C or G
gaacaataatgctggagctcgcgcgcctgcaggtcgacatctagtggatccaaagaattcggcacgagagaaggagtaggagctgctgctggcgcccgagagggaaggagccggcctgctgggcagcgtggccacaaggggcggcactcctcaggccgggggagccactgccccgtccaaggccgccagcttgtgatgcatcctcccggcctgccttgagccctgatgctgcttgtcaganaaaggacactgcgtcccccacgggcctgcgtggngctgcccggcccccccacgtgtactgtagnagttttttt

SEQ ID NO: 8195 - DNA, 104 bp, Homo sapiens
  misc_feature 8, 17, 102: n = A,T,C or G
tccaaggnaattcggcncgagccagcagtctcccaaactttcttaactccaacattcacccaaaattccaagtccaaagtctcatctgagaaaagacaagtnct

SEQ ID NO: 8196 - DNA, 400 bp, Homo sapiens
  misc_feature 2: n = A,T,C or G
gnaaaagctggagctcgcgcgcctgcaggtcgacactagtggatccaaagaattcggcacgagctcgtgccgaattcggcacgagagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacagg

SEQ ID NO: 8197 - DNA, 288 bp, Homo sapiens
  misc_feature 3, 109, 236, 242: n = A,T,C or G
ganaataagctggagctcgcgcgcctgcaggtcgacactagtggatccaaagaattcggcacgagaataacttaaagaaaaaaaaacctgggaaatcttcaacatgttnttggaacatatatgtatgtattaatgtatatacatggcttaacttatacgttatggcagctctgtatacagtttgatctcatgtactgaaaaaaaattcttaattttattggagtttataccactgngaaacngcaatatgactgtaagagagtaaaaagattgttacatctaaaaaaa

SEQ ID NO: 8198 - DNA, 396 bp, Homo sapiens
  misc_feature 20, 355, 361, 369: n = A,T,C or G
aaaaagctggagctcgcgcncctgcaggtccgacactagtggatccaaagaattcggcacgagtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaacttcaaagacctggaaaaatggcagaataatctgcttccatcccgccagntttggnttcattgnactgacaacctcagctggcatcatgga

SEQ ID NO: 8199 - DNA, 156 bp, Homo sapiens
  misc_feature 3: n = A,T,C or G
ganaataagctggagctcgcgcgcctgcaggtcgacactagtggatccaaagaattcggcacgagcttggaagaaatatatttgcatattgaaaagcacagaggatttctttagtgtcattgccgattttggctataacagtgtctttctagccat

SEQ ID NO: 8200 - DNA, 367 bp, Homo sapiens
  misc_feature 3, 8, 281, 286, 305, 350: n = A,T,C or G
ganaattngctggagctcgcgcgcctgcaggtcgacactagtggatccaaagaattcggcacgaggttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcngcgtntgcacacgaactgccaaantatggcgtgaaggttggcctgacaaattatgctgcagcatattgnactggcctgctgctggc

SEQ ID NO: 8201 - DNA, 278 bp, Homo sapiens
  misc_feature 4, 112: n = A,T,C or G
agancaataagctggagcctcgcgcgcctgcaggtcgacacctagtggatccaaagaattcggcacgaggcagcctcgagtgcccctgtcccacctggctccccctgctggngtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaat

SEQ ID NO: 8202 - DNA, 400 bp, Homo sapiens
  misc_feature 9, 34: n = A,T,C or G
gaacaatantgctggagctcgcgcgcctgcaggncagacactagtggatccaaagaattcggcacgagcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtat

SEQ ID NO: 8203 - DNA, 279 bp, Homo sapiens
  misc_feature 6, 22, 27, 226, 245, 279: n = A,T,C or G
gacaanagctggagctcgcgcncctgnggtcgacacctagtggatccaaagaattcggcacgaggtggtatgtagcaaatattcaaacgagaactttgaaggccgaagtggagaagggttccatgtgaacagcagttgaacatgggtcatgtcggtcctgagagatgggcgagcgcccgttccgaagggacgggcgatggccctcccgttgccctcggccgatcgnaagggagtcggggttccgngatccccgaatccgggagtggcggaaattggccn

SEQ ID NO: 8204 - DNA, 367 bp, Homo sapiens
  misc_feature 3, 6, 326: n = A,T,C or G
gtnacnttactgggcgctagtggatccaaagaattcggcacgaggttttatacagtctatcattgatggacatttgggttggttccaagtctttgctattgtgagtagtgccacagtaaacataggtgtgcatgtgtcttcatagtagaatgatttataatcctttgggtatatctccaataatggaatagctgggtcaaatggtatttctagttctagatccttgaggaatcgccacactgtcttccataaagattggactaatttacacttcaaccaacagtgtaaaagcattcctatttcttcacatcctctccagcatctgntgtttcctgactttttaatgatccacctgcctcagcctccc

SEQ ID NO: 8205 - DNA, 328 bp, Homo sapiens
  misc_feature 3, 19, 275, 304: n = A,T,C or G
ganaataagctggagcctngcgcgccctgcgggtcgacactagtggatccaaagaattcggcacgagccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacggcccggntcttcggatacgggcaaaaaagagcccanggaagccgcagaacagggatgttg

SEQ ID NO: 8206 - DNA, 296 bp, Homo sapiens
  misc_feature 118: n = A,T,C or G
gacaataagctggagctcgcgcgcctgcaggtcgacactagtggatccaagaattcggcacgaggcagggccaagttcaagtttcctggccgccagaagatccacatctcaaagaagnggggcttcaccaagttcaatgctgatgaatttgaagacatgggggctgaaaagcggctcatcccagatggctgtggggtcaagtacatccccagtcgtggccctctggacaagtggcgggccctgcactcatgagggcttccaatgtgctgcccccctcttaatactcaccaataaat

SEQ ID NO: 8207 - DNA, 166 bp, Homo sapiens
  misc_feature 6, 103: n = A,T,C or G
gaacantaagctggagctcgcgcgcctgcagggtcgacactagtggatccaaagaattcggcacgagctcgtgccgcaaagaggaaacacttgttgaagcatnagtcgctgggggctgccgcgtcaacagccaacctcctggatgatgtggagggccacgcgtgtg

SEQ ID NO: 8208 - DNA, 305 bp, Homo sapiens
  misc_feature 245, 274, 293: n = A,T,C or G
gaaaaagctggagctcgcgcgcctgcaggtcgacactagtggatccaaagaattcggcacgaggaaagtcctcaagtttgcctgcaaggtacaaaagaaggatcccaaggaatgggcagctcagtaccgagaggcgatggaagcggatttgaaggctgcagctgaggctgcagcttgaagccaaggctagggccgagattagagctcgaatgggcattgggctcggctcggagaatgctgccggnccctgcaactgggacgaagctgatatcgnaccctgggccaaagcccgnatccaggcggga

SEQ ID NO: 8209 - DNA, 398 bp, Homo sapiens
gacaataagctggagctcgcgcgcctgcaggtcgacactagtggatccaaagaattcggcacgaggtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgt

SEQ ID NO: 8210 - DNA, 400 bp, Homo sapiens
  misc_feature 5, 21, 27: n = A,T,C or G
gaaanagctggagctcgcgcncctgcnggtcgacactagtggatccaaagaattcggcacgagggtaaagctggagctgaaagggaattccgaggcctcggtgactgcctggttaagatctacaaatctgatgggattaagggcctgtaccaaggctttaacgtgtctgtgcagggtattatcattctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgatgatgatgcagtcagggcgcaaaggaactgacatcatgtacacaggcacgctttgactgc

SEQ ID NO: 8211 - DNA, 203 bp, Homo sapiens
  misc_feature 26: n = A,T,C or G
gacaataagctggagctcgcgcgccntgaaggtcgacactagtggatccaaagaattcggcacgagccaaagtgctggagtgaggctccagaggagactttgagttgatgggggccaggacaccagtccaggtagtgttgagacccaggcctgtggccccaccgagctggagcgggagaggaagccagcttggttttgcactt

SEQ ID NO: 8212 - DNA, 400 bp, Homo sapiens
  misc_feature 79, 87, 105, 124, 129: n = A,T,C or G
gacaaaaagctggagctcgcgcgccctgaggtccgacactagtggatccaaagaattcggcacgagcggacacgctggncctactgncctgatgctgctgagatncctggtggctctcgctggntctgnctacctggcctggatcctgttcttcgagctctatgatttctgcattgtttgtatcaccacctatgctatcaacgtgagcctgatgtggctcagtttccggaaggtccaagaaccccagggcaaggctaagaggcactgagccctcaaacccaagccaggctgacctcatctgctttgctttggaatgtgagccttgcctaagggggcatatctgggtcccttagaaggccctagatgtggggcttctagattaccccctcctcctgccata

SEQ ID NO: 8213 - DNA, 400 bp, Homo sapiens
  misc_feature 3, 22: n = A,T,C or G
ganaataatgctggagctcgcngcgcctgcaggtcgacactagtggatccaaagaattcggcacgagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgcttggtgaaaagggtagcacaggtgctccagggaagcctggtcagatgggaaattcaggcaaaccgggccaacaggggcctccaggagaaggtgggaccccgaggaccccaggg

SEQ ID NO: 8214 - DNA, 306 bp, Homo sapiens
  misc_feature 8, 9: n = A,T,C or G
gaacaatnngctggagctcgcgcgcctgcaggtccgacactagtggatccaaagaattcggcacgagcggcacgagaaaaaacttttcccgaaaggagtcttcaccaaagagctcccatctggcaagaaatacctccgctacacaccccagccttaagtctcttggagaagctggtgctgtgagccaagaggatgtcagctgccaattgtgttttcctgcagcaattccataaacacatcctggtgtcatcacagccaaggtttttaggttgctataccaatggcttattaaatgaaaatggcact

SEQ ID NO: 8215 - DNA, 329 bp, Homo sapiens
gaaaaagctggagctcgcgcgcctgcaggtcgacactagtggatccaagaattcggcacgagagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttc

SEQ ID NO: 8216 - DNA, 298 bp, Homo sapiens
  misc_feature 27: n = A,T,C or G
gaaataagctggagctcgcgcgcctgnaggtcgacactagtggatccaaagaattcggcacgagcttgtctcctccccgtgtccccaatgtcttcagtggggggccccctcttgggtcccctcctctgccatcacctgaagacccccacgccaaacactgaatgtcacctgtgcctgcccgcctcggtccaccttgcggcccgtgtttgactcaactcagctcctttaacgctaatatttccggcaaaatcccatgcttgggttttgtctttaaccttgtaacgcttgcaatcccaat

SEQ ID NO: 8217 - DNA, 237 bp, Homo sapiens
gaaaaagctggagctcgcgcgcctgcaggtcgacactagtggatccaaagaattcggcacgagggataacaagacttaattactgaaaaacagtaacatagcattttgaaatataatcttttaaaatattgatgctttccttttaaatggaaatttaaattttatgattaaaagtttaaacatttatgataattttcctcatcagttctcccataggaaataaagcatgtgaaaggg

SEQ ID NO: 8218 - DNA, 399 bp, Homo sapiens
  misc_feature 18, 26, 29, 232, 276, 281, 331, 351, 374, 377: n = A,T,C or G
aaaaatgctggagctcgngcgcctgnagntcgacatctagtggatccaaagaattcggcacgagccggccctcgaggactggccgggaaccgaggcgtgccaggacagcccgggagacagggcgtggagggccgggatgccactgaccagcacatcgtggatgtggcgctgaagatgctgaagagcaactggcagaggtcgccgtgagtgccaagcgggaagcccctgggtncggtgggcatgattgggtcctccaggaccttcctgggccccccntgggntaccccaggcaagcagggccccccattgggcacccctggcccttcggggngttccttgggattcgggggnacccggggggtcaaaaatcggcnacnacggggcccaagggaaaaacgt

SEQ ID NO: 8219 - DNA, 389 bp, Homo sapiens
  misc_feature 26, 31, 34, 386: n = A,T,C or G
gaacaataatgctggagctcgtgccncctgnggngcgacactagtggatccaaagaattcggcacgagcagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaanggg

SEQ ID NO: 8220 - DNA, 183 bp, Homo sapiens
tctggagcctcgccgcgccctgcaggtcgacacctagtggatccaaagaattcggcacgagctcgtgccgaattcggcacgagaaaatactcactgactgaaattcattcatcttctctgctttttgtaatttaaagttcatctttttttgtaaggtgacttgcttatggggagtctttcttc

SEQ ID NO: 8221 - DNA, 398 bp, Homo sapiens
  misc_feature 2, 263: n = A,T,C or G
gnaaaagctggagctcgcgcgcctgcggtcgacactagtggatccaagaattcggcacgagagaaatttgtggctaccatgtattattacttgcagtttgcctattataagttgaacgacctgaagaatgcagccccctgtgcagtcagctatctgctctttgatcagaatgacaaggtcatgcagcagaacctggtgtattaccagtaccacagggacacgtggggcctctcagatgagcacttccagcccagacctggagnaagttgtggaatatgtgggatgacctcttggaactggaggagaccagctagcccacagcaaccaaagagacttcctcttggcgttcaggaaacacagattctttgtccttttcccaacagcccaggctgttgata

SEQ ID NO: 8222 - DNA, 400 bp, Homo sapiens
  misc_feature 3: n = A,T,C or G
ganaaaagctggagctcgcgcgcctgcaggtcgacactagtggatccaaagaattcggcacgaggaagaggtccttcacatcccttgtaagttggattcctaggtatattcagatcctttcttatgttcacttaaaagttattgattccaacttctgtcctagagatagcataacttggatgtttgagattaaaaaaaaatgcttttagtaacctttatttaactcgctcagcttgctatatagccaagtcggtatttataggtttgtttccacccttgataatttcatgccagtactcatcagaatggaacactgacttggctctgtctgtccttattctcatctccatcccctcctttccaacacactgcaattctagattgaagactgcacatttat

SEQ ID NO: 8223 - DNA, 400 bp, Homo sapiens
  misc_feature 3: n = A,T,C or G
ganaaaagctggagctcgcgcgcctgcaggtcgacactagtggatccaaagaattcggcacgagtgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccct

SEQ ID NO: 8224 - DNA, 400 bp, Homo sapiens
  misc_feature 34, 204: n = A,T,C or G
gaacaataatgctggagctcgcgcgcctgcaggncgacactagtggatccaaagaattcggcacgagccagaacacaggtgtcgtgaaaactacccctaaaagccaaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagact

SEQ ID NO: 8225 - DNA, 177 bp, Homo sapiens
  misc_feature 5, 7: n = A,T,C or G
acaanangctggagctcgcgcgccctgcaggtcgacactagtggatccaaagaattcggcacgagagtaagattcaggaaaaatgcacttgggaatcaaagaaaatggaacttctttttgaaaagacaagcaaccatgttaactgtattgacacatcctcaataaaacctgttgtat

SEQ ID NO: 8226 - DNA, 189 bp, Homo sapiens
  misc_feature 4, 6, 64, 68, 69, 70, 106, 175, 181, 186: n = A,T,C or G
accntncagtgggacgctagtggatccaaagaattcggcacgagctcgtgccgaattcggcacnagcnnntcactgtcataagggagaaagaggctcattcctggnagaagtatgggggggttatcattttcaaaattattgggattctcacctccctccccacctcagtgtttngtctgnccgcnccc

SEQ ID NO: 8227 - DNA, 398 bp, Homo sapiens
  misc_feature 5, 7: n = A,T,C or G
cctgngngcgacactagtggatccaaagaattcggcacgagtgaattggagcaataattttaggaatggagcagaggggaagatttcaggactatactattttacaggtaaaatggacaggtcatggtgatagaatatggggaaggaggaaattgaagtgtgtcaagagtggttaccacgtttctgactagggtggttgggcaattttcatcaaggcagggaattcggaagaagcatgattttgaggtaagaggataaggttttatttctttgcagaaaaccgaagtggacgagtccaacaggtggctagatatccctgagtcctgatgctgtcaacccagctattagtagaaactcctaactggcctccctgtcccctgtcttgccccccttatatc

SEQ ID NO: 8228 - DNA, 397 bp, Homo sapiens
gacaataagctggagctcgcgcgcctgcaggtcgacactagtggatccaaagaattcggcacgagaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcattttttgttgcatgttatgggtccgatgttcctgtaattgcagtgccgtaaaaagcttatt

SEQ ID NO: 8229 - DNA, 174 bp, Homo sapiens
  misc_feature 2, 65: n = A,T,C or G
gnaaaagctggagctcgcgcgcctgcaggtcgacactagtggatccaaagaattcggcacgaggngcgtgtcaaaagaaggaacagctcgttctgcttcctgctgagtcggtgaattctttgctttctaaactcttccagaaaggactgtgagcaagatgaatttacttttctt

SEQ ID NO: 8230 - DNA, 398 bp, Homo sapiens
gaacaaaagctggagctcgcgcgccctgcaggtcgacactagtggatccaaagaattcggcacgagtcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttgggttggctggattcagtaat

SEQ ID NO: 8231 - DNA, 400 bp, Homo sapiens
gaacaataagctggagctcgcgcgcctgcaggtccgacactagtggatccaaagaattcggcacgagtctcactctgtcgcccaggctggagtgcagtggcgtgatctcggctcactgcagcttttgcctcctgggttcaagcaattatcctgcctcagcctcccaggtagctgggattacacgcatgagccactacccctagccgacatttttaagactttgttctcatgtcaaattttaccagtttacactcctaccagcagtctgacagtgcctttcgtagaacataaatcagtataagcatgacagtgtaaataaagaccttaaaaacacagtaggtaaacaaagatgaacaagaccattgtccctgacctaaagtaatagcctctgtattttttt

SEQ ID NO: 8232 - DNA, 233 bp, Homo sapiens
  misc_feature 124, 126, 146, 151: n = A,T,C or G
gaacaataagctggagctccgcgcgcctgcaggtcgacactagtggatccaaagaattcggcacgagctcgtgccgaattcggcacgagtaggaaaggaattattttccccccttttacagggnangtaactttctccacagaagngccantatggcaaaattacacaagaaaacagtattgcaattgacaccattacataaggaacattgaactgttagaggagtgctcttc

SEQ ID NO: 8233 - DNA, 400 bp, Homo sapiens
  misc_feature 176, 282: n = A,T,C or G
gacaataagctggagctcgcgcgcctgcaggtcgacactagtggatccaaagaattcggcacgagctcgtgccgaattcggcacgagtttggctgcatctttatacaacttttcttcattctgaatagtatttgggcacaccagatgtattacatgtttggcttcctatttctggngtttatcattttggttattacctgttctgaagcaactatacttctttgctatttccacctatgtgcagaggattatcattggcaatggcgttcattccttacgagnggctttactgcagtttatttcttaatctatgcaggacactactttcttttcaaaactgcagatcacgggaacagcaagcacaattctgtactttggttataccatgataatgggtttt

SEQ ID NO: 8234 - DNA, 400 bp, Homo sapiens
  misc_feature 169, 276, 303, 361, 375: n = A,T,C or G
gaaaaagctggagctcgcgcgcctgcaggtcgacactagtggatccaaagaattcggcacgagagatggcggaggtgcaggtcctggtgcttgatggtcgaggccatctcctgggccgcctggcggccatcgtggctaaacaggtactgctgggccggaaggtggtggncgtacgctgtgaaggcatcaacatttctggcaatttctacagaaacaagttgaagtacctggctttcctccgcaagcggatgaacaccaacccttcccgaggccccntaccacttccgggcccccagccgcatnttctggcggaccgtgcgaggtatgctgcccccacaaaaccaagcgaggccaggcccgntcttggaccgtctnaaggtgtttgacggcatcccaccgc

SEQ ID NO: 8235 - DNA, 339 bp, Homo sapiens
  misc_feature 200, 309: n = A,T,C or G
gacaataagctggagctcgcgcgccctgaggtccgacactagtggatccaaagaattcggcacgaggttcagtatctcaagcccagaaagatgaattaatccttgaaggaaatgacattgagcttgtttcaaattcagcggctttgattcagcaagccacaacagttaaaaacaaggatatcaggaaatttttggatggnatctatgtctctgaaaaaggaactgttcagcaggctgatgaataaagatctaaagagttaccctggctacagaaaagaagatgccagatgacacttaagacctacttgngatatttaaatgatgccataaaagacctat

SEQ ID NO: 8236 - DNA, 398 bp, Homo sapiens
gaacaataagctggagctcgcgcgcctgcaggtcgacactagtggatccaaagaattcggcacgaggtcaggagtcctgccctcagatttgagagtgcagaaccccgccagccccccaacttgcatgcaaaccctggcatgtgtgcctctttcctgagggatcgtccataaatatcaccagattatctaaaggttgggaaaggatccatgaaccaaaatagggcaagagccactggtcaagatgcttcccctctgcaattgcaaaagtggagtggattgtgtggtgagatgaggaagtttcattcttctcgtttgttttctcccagtacgagtatgcgttgagacatttgtaccgtgctggtcaaccctttgtgagaagccgtatccacttcacaggt

SEQ ID NO: 8237 - DNA, 400 bp, Homo sapiens
  misc_feature 25: n = A,T,C or G
gaaaataagctggagctcgcgcgcntgcaggtcgacactagtggatccaaagaattcggcacgagcggacgggagcgagtatgtccgctctgactcggctggcgtctttcgctcgcgttggaggccgccttttcagaagcggctgcgcacggactgctggagatggtggagtccgtcatgccggtggtggtgtgcacatttgagccccggtatagacagttcccccagctgaccagatcccaggtgttccagagcgagttcttcagcggactcatgtggttctggattctctggcgcttttggcatgactcagaagaggtgctggggtcacttttccgtatcctgatccttcccagtggacagatgaagaattaggtatcccctcctgatgatgaagact

SEQ ID NO: 8238 - DNA, 400 bp, Homo sapiens
gacaaaagctggagctcgcgcgcctgcggtcgacactagtggatccaaagaattcggcacgagagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgg

SEQ ID NO: 8239 - DNA, 400 bp, Homo sapiens
  misc_feature 207, 329, 366, 395: n = A,T,C or G
gaaaaagctggagctcgcgcgcctgcaggtcgacactagtggatccaaagaattcggcacgagtaacccacaggtgttggctgcctggcccatgtgcccactgtctcttccacttggtctgggtttggcaaggcacctgcctgctacttgagggccaggatgctcccccagggaagaaacggaatagtgtgggggtgtgtgcagggnctgcatcccgcagatggctgaaatattaaaattcttctatattggctggaaaattgccatggcccctgagccactgagtatgttcattgccacccctgtcccctccccctgggcaccccttnactttccctgatccctgcaattaaaagggttaaatgnggggcaatatggaaagggactcccaaggnccctt

SEQ ID NO: 8240 - DNA, 400 bp, Homo sapiens
  misc_feature 171, 273, 283, 298, 312, 322, 336, 348, 395: n = A,T,C or G
gaacaataagctggagctcgcgcgcctgcaggtcgacactagtggatccaaagaattcggcacgagggatgggcaagtgtcgtggacttcgtactgctaggaagctccgtagtcaccgacgagaccagaagtggcatgataaacagtataagaaagctcatttgggcacanccctaaaggccaacccttttggaggtgcttctcatgcaaaaggaatcgtgctggaaaaagtaggagttgaagccaaacagccaaattctgccattaggaagngtgtaagggnccagctgatcaagantggcaagaaaatcncagcctttgnacccaatgacggtngcttgaactttnttgaggaaaatgatgaggttctggttgctggatttggccgcaaaggncatgc

SEQ ID NO: 8241 - DNA, 288 bp, Homo sapiens
  misc_feature 25, 115, 225: n = A,T,C or G
gaacaataagctggagctccgcgcnccttcgcgggtcgacactagtggatccaaagaattcggcacgaggctgtttggggaaagtagcaagcacattttctgcaggcccattggntgctgttttgctttcatattctctcaccattaactatacagcagctagagcagaggagttgttaacaaaatatactttcactgctagccaaactatatacatgacttagnggtaatatttgattttatgtcatttacttatgtctctgtatgtcttacaccaagggactaaca

SEQ ID NO: 8242 - DNA, 400 bp, Homo sapiens
  misc_feature 348: n = A,T,C or G
gaacaatttgctggagcctcgcgcgcttgcaggttcgacactagtggatccaaagaattcggcacgaggccgcccaagatgccgaaaggaaagaaggccaagggaaagaaggtggctccggccccagcttgtcgtgaagaagcaggaggctaagaaagtggtgaatcccctgtttgagaaaaggcctaagaattttggcatttggacaggacatccagcccaaaagagacctcacccgctttgtgaaatggccccgctatatcagggttgcagcggcagagagccatcctctataagcggctgaaagtgcctcctgcgattaaccagttcacccagggccctggaccngccaaacaagctactcagcttgcttaagcctgggcccacaaagtacagacca

SEQ ID NO: 8243 - DNA, 180 bp, Homo sapiens
  misc_feature 9: n = A,T,C or G
gaacaatangctggagctcgcgcgccttgcaggtcgacactagtggatccaaagaattcggcacgagttgaggtgggagaatcacttcagcccactaggtcgaggctgtagtgagctataattgtaccactgcactccagcctcggggacagagtgagaccctgtctctactagaaatac

SEQ ID NO: 8244 - DNA, 396 bp, Homo sapiens
  misc_feature 27, 334: n = A,T,C or G
gaaaaagctggagctcgcgcgccttgnggtcgacactagtggatccaaagaattcggcacgagctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagacccccctccctcggatccttattggngtgcccctttagcactcccgcagactctgcggggggaacaggagtgatgataaaaatttttc

SEQ ID NO: 8245 - DNA, 400 bp, Homo sapiens
  misc_feature 20, 393: n = A,T,C or G
gacaaaagctggagctcgcncgcctgcaggtcgacactagtggatccaaagaattcggcacgagcccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagccccctttcccaccatncttcggc

SEQ ID NO: 8246 - DNA, 400 bp, Homo sapiens
  misc_feature 20, 24, 196: n = A,T,C or G
gaaataagctggagctcgcncgcntgcaggtcgacactagtggatccaaagaattcggcacgagtgtgtctgtcaaggatgttcgtcgtggcaacggttgctggtgacagcaaaaatgacccaccaatggaagcagctggcttcactgctcaggtgattatcctgaaccatccaggccaaataagcgccggctatncccctgtattggattgccacacggctcacattgcatgcaagtttgctgagctgaaggaaaagattgatcgccgttctggtaaaaagctggaagatggccctaaattcttgaagtctggggatgctgcattgttgatatggttcctggcaagcccatgtgtgttgagagcttctcagactatccacctttggtcgctttgtgttc

SEQ ID NO: 8247 - DNA, 358 bp, Homo sapiens
gacaataagctggagctcgcgcgcctgcaggtcgacactagtggatccaaagaattcggcacgagcacgaaaagaataaaacacctaggaatacagctaattaggaaggtgaactatgtctacaatgagaaatataaaacactgctcaaagaaatccaaggtgacacaaatggaaaaacatcccatgctcatggaaaggaagaatgaatattgttaaaatggctgtactgtctaaagaaatttacagatttaatgctattcctatcaaactacaaattacattcttcacagaactagataaaactattttaaaatctacatggaatcaaaacagaggtcaaatagctaaggcaatcct

SEQ ID NO: 8248 - DNA, 400 bp, Homo sapiens
  misc_feature 2: n = A,T,C or G
gnaaaagctggagctcgcgcgcctgcaggtcgacactagtggatccaaagaattcggcacgagcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgcctggtgaccgttttggcaattccatttcggcaaagaattca

SEQ ID NO: 8249 - DNA, 195 bp, Homo sapiens
  misc_feature 5: n = A,T,C or G
aaganaaaagctggagctcgcgcgcctgcaggtcgacactagtggatccaaagaattcggcacgagggcggttcagagatgttggaggacacccctcgccatctcgcccttgctgggggcacgggagtggggggggtgacatgggccctaggcagactgcaagcccgaccgagcacttggactcgaactctgtgc

SEQ ID NO: 8250 - DNA, 325 bp, Homo sapiens
  misc_feature 274, 298, 319: n = A,T,C or G
gaaaaagctggagctcgcgcgcctgcaggtcgacactagtggatccaaagaattcggcacgagcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggngacgccaacaccatcgtgtgcaanagcaaggacgggcggggcctnggggga

SEQ ID NO: 8251 - DNA, 390 bp, Homo sapiens
gacaataagctggagctcgcgcgcctgcaggtcgacactagtggatccaaagaattcggcacgaggagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaat

SEQ ID NO: 8252 - DNA, 389 bp, Homo sapiens
  misc_feature 11, 28, 29, 32, 36, 43: n = A,T,C or G
aaccataatantgaagtctgtgtgaccnnttnaagntgggacntctagtggatccaaagaattcggcacgaggctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgct

SEQ ID NO: 8253 - DNA, 400 bp, Homo sapiens
gacaataagctggagctcgcgcgcctgcaggtcgacactagtggatccaaagaattcggcacgagaaatcttattcttaaatgtacaaatcaaaagcttccttctctatgaagacgtctgatcactaccttcccagagaggaataacattgctcccctttgtcttccctaaacactaccatgtcatgagcacttccctcattgtgttatagtcggttggttctcttcatttccccctcagagatatttaggctttgtgaaatcatgtcttatttatctttgtgttttcagggcttaacacggtgcttgccacataaggaatgctcaatattttttgttagcttaattagaggaaagaaaattatactcttattccatataaaatagagtaggttttaaga

SEQ ID NO: 8254 - DNA, 338 bp, Homo sapiens
  misc_feature 25, 222: n = A,T,C or G
gaacaataagctggagctccgcgcncttcgcggtcgacactagtggatccaaagaattcggcacgaggccagggtgtggtggctcgacatgtaatcccaacactttgggagaccaaggcgggtggatcacctcaggtcgggagttcgagaccagcctgatcaacatggagaaaacccgtctctaccaaatatacaaaattacccaggcatggtggtgcattncttgtaatcctagctactcgggaggctgaggcaggagaatcacttgaacccaggaggtggaggttgctgtgaaccaagattgcgcccttgacaacaagagtgaaactccatccatc

SEQ ID NO: 8255 - DNA, 190 bp, Homo sapiens
  misc_feature 25, 76: n = A,T,C or G
gaacaataagctggagctccgcgcnccttcgcggtcgacactagtggatccaaagaattcggcacgagggcagtgnctcctattatgtacaattttagtgctaagtactgtgttaatgatggctatcaaacaatatgttaacatctgaaaggaaatatgtatattgagcataataaatattttataaata

SEQ ID NO: 8256 - DNA, 400 bp, Homo sapiens
  misc_feature 6, 21, 343, 361: n = A,T,C or G
gacaanaagctggagctcgcncgcttgcggtcgacactagtggatccaaagaattcggcacgagcaacagcagcagaaacatcagtatcagcagcgtcgccagcaggagaatatgcagcgccagagccgaggagaacccccgctccctgaggaggacctgtccaaactcttcaaaccaccacagccgcctgccaaggatggactcgctgctcattgcaggccagataaacacttactgccagaacatcaaggagttcactgcccaaaacttaggcaagctcttcatggcccaggctcttcaagaatacaacaactaagaaaagggaggttccagaaaagaagntacatgaactcttgaagncacaccagggcaactcttggaagaaatattatttgcata

SEQ ID NO: 8257 - DNA, 337 bp, Homo sapiens
gacaataagctggagctcgcgcgcttgcggtcgacactagtggatccaaagaattcggcacgagacaatcttcagttgctaatggtttactaactggcttgtaaatgaattcattcagtattcaagaaaatggcactacatttagaaacattttgtagcatttcttactttctaagaatttccaataggcaccatgatcactaaaaaatcataaccaggctgggggcagtggctcacgcctataattccaataatttgggagaccaaggagggaagatcacttgaggccaggagtttgagaccagcctgggcaacatagcaaagactccatctctac

SEQ ID NO: 8258 - DNA, 266 bp, Homo sapiens
  misc_feature 20: n = A,T,C or G
gaacaataatgctggagctngcgcgcttgaggtgcgacactagtggatccaaagaattcggcacgagtccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaag

SEQ ID NO: 8259 - DNA, 381 bp, Homo sapiens
  misc_feature 83: n = A,T,C or G
gacaataagctggagctcgcgcgcttgcggtcgacactagtggatccaaagaattcggcacgagacgagaacatgcctctcgnaaaggatctccttcatccctctccagaagaggagaagaggaaacacaagaagaaacgcctggtgaagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 8260 - DNA, 400 bp, Homo sapiens
  misc_feature 95, 296, 326: n = A,T,C or G
gaaaaagctggagctcgcgcgcctgaggtcgcactagtggatccaaagaattcggcacgagggcccccctagccaagctgtattctactccaagngagctgcaaacctctgctttcatcatgccttctcctgctccaatacttttactagctcttcactacatacaggataaagtctaaattccccaatcaacactaatggcttggcaaaaaaaaacccctatccactcagtaaatacttgctgaatgaatgaactcaacagagacgtggaacacgcccaccattctttgttttgnggtcactccattcttgccggctcaccttgnggatctgggccgccaatgctgcgccgttgctgaagctgtgttctgctgcttccggctctgagaggctggttcga

SEQ ID NO: 8261 - DNA, 274 bp, Homo sapiens
  misc_feature 7, 200: n = A,T,C or G
gacaatnagctggagctcgcgcgcctgcaggtcgacactagtggatccaaagaattcgccacgagattcaatggaaatacactttgctaatattttaatggtatagatctgctaatgaattctcttaaaaacatactgtattctgttgctgtgtgtttcattttaaattgagcattaagggaatgcagcatttaaatcangaactctgccaatgcttttatctagaggcgtgttgccatttttgtcttatatgaaatttctgtcccaagaaagg

SEQ ID NO: 8262 - DNA, 330 bp, Homo sapiens
  misc_feature 3, 6, 252, 298, 309, 318: n = A,T,C or G
tgnagntgcgacactagtggatccaaagaattcggcacgaggggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatggncgcaccctgtctgactacaacatccagaaagagtccaccctgcacntggtgctgcgnttgagaggngggatgcaaatc

SEQ ID NO: 8263 - DNA, 400 bp, Homo sapiens
  misc_feature 127, 247, 262, 321, 326, 381: n = A,T,C or G
gacaataagctggagctcgcgcgcctgcaggtcgacactagtggatccaaagaattcggcacgagctcgtgccgaattcggcacgagaaaaaacgggattcttgtttgatcaaaacaaaagcttgcngttactagtattaaaagcaaacacccaacaaagtaaaaagcccaaacatgtatttgtactaaaacctgaatacacctatacatttaaagaagcattttacttagaattatattttcctgnggaaacttgagtagngccaagagtatttacatctttgacatcacctttaccattcacagactacttaatcttanaatgngtttaattgaaaggtaagcatacttaactgtagaatgatcaggttgttttaatanagaagaactttggtttaat

SEQ ID NO: 8264 - DNA, 320 bp, Homo sapiens
gaacaataagctggagctcgcgcgcctgcaggtcgacactagtggatccaaagaattcggcacgaggctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaatttggttcaagttc

SEQ ID NO: 8265 - DNA, 384 bp, Homo sapiens
  misc_feature 3: n = A,T,C or G
ganaataagctggagctcgcgcgcctgcaggtcgacactagtggatccaaagaattcggcacgagagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacatt

SEQ ID NO: 8266 - DNA, 359 bp, Homo sapiens
  misc_feature 355, 358: n = A,T,C or G
gaaaataagctggagctcgcgcgcctgcaggtcgacactagtggatccaaagaattcggcacgagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggnggng

SEQ ID NO: 8267 - DNA, 199 bp, Homo sapiens
  misc_feature 3: n = A,T,C or G
ganaataagctggagctcgcgcgcctgcaggtcgacactagtggatccaaagaattcggcacgagggaagactggtctgcagctcccactgctcaggccactgaatgggtaggagcaaccactgactggtcttaagctgttcttgcataggctcttaagcagcatggaaaaatggttgatggaaaataaacatcagttt

SEQ ID NO: 8268 - DNA, 393 bp, Homo sapiens
  misc_feature 5, 25: n = A,T,C or G
gaaantaagctggagctcgcgcgcntgcaggtcgacactagtggatccaaagaattcggcacgagggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttttt

SEQ ID NO: 8269 - DNA, 240 bp, Homo sapiens
  misc_feature 3, 6: n = A,T,C or G
ganaanaagctggagctcgcgcgcctgcaggtccgacactagtggatccaaagaattcggcacgagcctgggcaacattgtgaaaacctgtctcttaaaacaaaacaaaacaagccaggtgttgtgacacgtgcttgttgtatgagctacttgggaggctgaggatggaggttggcttgaacccagaaattgaggctgcagtgagctatgatagcaccactatattccagcctgggtgac

SEQ ID NO: 8270 - DNA, 239 bp, Homo sapiens
  misc_feature 115: n = A,T,C or G
gaaaaagctggagctcgcgcgcctgcggtcgacactagtggatccaaagaattcggcacgagttgtaatgttttttatacatatttctactgtacctctaagcatataacatgtnatgaccatgccttgcctatcttctcactacactggaaactccaggccacagtcacatcttagccttacctcctccagtttaacgtagcctgacacacagggcactctcaataaatcaccagcac

SEQ ID NO: 8271 - DNA, 165 bp, Homo sapiens
  misc_feature 67: n = A,T,C or G
gacaataagctggagctcgcgcgcctgcaggtcgacactagtggatccaaagaattcggcacgaggngcttttaaactctgccagaaaaaaataactattttgttttaatctactttttgtatttagtagttatttgtataaattaaataaactgttttcaagtc

SEQ ID NO: 8272 - DNA, 398 bp, Homo sapiens
acaaaagctggagctcgcgcgcctgcaggtcgacactagtggatccaaagaattcggcacgaggcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcg

SEQ ID NO: 8273 - DNA, 400 bp, Homo sapiens
  misc_feature 3: n = A,T,C or G
ganaataagctggagctcgcgcgcctgcaggtcgacactagtggatccaaagaattcggcacgagcgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattc

SEQ ID NO: 8274 - DNA, 400 bp, Homo sapiens
  misc_feature 3, 311: n = A,T,C or G
ganaaaagctggagctcgcgcgcctgcaggtcgacactagtggatccaaagaattcggcacgagggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgncttcctgtaagaccttcgggtcaaggcagaggcaggaaactaactggtgtgagtcaaatgccccctgagtgactgcccccagcccaggc

SEQ ID NO: 8275 - DNA, 269 bp, Homo sapiens
  misc_feature 181: n = A,T,C or G
gacaaaagctggagctcgcgcgcctgcaggtcgacactagtggatccaaagaattcggcacgagatatgttctgtgagaatagtagctttatctttgatataatacatagtctccaaataggtaatacttcgcaattgattagattttcagagtagatttagagttatctgtttttctggngagggtcaaatatttttgttaattaagctcacaaatttgataaattaagaattatctgcatttgtcttgtaacataataatgtgtaat

SEQ ID NO: 8276 - DNA, 400 bp, Homo sapiens
  misc_feature 4, 10, 55, 75, 81, 222, 225, 228, 279, 319, 320, 339, 378,394, 398: n = A,T,C or G
cgancttaanctggggcctcgccgcgcctgcggtcgacactagtggatccaaagnaattcggcacgagggtgccnttgccncatgtgaagtcactgtgccagcccagaacactggtctcgggcccgagaagacctcctttttccaggctttaggtatcaccactaaaatctccaggggcaccattgaaatcctgagtgatgtgcagcttgatcaagactggnganggngggggagccagcgaagccacgctgctgaacatgctcaacatctcccccttntcctttgggctggccatccagcaggtgttcgacaatggcnngcatctacaaccctgaagngctggatatcacagaggaaactctgcattctcgcttccngggggggggcccgcantgtngc

SEQ ID NO: 8277 - DNA, 193 bp, Homo sapiens
  misc_feature 9, 27, 99, 112, 115: n = A,T,C or G
gaacaatantgctggagcctcgccgcncctgcaggtcgacactagtggatccaaagaattcggcacgagctcgtgccgaattcggcacgaaaaaaatcnttaacctccctgntgntgacttcaacgaaatgatgtccaaagagcagttcaatgaagctcaacttgcattaattcgggatatacgtaggagggg

SEQ ID NO: 8278 - DNA, 400 bp, Homo sapiens
  misc_feature 67, 128, 143, 179, 217, 225, 285, 304, 330, 355, 392: n = A,T,C or G
gacaaaaagctggagctcgcgcgcctgcaggtcgacactagtggatccaaagaattcggcacgaggngaagtatagcctttatgtcagaaaaacattctttttagctgcttactttctcatgaaaagnaaagatgtttacagngatgccaagttttcaagtttctgtataacaacaggnagaggttctaatcatattgaaaactgtgttataatggnctgagccntgttgctaaggaaacaatagggtccaattttgtattcctgctctcctgtgctggaaaagngactgggtactgtacaggntcatgttctctggctgcaggtaaaangggctttttgcatttttgctctggnctttcaggccagaagcatgcatttttctacaagagcntcacaaca

SEQ ID NO: 8279 - DNA, 400 bp, Homo sapiens
  misc_feature 28, 229: n = A,T,C or G
gaacaataatgctggagcctcgcgcgcntgcggtcgacactagtggatccaaagaattcggcacgagctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcnggggccccgtgcatcatctataatgaggataatggtatcatcaaggccttcagaaacatccctggaattactctgcttaatgtaagcaagctgaacattttgaagcttgctcctggtgggcatgtggggacgtttctgcatttggactgaaagtgctttcccggaagttag

SEQ ID NO: 8280 - DNA, 400 bp, Homo sapiens
gacaataagctggagctcgcgcgcttgcggtcgacactagtggatccaaagaattcggcacgagatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatactttt

SEQ ID NO: 8281 - DNA, 118 bp, Homo sapiens
  misc_feature 6, 18, 33, 36, 39, 41: n = A,T,C or G
gagggnttgaagctacgntccctagggcatgtnttncananctttttactctcatacttctcttagcgctttctttactatgtaaaccaggggcatccaatcttttaggcttccctgg

SEQ ID NO: 8282 - DNA, 374 bp, Homo sapiens
  misc_feature 16, 19, 30, 99, 182, 209, 290, 354: n = A,T,C or G
taattcggcacgagcntgngggcgccgatngccatctctcaagaaaccaggaatctggatttttaaaaatttgaaatcaccaaagtttaagaaattggnttattttccaaaacattacatgagtcaaataaatcttattgggggacagaattcagcttgtggacttaacaatgggggagggntttattctagagcccccgccttaggcnttgattacagaggaatgcttttgaatttctaactctagaaattattagaaatctaaaagatctccagatggataaaatgangccctgtacttttatcagaaagcaaggggaaagtacccaatgatctccttttttgattactttnaactaaaaaaaaaaaaaaaa

SEQ ID NO: 8283 - DNA, 322 bp, Homo sapiens
  misc_feature 18, 20, 173, 174: n = A,T,C or G
taattcggcacgaggatncntggccgagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgnngggggaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaa

SEQ ID NO: 8284 - DNA, 399 bp, Homo sapiens
  misc_feature 14, 41, 372: n = A,T,C or G
ctggagctcgcgcncctgcaggtcgacactagtggatcttnagaattcggcacgaggaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgnttcttccttttttagttcttcaaagat

SEQ ID NO: 8285 - DNA, 282 bp, Homo sapiens
  misc_feature 6, 24, 48, 68, 76, 224, 225, 227: n = A,T,C or G
cgacanttagctggagctcgcgcncctgcaggtcgacactagtggatncaaagaattcggcacgaggnttacaagnactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaannangtttgtgatctctactactgttgattttgccctcggagcaaactgaataaagcaa

SEQ ID NO: 8286 - DNA, 400 bp, Homo sapiens
  misc_feature 8, 13, 33, 52, 54, 58, 63, 211, 212, 213, 379: n = A,T,C or G
attacccnttcantgggacgactagtggttttnaagaattcggcacgaggantnaacnaaggnaatgaaagatctgtataccgaaaactataaaacattgatgaaagaaactgaagatgacacaaataaatggaaaggtatctgtgttcatgaactggaagaactagtattattaaaatgttcatacgacccaaagcaatctacagatggnnngcaatccctatcaaaatttcaatgtcattcttcaaagaaatagaaaaagcaattctgaaattcatatggacccacaaaacacccctaatagctgaagcaacctggactaaaacaaagctagaggtattacactaccagatttcaaaatacattacaaagatatggnaatcaaaacaacatgcaatgg

SEQ ID NO: 8287 - DNA, 400 bp, Homo sapiens
  misc_feature 11, 12, 40, 59, 60, 62, 208, 215, 216, 217, 364: n = A,T,C or G
gctggagctcnngcccctgcaggtcgacactagtggattnaaagaattcggcacgagcnngncccaggccctcatcatgatccagcccattctctactcttactcctttcatgggccaccagagccagtactcttggatagcagcagcattctagctgacagaattttgctgatggatactttctttcaaattgtcatttatcttggngagaccnnngcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagncaggctcgattccttttgtccaaagtgaacccatct

SEQ ID NO: 8288 - DNA, 236 bp, Homo sapiens
  misc_feature 12, 39, 59, 68, 163, 181, 200: n = A,T,C or G
gctggagctcgnccgcctgcaggtcgacactagtggatncaaagaattcggcacgagtnataactggnttctgcttgtatccacacaacaccaggacttaagacaaatgggactgatgtcatcttgagctcttcatttattttgactgtgatttatttggagnggaggcattgtttttaanaaaaacatgtcatgtaggntgtctaaaaataaaatgcatttaaactcaaaaaaaa

SEQ ID NO: 8289 - DNA, 400 bp, Homo sapiens
  misc_feature 13, 22, 44, 70, 166, 174, 210, 221, 355: n = A,T,C or G
tctggagctcgcnccgccccgnaggtcgacactagtggatccanagaattcggcacgagtggtaggagcngggcctggagcccagggctcctgattcccaggccactgctctccacaacaccaagtcacagaatttcaagatcccacccagagtctgattttgcangatcctgngaggaacttgcctagcagtctgtggacccagactgngttcatttatngggtttctagacaaggtaaagtaggaattaagtagatgaaggcataaaggagcaactgaaacttacgggaacttgaaattctctcacaggggcagatgccatggggattttttgagactgcttctggggaaggngaaccacccatctactcagaagggaggggtcaggaatggctagca

SEQ ID NO: 8290 - DNA, 326 bp, Homo sapiens
  misc_feature 13, 25, 29, 33, 54, 55, 75, 76, 77, 80, 81, 82, 84, 86, 133,247, 257, 261: n = A,T,C or G
aacccactttttnctggagcctcgnagcncctnaggtccgacactagtggatcnnaagaattcggcacgagcccnnnttnnngngncctttattgtagcattgctgtctgcaagggagcccctagcccctggnagacatagctgcttcagtgccccttttctctctgctagatggatgtttgatgcacctggaggtcttttagcctgcccttgcatggcgcctgcttggaggggggggagagctctnctggcatgangccncaagttttcttgactggaggccatcaacccctcttgggtgagggcctttgttctgagccctggca

SEQ ID NO: 8291 - DNA, 134 bp, Homo sapiens
  misc_feature 8, 13, 24, 40, 82: n = A,T,C or G
tggagctnggagngcctgaggtgngacactagtggatccnaagaattcggcacgagccattccaatccattacaatcgagtngattccattccattccattccattccattccattccattccattccattcct

SEQ ID NO: 8292 - DNA, 400 bp, Homo sapiens
  misc_feature 7: n = A,T,C or G
gacaatnagctggagctcgcgcgcctgcaggtcgacactagtggatccaaagaattcggcacgagtgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagattgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatc

SEQ ID NO: 8293 - DNA, 400 bp, Homo sapiens
  misc_feature 6: n = A,T,C or G
gaacantaagctggagctcgcgcgcctgcaggtcgacactagtggatccaaagaattcggcacgagctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatct

SEQ ID NO: 8294 - DNA, 186 bp, Homo sapiens
  misc_feature 24, 27, 36: n = A,T,C or G
gaacacataagtctggaggctcgngcncctgcaggncgacactagtggatccaaagaattcggcacgagctgtcctctgccagcctacaggaggaaaagcaaggcttacagaaggatgttccttcaggaggaagcagcactaaaagcactctgagtcaagatgagtgggaaaccatctcaataaac

SEQ ID NO: 8295 - DNA, 400 bp, Homo sapiens
  misc_feature 5, 391: n = A,T,C or G
gaaanagctggagctcgcgcgcctgcaggtcgacactagtggatccaaagaattcggcacgaggtcatcctgagggtgcgacctccgccgcgatggtgacccggttcctgggcccacgctaccgggagctggtcaagaactgggtcccgacggcctacacatggggcgctgtgggcgccgtggggcttggtgtgggccaccgattggcggctgatcctggactgggtaccttacatcaatggcaagtttaagaaggataattaattacacaaacccttcacagactgctctggtgccttggggggtgctagctcctcccacctcagcacctgctgcatctgggagcagccccaagcctcaggatggacaagaggaaacccacagctcagcnttcaggctt

SEQ ID NO: 8296 - DNA, 301 bp, Homo sapiens
gaaaaagctggagctcgcgcgcctgcaggtcgacactagtggatccaaagaattcggcacgagctttgggaggccaaggcgggtaaatcacctgaggttgggagtttgagaccagcctgaccgacatggagaaaccctgtctctaccggaaatacaaaattggccgggcatgatggagcatccctgtagtcctagctacttgagacgctgaggcaggaaaattgcttgaacccgtgaggcaagaggttgcaatgagccgagatcgtgccattgcactccagcctgggcaataagagcagga

SEQ ID NO: 8297 - DNA, 400 bp, Homo sapiens
gacaaaagctggagctcgcgcgcctgcggtcgacactagtggatccaaagaattcggcacgaggagcatccaggtagaaatgcccagcaagtccttggagatataggaccagaatccaggagggaactagagtcaaaacaatagagttggtgactgggctgcatggaagtaatagaggcgacagggtggtggtgtctctctcacactgatgggaaaaatgaagctatcttcactcttgacatgtgcaataaataaaacaaagaaaaccattagatgctggcaaggtgtgaaactggcctcctgaaaagaaggtgggctggctcagcggaaattgggaaagagaggggaatattcatttatgctgagcttgctacatcccaagtgctctgacactgcattt

SEQ ID NO: 8298 - DNA, 343 bp, Homo sapiens
  misc_feature 14, 27, 145, 168, 178, 241, 250, 285, 295, 323: n = A,T,C or G
aaaaaccgaacatntaagctggagctncgcgcgcctgcaggtcgacactagtggatccaaagaattcggcacgagctcagcctcccgagtagctgggattacaggcatgctccaccatgcccagctaattttgtatttttagtanaaacggggtttcaccatattggncaaggctggnctcgaactccagacctcaggtgatccgcccacctcggcctcccaaactgctgggattacaggngtgagcccnccgcgcctggccagggactatactctttttaaaanagacatttgngggggctcacacaatatttgaaatagtncccctctaaaaaaaaaaaaa

SEQ ID NO: 8299 - DNA, 389 bp, Homo sapiens
  misc_feature 22, 24, 29, 313, 378, 382: n = A,T,C or G
cgacaaaagctggagctccgcncncttgnggtcgacactagtggatccaaagaattcggcacgagtgcggctccagcccagcccgctgctcactttccaccctctctccacctgcctctggtttctcaggcctctgctctccgacctctctcctctgaaaccctcctccacagctgcagcccatcctcccggctccctcctagtctgtcctgcgtccctctgtcccccgggtttcagagacaacttcccaaagcacaaagcagtttttccccctaggggggggaggaagcaaaagactctgtacctattttgnatgtgataataaatttggagaaggtttttaattaatttttggaatgcctgggaataaaggcatgngggnaaatgac

SEQ ID NO: 8300 - DNA, 400 bp, Homo sapiens
gacaataagctggagctcgcgcgcttgcggtcgacactagtggatccaaagaattcggcacgagatcaaaccagccacaacgttctgttaagcctaaacctaatccagagcaaggccctaatgctcttcaattctatggaggctgagagttgaggaagctgtggaagaaaagtttgaagctagcagagaataattcatgaggttgaaagaaagaagctgtctccagaacataaaagtgcaaggtgaagcagcaagtgctgatggagaacctccagcatgtgatccagaagacctagctgaaataactgacgagggtgactgcattaaataacaaattttcattgtagacaaaacagccttctattcaaagaagatgccatctaggactttcatggctaga

SEQ ID NO: 8301 - DNA, 318 bp, Homo sapiens
  misc_feature 4, 7, 54, 100, 105: n = A,T,C or G
gaanaanagctggagctcgcgcgcctgcaggtcgacactagtggatccaaaganttcggcacgagcagaggtgcaaggagctgggtatcacccgccctcnacatnaaactccgggccacaggaggaaaataggaccaagacccctggacctggggcccagtcggccctcagagcccttgcccgctcgggtatgaagatcgggcggattggaggatgtcacccccatcccctctgacagcactcgcaggaaggggggtcgccgtggtcgccgtctgtgaacaagattcctcaaaatattttctgttaataaattgcctt

SEQ ID NO: 8302 - DNA, 204 bp, Homo sapiens
  misc_feature 3, 28, 91, 99: n = A,T,C or G
ganaataagctggagctcgcgcgcttgnggtcgacactagtggatccaaagaattcggcacgaggggagataaacaagaaaagccaaaatnaaactttnaaagacaaaaacatttgagatgaaaattacattggatgaactaaaagcagattagaaactgcagaaagaaaagattagcaaacttgaagatacaagaacagacac

SEQ ID NO: 8303 - DNA, 132 bp, Homo sapiens
  misc_feature 76, 88, 94, 96, 114: n = A,T,C or G
gacaataagctggagctccgcgcgccttcgaaggtcgacactagtggatccaaagaattcggcacgagctcgtgcnagattggggacngagggngnaaggactcacagcgaccntttttttttctctgaaac

SEQ ID NO: 8304 - DNA, 400 bp, Homo sapiens
  misc_feature 241: n = A,T,C or G
gacaaaagctggagctcgcgcgcctgcggtcgacactagtggatccaaagaattcggcacgagtttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggntcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacagg

SEQ ID NO: 8305 - DNA, 370 bp, Homo sapiens
gaacaaaagctggagctcgcgcgcctgcaggtcgacactagtggatccaaagaattcggcacgagctcacttggcagtcactccccattctccctagctcctggcaacaacttaacctgtctctgtggatttgcctattctggacatttcatataaattgaatcataatttatgtagtcttttgtgactggcttcttttacttaggatgtttttaaggttcttactgttgtaggatgtatcaggagtttgtttttatgatgaatgttccatcttatggacgtaccacatttgtccattcattagttgacagacatttgaattgcttccacttcctggcttctatgaataatgctgccataaacatttgtg

SEQ ID NO: 8306 - DNA, 400 bp, Homo sapiens
  misc_feature 22, 194: n = A,T,C or G
gaaaaagctggagctccgcgcncttcgcaggtcgacactagtggatccaaagaattcggcacgagaaaatactgatgtgtgttttaactaactggtatattgatccatgggaggctgcacagaagaccctgcggccaggaggggcattgtcagtggctgcttctcctgagctccacgccttcattgcagctgantgttcgatacaatacacctgcttcacagccccatggacatccctacaggtactgtcatgtgaagccttgcctagtagttctctccagggcaaatgaagctcacagttttgcaaaggtggaaacctcttattcacatttgctttgattccccgatggagtagactgcctttgttccatacaggcaaagtaaggatattttaatatca

SEQ ID NO: 8307 - DNA, 310 bp, Homo sapiens
  misc_feature 15, 21, 32, 139, 219, 240, 247, 248, 279: n = A,T,C or G
aacacataatgctgnagcctntgtgaccttgnggtgggacacttagtggatccaaagaattcggcacgagcctcagcggcccccatcagcaccgcctccaccacccgcttgcagctcggcgccccgccccggggccgcntcgagtttcatgattctttagtctccttcaatctagatctgtccccaggattgtttaaaagcttactgacaaacctttgngactgtaaatgacctgaggtntacattnntctttacttggagaatagtaatttttttcantatgcctttaaaaggatccttacccatgaaa

SEQ ID NO: 8308 - DNA, 400 bp, Homo sapiens
  misc_feature 22, 29, 37, 315: n = A,T,C or G
gacaaaagctggagctcgcgcngcttcgngggtcganactagtggatccaaagaattcggcacgagcggcacgagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattattttttngggggatcaagtgttccgcaagctattccaactttacaagagaaattgtgattatgttcttttcacctgtgggttataaaaaatg

SEQ ID NO: 8309 - DNA, 400 bp, Homo sapiens
  misc_feature 213, 273: n = A,T,C or G
gacaataagctggagctcgcgcgcctgcaggtcgacactagtggatccaaagaattcggcacgagccaacatgggccgcgttcgcaccaaaaccgtgaagaaggcggccccgggtcatcatagaaaagtactacacgcgcctgggcaacgacttccacacgaacaagcgcgtgtgcggaggagatcgccattatccccagcaaaaagctccgnaacaagatagcaggttacgtcacgcatctgatgaagcgaattcagagaggcccagtaagnaggtatctccatcaagctgcagggaggaggagagagaaaaggagagacaattatgttcctgaggtctcagcctttggatcaggagattatttgaagtagatcctgacactaaggaaatgctgaagct

SEQ ID NO: 8310 - DNA, 317 bp, Homo sapiens
  misc_feature 118: n = A,T,C or G
gacaaaagctggagctcgcgcgcctgaggtcgcactagtggatccaaagaattcggcacgagctgtggagaagatgactaacgtgtcacggggaagagctccctgctgtgtgcctgcnccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatg

SEQ ID NO: 8311 - DNA, 400 bp, Homo sapiens
  misc_feature 8, 360: n = A,T,C or G
gaacaaanagcctggagctcgcgcgcctgcaggtcgacactagtggatccaaagaattcggcacgagcgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacactttgtgttcattgngggatgttaaagccaacaagcaccagattaaacaggctgt

SEQ ID NO: 8312 - DNA, 280 bp, Homo sapiens
  misc_feature 55, 69, 70, 71, 74, 106, 258, 259: n = A,T,C or G
gaacaataagctggagctcgcgcgcctgcaggtccgacactagtggatccaaagnaattcggcacgagnnngancgagaccctcctgcctaacacggtgaaacctngtctctactaaaaatacaaaaaaattagccgggcgaggaggccgggtgcctatagtcccagctgctcgggaggctgaggccggagaatggcatgaacccgggaggtggagcttgcatgtgagctgagattgcaccactgcactccaggctgnnctcagagcaagactccatctc

SEQ ID NO: 8313 - DNA, 379 bp, Homo sapiens
  misc_feature 13, 17, 210, 211: n = A,T,C or G
gctccgcgccccntcgnggtcgacactagtggatccaaagaattcggcacgagcttcagttgttcctccatggctagaaccataataaacaatgtacccgtaatttgtaacataaagtattggaatatgttagtaacaatcttgcagccttcctttccaaagttcattttattttgatcagttcagtatattgcactaattattttaggnnttttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagc

SEQ ID NO: 8314 - DNA, 400 bp, Homo sapiens
  misc_feature 5, 6: n = A,T,C or G
aattnnctggagctcgcgcgcctgcggtcgacactagtggatccaaagaattcggcacgagcggcacgagccaacatgggccgcgttccgcaccaaaaccgtgaagaaggcggcccgggtcatcatagaaaagtactacacgcgcctgggcaacgacttccacacgaacaagcgcgtgtgcgaggagatcgccattatccccagcaaaaagctccgaaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagatttttgaagtagatcctgacactaaggaaatgctgaagctt

SEQ ID NO: 8315 - DNA, 328 bp, Homo sapiens
gacaataagctggagctcgcgcgcctgcaggtcgacactagtggatccaaagaattcggcacgagcaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaaga

SEQ ID NO: 8316 - DNA, 394 bp, Homo sapiens
  misc_feature 29, 129: n = A,T,C or G
gaacaataagctggagctcgcgcgcctgnaggtcgacactagtggatccaaagaattcggcacgagagaaggtggcccggaccatcggcatttctgtggatccgaggaggcggaacaagtccacggagnccctgcaggccaacgtgcagcggctgaaggagtacccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggccccgtgccaccgcccggctctttcggcatacgggc

SEQ ID NO: 8317 - DNA, 400 bp, Homo sapiens
  misc_feature 24: n = A,T,C or G
gacaaaagctggagctcgcgcgcntgcaggtcgacactagtggatccaaagaattcggcacgaggatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtctta

SEQ ID NO: 8318 - DNA, 348 bp, Homo sapiens
  misc_feature 18, 21: n = A,T,C or G
agctggagctcgcgcgcntgnaggtcgacactagtggatccaaagaattcggcacgagtgatgaccacagagctgggaaaattgttgtgaacctcacaggcaggctaaacaagtgtggggtgatcaagccccagatttgacgtgcaacctcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttcc

SEQ ID NO: 8319 - DNA, 399 bp, Homo sapiens
  misc_feature 11, 33, 230: n = A,T,C or G
aacgaacattntgctggagctccgcgcgcctgnaggtcgacactagtggatccaaagaattcggcacgaggggataaccccttttttacttactgtaaagagtcattttcataaagatcaattcattgatttgttttttgtaaagctatcattcaatatatattataaattaatataaatttaagggaagctctatgtaaggagacttagagccaaactgtttaagctgnatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacac

SEQ ID NO: 8320 - DNA, 400 bp, Homo sapiens
  misc_feature 2, 5: n = A,T,C or G
cntgnggtgcgacactagtggatccaaagaattcggcacgagcagcagcatatcctatttccccatgttggttggattcttaatagtttcaatagtttaatgtgaggtagaaagactcaaataattatattggaggtggaaatggtaaaggaaagacatatattattaatattgtgaagaaagaaaaatcctctaattgaagaggatccccttaactgaaggctaaaacccctcattgtttgacatttgacctttaatatatttcccagactcacagacaatatcttgaatctaaaggatttcgatgtatctaacaagaaagagattctgcacattcccagattctcagtgtgaaagcagggaattaatgctattcaaatgtaagagatcccagtctggg

SEQ ID NO: 8321 - DNA, 229 bp, Homo sapiens
  misc_feature 8, 19, 28, 31, 84, 153, 221: n = A,T,C or G
gtggatcnaagaattcggnacgaggttntantccacctctatgatcttgagactggtacctgcatctacatgaatagaatcagnggagaaacaatttttgttactgcacctcatgaagccacagctggaataattggagtaaacagaaagggncaagtaaggaaaccttgaaacttaagcaataaaataagataacctgatgagttgggaacaatcctgtncttttgag

SEQ ID NO: 8322 - DNA, 139 bp, Homo sapiens
  misc_feature 98, 102, 104, 106, 109, 115, 117, 119, 121, 130, 134, 135: n = A,T,C or G
acttaattggagtattatgacacttttccacacaaaggaaattaaaactaaaaaattcaggacataggaaataggatatatatatataaatatatatntaantntnatncatatntnangnaattatgtntgtnntggg

SEQ ID NO: 8323 - DNA, 170 bp, Homo sapiens
  misc_feature 5, 49: n = A,T,C or G
ccacnttttgctggagctcgcgcgcctgaggtcgacactagtggatccnaagaattcggcacgaggtctttacctatctccaagtctccaagtggttcactgagctaacattaatctaatttaattctcaaccagatttgaaaaagggagattaattggataaaaatgta

SEQ ID NO: 8324 - DNA, 400 bp, Homo sapiens
  misc_feature 4, 18, 275, 337, 362: n = A,T,C or G
gctngtgcgcctgctggncgcacttgtggatccaaagaattcggcacgagccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgntaaaatttgcactttgaaggtaagctttctaggcctgaccctccaggtgtcaatggacttgngctactatatttttttattcttggnatcagtttaaaattcagacaaggcccacagaataagat

SEQ ID NO: 8325 - DNA, 329 bp, Homo sapiens
  misc_feature 12, 59, 120, 188, 212, 257, 280: n = A,T,C or G
gcactttgtggntccaatgaattcggccgagtaacccttactttttctgcattattttnatagttatgcttcttgcttcctggaaccaatcagctacagcatcacttctcaaaatgtggnctcagtactgcctacatcagattaaataggtgcattgtaaaatgtagatttctgcattccagggtcangacctatttaatcttaatattagnccagggacccgaaaatatccattttacaaaacaaatacgcattgnctttattatgcaaataacaattnggcccctcctgatgtaatgtttaaatataaagtttaatatctatcggtt

SEQ ID NO: 8326 - DNA, 278 bp, Homo sapiens
  misc_feature 1, 6, 65, 66, 80, 224, 235, 237, 240: n = A,T,C or G
nctggngctcgcgccgccccgcaggtcgacactagtggatccaaagaattcggcacgagccgagnngcgcggaggcggangcttgggtgcgttcaagattcaacttcacccgtaacccaccgccatggccgaggaaggcattgctgcttggaggtgtaatggacgttaatactgctttacaaggaggttctgaagactgccctcatccacgatggccctagcanggggggaattngngangctgccaaagccttaaaacaagcgccagccccattttt

SEQ ID NO: 8327 - DNA, 197 bp, Homo sapiens
  misc_feature 2, 11, 45, 166: n = A,T,C or G
cnaggctgacncaacactccagaaagagtccaccctgcacctggngctccgtctcagaggtgggatgcaaaatcttcgtgaagaccctgactggtaagaccatcaccctcgaggtggagcccagtgacaccatcgagaatgtcaaggcaaagatccaagataaggnaggcatccctcctgattagcagaggttgatc

SEQ ID NO: 8328 - DNA, 133 bp, Homo sapiens
  misc_feature 11, 25, 34, 55, 67, 83, 85, 89, 114, 121, 130, 133: n = A,T,C or G
tagtggatccnaagaattcggcacnagcttcagngatatacttggtagatatctnaagccttttgtnttttacacaatggggntntatnctattgttttcttttgaaaggaagnatggtgnacactggcnttn

SEQ ID NO: 8329 - DNA, 263 bp, Homo sapiens
  misc_feature 3, 15, 69, 152, 187, 196, 223, 228, 249: n = A,T,C or G
cgngcttaggaaggncgacctgtggcaaatgtggctaccctgccaagcgcaagagaaagtataactggngtgccaaggctaaaagacgaaataccaccggaactggtcgaatgaggcacctaaaaattgtataccgcagattcaggcatggnttccgtgaaggaacaacacctaaacccaagagggnagctgttgnaagcatccagttcatcttaagaatgtnaacgnttaggcatgcaataaatgggntgggtttaaaaaat

SEQ ID NO: 8330 - DNA, 120 bp, Homo sapiens
  misc_feature 2, 4: n = A,T,C or G
tngngtattgcggcaagaaggcccagctcaacattggcaatgtgctccctgtgggcaccatgcctgagggtacaatcgtgtgctgcctggaggagaagcctggagaccgtggcaagctgg

SEQ ID NO: 8331 - DNA, 311 bp, Homo sapiens
  misc_feature 23, 55, 107, 259: n = A,T,C or G
tggacactccatgctgaactgcntgagggcctcttccagagccaactgctgtgcnggggcccaagcctagcatctaagcctgttccctgttcaggtaaagccccagngattgagcttcttggctgccttgttctcagggtttgttttggaagtagaaaaaatagtggtctcactgcttatttagatgtgattcactagtcaccatggactttgaccctaaggatagttagaggaaatagggcatttgcttgtgctgagnggcagaaccagcattgagtgggcacctatcatgagttagacctgtactatgg

SEQ ID NO: 8332 - DNA, 327 bp, Homo sapiens
  misc_feature 6, 17, 41, 44, 55, 67, 80, 161, 191, 193, 224, 235, 252, 313: n = A,T,C or G
tgtgancttgaaatgcnacactagtggattcaaagaattcnttncgagctctggnccgccgccgccncgatgggcgtgcntcgggaacagtaagaccgaggaccagcgcaacgaggagaaggcgcagagtgaggccaacaaaaagatcgagaagcagctgnaggaaggacaagcaggtttaccgggccacncnccccctgctgctgttgggtgcttggagaatntggtaaaagcnccattgtgaagcagatnaggatcctgcatgttaatgggtttattggagacagggagaaggcaaccaaagtgcaggacntcaaaaacaacctg

SEQ ID NO: 8333 - DNA, 500 bp, Homo sapiens
  misc_feature 21, 26, 59, 71, 73, 147, 150, 254, 455, 465, 482: n = A,T,C or G
cttcttttgggaaaaaaaccnggatnttttgggcgcttgcaggtccacactagtggatncaaagaattcgntncgagtttgagtgaagctcttcctggggacaatgtgggcttcaatgtcaagaatgtgtctgtcaaggatgttcgncgnggcaacgttgctggtgacagcaaaaatgacccaccaatggaagcagctggcttcactgctcaggtgattatcctgaaccatccaggccaaataagcgccggctntgcccctgtattggattgccacacggctcacattgcatgcaagtttgctgagctgaaggaaaagattgatcgccgttctggtaaaaagctggaagatggccctaaattcttgaagtctggagatgctgccattgttgatatggttcctggcaagcccatgtgtgttgagagcttctcagactatccacctttgggtcgctntgctgttcgngatatgagacagacagntgcgggggggtgtcatca

SEQ ID NO: 8334 - DNA, 346 bp, Homo sapiens
  misc_feature 2, 45, 47, 68, 72, 116, 313, 318: n = A,T,C or G
tnttgggcgcttgaaggtccgacactagtggatccaaagaattcngntcgagcagattatcatggccntggnagacgaatttgggtttgaaattcctgatatagatgctgaaaagntaatgtgtccacagagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgtnttacntctttgaaaataaatctataaaaccaac

SEQ ID NO: 8335 - DNA, 498 bp, Homo sapiens
  misc_feature 2, 3, 45, 83, 138, 419, 430: n = A,T,C or G
tnnttgggcgcttgaggtccccactagtggatccaaagaattctntcgagctcatgctgtcttatgtcacgtgtgggactgcngaactagaagacatcatgttcttctcctgcaaagtccccaggacgcctggaggcnggtgggggtgacggaagggagctaatgctccaagtccacttcagccggagcagcttttagtgtttgttggtcggtctgttgattaccttggaagattttattggaagaaagcatttgaggaccaagttaatctactctttcaataccaacccagaaaccttaaagaaaatcttgacagatttaataggataagagttttttaaaaaatctctttggcaaaagactccgtcagccgggctaagagacgagagagaaaatacataccacattatgcctgtgtnagcttaatagncaatatataaagagcttttacagaccaataaggagagcatgagatcaccattgcaagatgagcagaac

SEQ ID NO: 8336 - DNA, 231 bp, Homo sapiens
  misc_feature 3, 5, 110: n = A,T,C or G
gcncntgaggtcgacactagtggatccaaagaattcggacgagcaacaagggagctcactcagtgggtttgatgtggtggatgctggctcgggaagttctgcgcatgcgnggaaccatttcccgtgaacacccatgggaggtcatgccctgatctgtacttctacagagatcctgaagagattgaaaaaagaagagcaggcttgttgtggaaaaggcagtgaccaaaggag

SEQ ID NO: 8337 - DNA, 100 bp, Homo sapiens
  misc_feature 5, 11, 78: n = A,T,C or G
ggtcnacactngtggatcaaagaattcggacgagtaaccttacactaatctttaagaattacatgattatgagggttntcatcagagcaattaaattaaa

SEQ ID NO: 8338 - DNA, 359 bp, Homo sapiens
  misc_feature 26, 345: n = A,T,C or G
gaacaataagctggagctcgcgcgcntgagggtcgacactagtggatccaaagaattcggcacgagtgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatattttttgatctttgagtgtattctatttgtgtaacggactttggcttacatttgaataatgtctagattttgaaaaattacctgtataatggagaattaaaactttgnagacattttgaaat

SEQ ID NO: 8339 - DNA, 398 bp, Homo sapiens
gacaataagctggagctcgcgcgcctgcaggtccgacactagtggatccaaagaattcggcacgagggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttc

SEQ ID NO: 8340 - DNA, 398 bp, Homo sapiens
  misc_feature 32, 174, 222, 226, 259, 265, 288, 308, 325, 362, 379, 393: n = A,T,C or G
acaataatgctggagctcgtgcgccttgagtncgacactagtggatccaaagaattcggcacgagttctcctctgcgctatgtggacattgccatcccatgcaacaacaagggagctcactcagtgggtttgatgtggtggatgctggctcgggaagttctgcgcatgcgtggnaccatttcccgtgaacacccatgggaggtcatgcctgatctgtacttntacngagatcctgaagagattgaaaaagaagagcagnctgctnctgaaaaggcagtgaccaaaggnggaatttcagggtgaatggncttgctcccgctccctngatttcactgctactccagcctgaggttgcaggactnggtctgaaggtgtacanggggcccctctgtngccta

SEQ ID NO: 8341 - DNA, 288 bp, Homo sapiens
  misc_feature 3, 25: n = A,T,C or G
ganaataagctggagctcgcgcgcntgcaggtcgacactagtggatccaaagaattcggcacgagaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaata

SEQ ID NO: 8342 - DNA, 245 bp, Homo sapiens
  misc_feature 2, 204, 237, 242: n = A,T,C or G
gnaggtcgacactagtggatccaaagaattcggcacgagggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagnacctgattgtatttttttttttaaataaaagcncaagncct

SEQ ID NO: 8343 - DNA, 320 bp, Homo sapiens
  misc_feature 9, 70, 256, 260, 270, 302: n = A,T,C or G
gaacaatangctggagctcgcgcgcctgcaggtcgacactagtggatccaaagaattcggcacgaggccnagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctntgcnggttcctggngaacgccatcatcaacagtgggccccgggagnactccacacgcattgggc

SEQ ID NO: 8344 - DNA, 400 bp, Homo sapiens
  misc_feature 3: n = A,T,C or G
gancaataagctggagcctcgcgcgcctgcaggtccgacactagtggatccaaagaattcggcacgagggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgcactcgactttccaacatttttgttat

SEQ ID NO: 8345 - DNA, 400 bp, Homo sapiens
  misc_feature 3, 50, 296, 397: n = A,T,C or G
aantctggagctccgcgcgccctgcaggtcgacactagtggatccaaagnaattcggcacgagaaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagngtttaacctggcatggattaataagagttggagttttatttttaagaaaaattcacaagctaacttccactaatccattatcctttattttattgaaatgnata

SEQ ID NO: 8346 - DNA, 400 bp, Homo sapiens
  misc_feature 30, 371: n = A,T,C or G
gaacaataagctggagctcgcgcgccctgnaggtcgacactagtggatccaaagaattcggcacgagttgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgnaagaccttcgggtcaaggcagaggcagga

SEQ ID NO: 8347 - DNA, 356 bp, Homo sapiens
  misc_feature 9: n = A,T,C or G
gaacaatangctggagctcgcgcgcctgcaggtcgacacctagtggatccaaagaattcggcacgagcccgacgttactcggactaccccgatgcatacaccacatgaaacatcctatcatctgcaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcct

SEQ ID NO: 8348 - DNA, 130 bp, Homo sapiens
  misc_feature 7, 26: n = A,T,C or G
gacaatnagctggagctcgcgcgccntgcaggtcgacactagtggatccaaagaattcggcacgagaacgaatagtgtggatgtgatttgtcatccagtattaagttcttagtcattgatttttgtgttt

SEQ ID NO: 8349 - DNA, 400 bp, Homo sapiens
  misc_feature 12, 15, 61: n = A,T,C or G
aaaaacgaacantantctggggctcgcgcgccctgcaggtcgacactagtggatccaaagnaattcggcacgagaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacact

SEQ ID NO: 8350 - DNA, 315 bp, Homo sapiens
  misc_feature 20, 69: n = A,T,C or G
atctggggctcgccgcgccntgcaggtcgacactagtggatccaaaaattcggcacgagcttgaacagnacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 8351 - DNA, 400 bp, Homo sapiens
  misc_feature 395: n = A,T,C or G
gaaaaagctggagctcgcgcgcctgcggtcgacactagtggatccaaagaattcggcacgagcacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaaagagggcccagcccagagccacctggatctatccctgcggcctccacacctgaacttgcctaactaactggcaggggagacaggagcctagcggagcccagcctgggagcccaggagggggggcaagaacagnggggc

SEQ ID NO: 8352 - DNA, 400 bp, Homo sapiens
  misc_feature 340: n = A,T,C or G
gaacaataagctggagctcgcgcgcctgcggtcgacactagtggatccaaagaattcggcacgagtgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggngggccagtaaatctcctgacaataaacctgtttggtatggtcttgatatgaacagagggt

SEQ ID NO: 8353 - DNA, 400 bp, Homo sapiens
  misc_feature 6, 28, 32, 67, 159, 265, 310, 326, 349, 382, 386: n = A,T,C or G
gacaanagctggagctcgcgcgccctgnggtngcactagtggatcaaagaattcggcacgagctcgngccgaattcggacgagcctaccgccagctcttccaccctgagcagctcatcacaggcaaggaagatgctgccaataactatgcccgagggcnctacaccattggcaaggagatcattgaccttgtgttggaccgaattcgcaagctggctgaccagtgcaccggtcttcagggcttcttggttttccacagctttggngggggaactggttctgggttcacctccctgctcatggaacgtctntcagttgattatggcnaagaagcccaagctggggttctncatttacccagcacccccagggtttccacaagngtgnggggtggagcccct

SEQ ID NO: 8354 - DNA, 360 bp, Homo sapiens
  misc_feature 195, 263, 302, 324: n = A,T,C or G
gaaaaagctggagctcgcgcgcctgcgggtcgacactagtggatccaaagaattcggcacgagctcgtgccgaattcggcacgagtgggaagtgtaccagagctgctgattgttctagaaccaccccactattccaagtttattaggctcagagccactgagagccttgagttctgggcacttctgtcacccatntccttttgcagcaccagacaaagaattttcctttttagcctcattgtttgcatgccttaggagtcggncactgtgctccttcgtagtctttgggtctcagaaatagngaacaggtacagcatccagggnggaatttttgcctttagtaccctcccttgaactctt

SEQ ID NO: 8355 - DNA, 294 bp, Homo sapiens
  misc_feature 115: n = A,T,C or G
aagcattgatttaaaagatgcacggaaagttatcttacagcaaactgtagtttgcctccaagacaccattgtctccctttaatcttctcttttgtatacatttgttacccatggngttctttgttccttttcataagctaataccactgtagggattttgttttgaacgcatattgacagcacgctttacttagtagccggttcccatttgccatacaatgtaaggttctgcttaatgtaacttcttttttgcttaagcatttgcatgactattagtgcttcaaagtcaatttt

SEQ ID NO: 8356 - DNA, 400 bp, Homo sapiens
  misc_feature 33: n = A,T,C or G
gaacaataagctggagctcgcgcgcctgcaggncgacactagtggatccaaagaattcggcacgagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactc

SEQ ID NO: 8357 - DNA, 288 bp, Homo sapiens
  misc_feature 2, 11, 29, 53, 61, 279: n = A,T,C or G
tnggcaacttntaactggagcctcgtgcnccttgccagttcgacactagtggntccaaagnaattcggcacgagggcaaaccgggccaacaggggcctccaggagaggtgggacccccgaggaccccaggggcttcccttggcagtagaggagaattaggaccagtgggatcccccaggccctaccaggtaaactgggttctctgggtagcccctggccctcccttgctttgccttgggcccccgtggactttcctggaatgaaaaggtgacaaggggntgtagtccg

SEQ ID NO: 8358 - DNA, 348 bp, Homo sapiens
gaaaaaagctggagctcgcgcgcctgcggtcgacactagtggatccaaagattcggcacgaggtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttattattcagtgaaaagattttatttatggaattaaccatttaataaagaaatatttaccta

SEQ ID NO: 8359 - DNA, 400 bp, Homo sapiens
  misc_feature 267, 368, 384: n = A,T,C or G
gacaataagctggagctcgcgcgcctgcaggtcgacactagtggatccaaagaattcggcacgagcagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggnattttctcctggggctcagagtgttgtactcgtaaaacaaggatattcgatgttgtctacaatgcatctaataacgagctggttcgtaccaagaccctggngaagaattgcatcggngctcatcgacagcaca

SEQ ID NO: 8360 - DNA, 273 bp, Homo sapiens
gacaataagctggagctcgcgcgcctgcaggtcgacactagtggatccaaagaattcggcacgagtgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggc

SEQ ID NO: 8361 - DNA, 400 bp, Homo sapiens
  misc_feature 124: n = A,T,C or G
gacaataagctggagctcgcgcgcctgcaggtcgacactagtggatccaaagaattcggcacgagcacaaacatttatggaatggtaaaaattttgagcttcaaacaattgaataccatttggngatgcaagaaaatgctaattttaaaaatagcttctgattttggaattatggaagtctaaatataatgttttctcactttaaaatggaaaaaactttcgtgctgtttctaaaacacaacataaaaagggaaaaccatttggcactgtgtacacacaggaacatcccagttttagtttttaatcatgtttttcaaggaaacaattactttctccaaatgcatggtttttaaagagtacttcgtatttccaggacatcttcttttgacctagtgtgttt

SEQ ID NO: 8362 - DNA, 400 bp, Homo sapiens
gacaaaagctggagctcgcgcgccctgcaggtcgacactagtggatccaaagaattcggcacgagcggcacgagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattc

SEQ ID NO: 8363 - DNA, 295 bp, Homo sapiens
  misc_feature 88, 110, 219, 293: n = A,T,C or G
gaacaaaaagctggagctcgcgcgccctgcaggtcgacactagtggatccaaagaattcggcacgagctcgtgccgaattcggcacgnggtgtttgcaagaggtgtgcantcaccttcgaccaggcccaacctgaccgtcaagctgccagatggatacgaaattcaagttccccaaccgcctcaacctggaggccatcaactacatggcagttgacggngacttcaagatcaaatgtgtggcctttgactgaaatcagccagcccatggcccccaataaaggcggctgccttntg

SEQ ID NO: 8364 - DNA, 159 bp, Homo sapiens
gacaataagctggagctcgcgcgcctgcaggtcgacactagtggatccaaagaattcggcacgagggaaaatcgcttgaaccccggaagcggaggttgcagtgagctgagattgcgacattgttctccagcctgggcaagaagagtgaaattctgtctc

SEQ ID NO: 8365 - DNA, 271 bp, Homo sapiens
gaacaaaagctggagctcgcgcgcctgcaggtcgacactagtggatccaaagaattcggcacgagattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaat

SEQ ID NO: 8366 - DNA, 400 bp, Homo sapiens
gaacaataagctggagctcgcgcgccctgcaggtcgacactagtggatccaaagaattcggcacgaggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatc

SEQ ID NO: 8367 - DNA, 398 bp, Homo sapiens
gaaaaaagctggagctcgcgcgcctgcaggtcgacactagtggatccaaagaattcggcacgagcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggtttgggccacgagttcctgaacgacggccccaagccggggcagtccccggattctgaatattcagcagcttcgctg

SEQ ID NO: 8368 - DNA, 281 bp, Homo sapiens
  misc_feature 24, 114: n = A,T,C or G
gacaataagctggagctccgcgcncctgcggtcgacactagtggatccaaagaattcggcacgagcttcctgtaagaccttcgggtcaaggcagaggcaaggaaactaactggngtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 8369 - DNA, 400 bp, Homo sapiens
  misc_feature 32: n = A,T,C or G
gacaataatgctggagcctcgtgcgccctganggtcgacactagtggatccaaagaattcggcacgagggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggcttttgtgttcaccaagga

SEQ ID NO: 8370 - DNA, 398 bp, Homo sapiens
  misc_feature 1, 27, 32, 222, 223, 337: n = A,T,C or G
nccatttatgtgagtcgattacatttnctggncgcaagtggatccaaagaattcggcacgagattgggcaccaagagtcttgcagggggacccacagatatgccatgtccttcacacgtgcttgggctccttaacctgaaggcaaattgctacttgcaagactgactgacttcaaggaatcagaaattacctagaagcaccatgtttttttctatgaccttnncggtccttcaggtcattttaaggtccactgcagggggttagtgagaaagggtatactttgtggtatgttttgctttcctaatagggacatgaaggaaacccagcaatttgctgntatggggaatggcctgtagagcagagtcaagagcggtgtgctttgccccgactgctcccat

SEQ ID NO: 8371 - DNA, 400 bp, Homo sapiens
  misc_feature 40, 266, 388: n = A,T,C or G
gaacaataatgctggagctcgcgcgcctgcaggtcgacanctagtggatccaaagaattcggcacgaggctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctgggggncaacatgaagggcaatgacatcagcagtggcacagtcctctccgattatgtgggctcggggcctcccaagggcacaggcctccaccgctatgtctggctggtttacgagcaggacaggccgntaaagtgtgacg

SEQ ID NO: 8372 - DNA, 281 bp, Homo sapiens
  misc_feature 222, 239, 246, 264, 276: n = A,T,C or G
gaaaaagctggagctcgcgcgcctgcaggtcgacactagtggatccaaagaattcggcacgagggcaggtgtttgagaagtcccccctgcgggtgaagaacttcgggatctggctgcgctatgactcccggagcggcacccacaacatgtaccgggaataccgggacctgaccaccgcaggcgctgtcacccagtgctacccgagacatgggtgccccggcncccgggcccggagcccnacttcanttcagatcattgaaaggngggagggagatncggcg

SEQ ID NO: 8373 - DNA, 400 bp, Homo sapiens
gaacaataagctggagctcgcgcgccctgcaggtcgacacctagtggatccaaagaattcggcacgagcgagtgtgtcatgctggcctgtgaggtggaccgagaggacgcccctgtgcgttggtacaaggacgggcaggaggtggaggagagtgacttcgtggtgctggagaatgagggcccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagcccgtgcgcctggagcgtgtggtgctgacctgtgagctatgccggcccttgggcaagaggtgcgcttgg

SEQ ID NO: 8374 - DNA, 400 bp, Homo sapiens
  misc_feature 3: n = A,T,C or G
ganaaaagctggagctcgcgcgcctgcaggtcgacactagtggatccaaagaattcggcacgagcggcacgagattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagt

SEQ ID NO: 8375 - DNA, 222 bp, Homo sapiens
gacaaaagctggagctcgcgcgcctgcaggtcgacactagtggatccaaagaattcggcacgaggaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctcc

SEQ ID NO: 8376 - DNA, 101 bp, Homo sapiens
  misc_feature 3: n = A,T,C or G
tcnaggggggacacatatgtggatccaaagaattcggcacgaggctctctctctctctctctctctctctctctctctctctctctctctctctctctctc

SEQ ID NO: 8377 - DNA, 338 bp, Homo sapiens
  misc_feature 89, 164, 214, 216, 294: n = A,T,C or G
ctggagctcgcgcgcctgcaggtcgacactagtggatccaaagaattcggcacgaggagatggggtttcaccctgttggccaggctggnctaaaactcctgacctcaggtgatccacctgcctcggcctcccaaagtgctgggattacaggcgtgagctactgnccccagcctcccagattctttaatgagtatgtcttactttcctaatggtnangacaaacattaaaaaccatggtacccaagagtctgtccagtatgcctcctgcccacccagccaggccaatgggggcanggggtcggccctatctttctagcctctttccctttaaatcccct

SEQ ID NO: 8378 - DNA, 400 bp, Homo sapiens
  misc_feature 2, 4, 169: n = A,T,C or G
cncncttcgcaggtcgacactagtggatccaaagaattcggcacgagcacatatgatagtgttataaatactgtaaaagcatggaaggtgcaaaactcagtatttctacaattgcagctaagaacattaggatgaatggctggctgcttctaggaatataagatgcctnaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttaagatattacccgtaaatactcaggattgggagc

SEQ ID NO: 8379 - DNA, 262 bp, Homo sapiens
  misc_feature 91, 196, 218, 238: n = A,T,C or G
gaacaaaaagctggagctcgcgcgcctgcaggtcgacactagtggatccaaagaattcggcacgagctcgtgccgaattcggcacgaggtnatctccaacgacaaaaggagcttttgccactgactcggccgtgtcctgacacctccagaacgcaggtgctggcgcccgttctgcctgggacccccgggaaccctntcctgccggaagccggacggcnagggatgggcccccaacttnggccctgcccacttggatttcacc

SEQ ID NO: 8380 - DNA, 191 bp, Homo sapiens
  misc_feature 13, 23, 28, 31, 38, 134, 155: n = A,T,C or G
gaccatttgctgnggctgtgtgnccttnagntgggacnctagtggatccaaagaattcggcacgaggaatatccttgccgaacaactacaagcagagactgagctctttgctgaagccgaagagatgagggcantgacttgctgctataaaagcnggcaattagaagagattctacatgacttggagtcta

SEQ ID NO: 8381 - DNA, 398 bp, Homo sapiens
  misc_feature 307: n = A,T,C or G
gaaaataagctggagctcgcgcgcctgcaggtcgacactagtggatccaaagaattcggcacgagctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggnggaaatgcctccgctgaaggccccgagggcgaaggtaccgaaagcacagtaatcactggtgtcgatattgtcatgaaccatcacctgcagg

SEQ ID NO: 8382 - DNA, 274 bp, Homo sapiens
aggaacaataagctggagctcgcgcgccttgcaggtcgacactagtggatccaaagaattcggcacgagtgtcaccggggcaactgcctgggggcgggggatgggggcagggtggaagcggctccccattttataccaaaggtgctacatctatgtgatgggtggggtggggagggaatcacctggtgctatagaaattgagatgcccccccaggccagcaaatgttcctttttgttcaaagtctatttttattccttgatatttttctttttt

SEQ ID NO: 8383 - DNA, 400 bp, Homo sapiens
  misc_feature 15, 22, 34: n = A,T,C or G
gaaccataatgctgnagctcgngcgcctgcaggncgacactagtggatccaaagaattcggcacgagtaaatctggtgttcacattacacaacaaaatgattgtacttcaagaaggaaagaaacagcaactcacgtggggcatggttttttagaactgatcaattttctgggttcttctcctggaggtgtgcaaagtccagagaagccagtgctggacaaggaaaagaagccacaagattagacttggctcacagcccacaaaataaactacttagaactacctttacttctcctcttttgggaatttggaaaaaatctcagttcttccacaaacccaatggaagccagctactgcagaaggggttcaggcagacctttccttaatgtccatgttgaaca

SEQ ID NO: 8384 - DNA, 398 bp, Homo sapiens
gaacaataagctggagctcgcgcgcctgcaggtcgacactagtggatccaaagaattcggcacgagggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaa

SEQ ID NO: 8385 - DNA, 400 bp, Homo sapiens
gaaaaaagctggagctcgcgcgcctgcaggtcgacactagtggatccaaagaattcggcacgaggccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctg

SEQ ID NO: 8386 - DNA, 394 bp, Homo sapiens
gacaaaagctggagctcgcgcgcctgcaggtcgacactagtggatccaaagaattcggcacgagaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattcagtaattcagaaaaactcaagatttaagttaaaaagtggtttggacttggggaacaggactttatacctcttttactgtaacaagtactcattaaaggaaattgaatg

SEQ ID NO: 8387 - DNA, 400 bp, Homo sapiens
gacaaaagctggagctcgcgcgcctgcaggtcgacactagtggatccaaagaattcggcacgaggttccctgtgtataataagaaagatagtaggctaaatgatttggttgagcataataaattttggttatgtctacctttttgttaagtaggtcaggaattttcattctttttaacaggcattttacttatataataacatgattcttccaacaacctttagaggaatcaggaggtgtgggttaaataatttatccgagctactaaatggcagagctgagattcaaaaccagtcttataaagttcatatgactaccacttttggccatatcttagctaggactactaatattttggtttttggttttggttttgagacagagtctcactccagcctgg

SEQ ID NO: 8388 - DNA, 400 bp, Homo sapiens
gaacaataagctggagctcgcgcgcctgcaggtcgacactagtggatccaaagaattcggcacgagctcgtgccgaattcggcacgaggtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcaccttggaaaacaacccagctctggagaaactgctgcctcatatccgggggaatg

SEQ ID NO: 8389 - DNA, 100 bp, Homo sapiens
  misc_feature 29: n = A,T,C or G
agtgagtcgtattacaattcactggccgntagtggatccaaagaattcggcacgagagcactacaactgcgagcactccaagatcaacttccgcgacaag

SEQ ID NO: 8390 - DNA, 400 bp, Homo sapiens
  misc_feature 25, 33: n = A,T,C or G
gaacaataatgctggagctcgtgcncctgaggncgacactagtggatccaaagaattcggcacgagccacactcaagtccctcaacaaccagattgagagcatccgcagccccgagggctcccgcaagaaccctgctcgcacctgcagagacctgaaactctgccaccctgagtggaagagtggagactacttggattgaccccaaccaaggctgcaccttggacgccatgaaggttttctgcaacatggagactggcgagacttgcgtctaccccaatccagcaaacattcccaagaagaactggtggagcagcaagagcaaggagaagaaacacatctggtttggagaaaccatcaatggtggcttccatttcagctatggagatgacaatctggctc

SEQ ID NO: 8391 - DNA, 400 bp, Homo sapiens
  misc_feature 7, 8: n = A,T,C or G
acatttnntgggcgctagtggatccaaagaattcggcacgagaaaaggttgattacatttcttgcctgtctgtacattctttgtataaacgtgaagaaaaataaaaatatagattttccagcactgggactatgaaatttgagatttaacatttattcattagtcagatttaaaggaatttaccttaagtcatagtttatattgtttttggaggacctgagtaaggattctattaaaaatgattaattttgtcattatttgaaatattgataggattttaatatgttccttttttgaaaatactaaaattataaattaacttacacttaatagcaaatagttcgtaagtatgtccgtaatcaacttattgactaaaaattttgtaaaagatgccatttat

SEQ ID NO: 8392 - DNA, 294 bp, Homo sapiens
  misc_feature 5, 6, 240: n = A,T,C or G
aatannctggagctcgcgcgcctgcaggtcgacactagtggatccaaagaattcggcacgagcttctttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgnggctctcttgtggtgctatctgttttaaggtctccttgaaggcgcactggggtc

SEQ ID NO: 8393 - DNA, 400 bp, Homo sapiens
  misc_feature 5, 6: n = A,T,C or G
aatannctggagctcgcgcgcctgcaggtcgacactagtggatccaaagaattcggcacgagaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcag

SEQ ID NO: 8394 - DNA, 400 bp, Homo sapiens
  misc_feature 244: n = A,T,C or G
gaaaataagctggagctcgcgcgcctgcaggtcgacactagtggatccaaagaattcggcacgagaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgncttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgt

SEQ ID NO: 8395 - DNA, 173 bp, Homo sapiens
gacaataagctggagctcgcgcgcctgcggtcgacactagtggatccaaagaattcggcacgagtctttatattctgtataaaaacaaaagcaaatttatatactaaaatcatttgtctaaaaatttaagttgttttcaaataaaaattaaaatgcatttctgatatgcactg

SEQ ID NO: 8396 - DNA, 280 bp, Homo sapiens
gaaaataagctggagctcgcgcgcctgcaggtcgacactagtggatccaaagaattcggcacgagatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcct

SEQ ID NO: 8397 - DNA, 398 bp, Homo sapiens
  misc_feature 12, 29, 31, 44, 225, 312, 380: n = A,T,C or G
aaccataatatntgaaggtctgtgtgacncnctgaggtgggacnctagtggatccaaagaattcggcacgaggctgcgtgtggccagctcttctctgggcatggggccgcagcacgccatgcagacggctgagcggctctacacgcaaggctacatcagctacccacggacagagaccacccactaccctgagaactttgacctgaagggctctctgcggcaganggccaacccacccctactgggccgacacggtgaagcggttgttagcagaaggtatcaaccgcccgcggaaaggccatgacgccgggngaccattcccccccatcacccccatgaagtctgccacagaggccgaattaggggggtgaccgcgtggngggcttttatgagtacat

SEQ ID NO: 8398 - DNA, 334 bp, Homo sapiens
acaaaagctggagctcgcgcgcctgcaggtcgacactagtggatccaaagaattcggcacgaggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgc

SEQ ID NO: 8399 - DNA, 400 bp, Homo sapiens
  misc_feature 344: n = A,T,C or G
gaaaaagctggagctcgcgcgcctgcaggtcgacactagtggatcaaagaattcggcacgagagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggnggacatggtgaatgacggcgtggaggacctccgctgcaaatacgtctccctcatct

SEQ ID NO: 8400 - DNA, 372 bp, Homo sapiens
  misc_feature 3, 12, 300, 354, 364: n = A,T,C or G
aangaaaataanctggagctcgcgcgcctgcaggtcgacactagtggatccaaagaattcggcacgagtcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcnggaggcccttgcgcagccttgcagcagctacagcacttaagagaagcccctganaaaaaccctnttggaaaa

SEQ ID NO: 8401 - DNA, 400 bp, Homo sapiens
gaacaataagctggagctcgcgcgcctgcaggtcgacactagtggatccaaagaattcggcacgagttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattat

SEQ ID NO: 8402 - DNA, 400 bp, Homo sapiens
  misc_feature 3: n = A,T,C or G
ganaataagctggagctcgcgcgcctgcaggtcgacactagtggatccaaagaattcggcacgagcggcacgaggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacttggagtgccaaggctaaaagacgaaataccaccggaactggtcgaatgaggcaccttaaaaattgtataccgcagattcaggcatggattccgtgaaggaacaacacctaaacccaagagggcagcttgttgcagcattccagttcatcttaagaatgtcaacgatt

SEQ ID NO: 8403 - DNA, 380 bp, Homo sapiens
  misc_feature 14, 25, 33, 35, 42, 324: n = A,T,C or G
aaccataatgctgnagcctgtgtgncccttgangntgggacnctagtggatccaaagaattcggcacgagtttgcctagattttctcctgttttgttctaaaaattagacaatttggttttacatttaagtctatgatccattttcaatttttgtataaggtataaggtttaggttgattattgtatatttttagcctatgatgtccaatagctccagcgccctttgttcaaaggctgtctttcctccaacacattgtttctgtacccttgtcaaaaatcaattgtgtgtaatcccagcattttgggaggctgaggcgggagcnttgcttgagcccaggagtttgaggccagcctggcaacataatgaaaccctgtctct

SEQ ID NO: 8404 - DNA, 400 bp, Homo sapiens
  misc_feature 3: n = A,T,C or G
ganaataagctggagctcgcgcgcctgcaggtcgacactagtggatccaaagaattcggcacgagctccctcctaggtgttcccctcaggggaagtaggcagggtcaccgggcaagcagcgcacgctgtgggcagacactgtcccaagtcttagcctgcgtgaactcactggcgccacaaccccatcgcggttttgtgatcacccctattctacaggaaactaagacacagagaggacaagtcacttgaccaaagtcactgagctggctgggcgcaatggctcacgcctgtaattccagcactttgggaggccgaggcgggtggatcacctgaggtcaggagttcgagaccagcctgaccaacatggtgaaaccccgtctctactaataatacaaaatta

SEQ ID NO: 8405 - DNA, 400 bp, Homo sapiens
gacaataagctggagctcgcgcgcctgcaggtcgacactagtggatccaaagaattcggcacgaggccaagggagagatcccagttgggagacagaccagagccagaaagcagtgtgggatttttaagccacagatttaatttcctgatgatatttttttcaggctgatattagcagcatttttcattccccaagcagatctgccaatcgtgaaaaagtgatccagagtgagctgggtgatgggccagtttgaacctgaacagacccatcaggatagcccaaagtcaaggcaatatgtcctctctttttctaaccactagagactaaggacaaattttgcttctggctggtcttggaggagagagaaagaacagtttctaggcagctctggtgaataaat

SEQ ID NO: 8406 - DNA, 278 bp, Homo sapiens
  misc_feature 2: n = A,T,C or G
gnaaaagctggagctcgcgcgcctgcaggtcgacactagtggatccaaagaattcggcacgagcgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttcta

SEQ ID NO: 8407 - DNA, 211 bp, Homo sapiens
  misc_feature 1, 26, 31, 71, 193: n = A,T,C or G
ncctatagtgagtcgtattacaattnctggncgctagtggatccaaagaattcggcacgagagcacaagcnattcttgtgcctcagcctccagaatagctgggattacaggtgggtgccaccacgccgagctaatttgtgtgcgtgtgtgtgtgtgtgtgtgtgtgtgtgtatatatatatatatatatattnttttttccccccttctct

SEQ ID NO: 8408 - DNA, 400 bp, Homo sapiens
gaacaataagctggagctcgcgcgcctgcaggtcgacactagtggatccaaagaattcggcacgagataaaatatttttcacttttttttactccccatatcttagtcttgttcagtaagagagagggaaatggtaactggctgatttacatagtccttgattttagttcacctcttaggctggcactattatttggacaatggattctagttgtttactgaaagagatatgatgccacaggccctgtttgcagctccaaagtacccacactgaaccttgaaatgcacctcagacctccttgactatgatagccatatcgaaccactttttcagcttcctgatcgaggttaaactgatcagcaatttaaagttttggtgctgggcaactggcctgagtga

SEQ ID NO: 8409 - DNA, 152 bp, Homo sapiens
gaaaaagctggagctcgcgcgcctgcaggtcgacactagtggatccaaagaattcggcacgagccgttctgtacctggacctagcacccagcacctttctctgagctgagtggctggagtggtcaataaagccacatgtgcctgtggcccag

SEQ ID NO: 8410 - DNA, 400 bp, Homo sapiens
  misc_feature 3: n = A,T,C or G
ganaaaagctggagctcgcgcgcctgcaggtcgacactagtggatccaaagaattcggcacgaggcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccgga

SEQ ID NO: 8411 - DNA, 400 bp, Homo sapiens
gacaataagctggagctcgcgcgcctgcaggtcgacactagtggatccaaagaattcggcacgagaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattg

SEQ ID NO: 8412 - DNA, 400 bp, Homo sapiens
  misc_feature 3: n = A,T,C or G
ganaataagctggagctcgcgcgcctgcaggtcgacactagtggatccaaagaattcggcacgagccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcggggttcgaccacttggccgatgggaatggtctgtcacagtctgctccttttttttgtccgccacacgtaactgagatgc

SEQ ID NO: 8413 - DNA, 268 bp, Homo sapiens
gacaaaagctggagctcgcgcgcctgcaggtcgacactagtggatccaaagaattcggcacgagtcctgtttctacgtttctgtattttcctattgaagatgagaggcagctgcacttcttccccctgcttaaggactacggaatagatgtaagagaatttaacaatcattaaacattgaaaaatatatcagtgaagaaggtcttaaagtcattttttttagagtcctttaaaattaaaatctattttcatgtgtccaagatggttta

SEQ ID NO: 8414 - DNA, 400 bp, Homo sapiens
aataagctggagctcgcgcgccctgcaggtcgacactagtggatccaaagaattcggcacgagccggtgtggctctgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaat

SEQ ID NO: 8415 - DNA, 103 bp, Homo sapiens
  misc_feature 4, 14, 28, 76, 98: n = A,T,C or G
gctngcgcgcctgnaggtcgacactagnggatccaaagaattcggcacgagctcgtgccgaattcggcacgagctntcaaatgtcatttttgagtggnccaag

SEQ ID NO: 8416 - DNA, 400 bp, Homo sapiens
  misc_feature 280, 289, 307, 355: n = A,T,C or G
aaataagctggagctcgcgcgcctgcaggtcgaactagtggatccaaagaattcggcacgagagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgnggtgggatntgctcctgggttccctangccctagtgagggcagaagagaaaccatcctctcccttcttacaccgngaggccaagatcccctcagaaggcaggagtgctgccctctcccat

SEQ ID NO: 8417 - DNA, 345 bp, Homo sapiens
  misc_feature 1, 20, 80, 106, 108, 142, 179, 216, 231, 266, 274, 334: n = A,T,C or G
ngctttccgaaccaaaaggngacctcacgaaatgcccctttgagctcaaaggctagttacccccaggggcccttccactntcggggacaggcgaaacctctttgtntntgcctcggcctgcggcccccagcccagcctccgngctttccctccgccagtccttgtcaatcaaacctggngccaaacgcggcagctgaagttttcagggacacattngcttctccccttgangaaccagttacaaagcgggatgtcctctctggggncccatcanaacaaagaaacaggtctaaagaccctcattccagagagcatcctgccccatatccagaangaaatccatgc

SEQ ID NO: 8418 - DNA, 308 bp, Homo sapiens
  misc_feature 290, 305, 307: n = A,T,C or G
aataagctggagctcgcgcgcctgcggtcgacactagtggatccaaagaattcggcacgagcttttcctagctttgccaggagatgtagttacctaaaagagaagagataaaactactttttaatttcactttaccttcctattagtgtactgtattagaaataaaattagacaaaggaaaatcccctcaaaacaaaaaaactcgagagtacttctagagcggccgcgggcccatcgattttccacccgggtggggtaccagggtaagtgtacccaattcgccctatagngagtcgattacaatncng

SEQ ID NO: 8419 - DNA, 400 bp, Homo sapiens
  misc_feature 8, 27, 31, 40, 73, 99, 142, 156, 225, 251, 256, 284, 289,301, 338, 365, 374: n = A,T,C or G
caaaaagntggagctcgcgcgcctgcnggtngacactagnggatccaaagaattcggcacgagccacaatggngcgcatgaatgtcctggcagatgctntcaagagtatcaacaatgccgaaaagagaggcaaacgccaggngcttattaggccgngctccaaagtcatcgtccggtttctcactgtgatgatgaagcatggttacattggcgaatttgaaatcnttgatgaccacagagctgggaaaatngttgngaacctcacaggcaggctaaacaagtgnggggngatcagccccanatttgacgtgcaactcaaagacctggaaaaatggcanaataatctgcttccatcccgccagttnggtttcatngtactgacaacctcagctggcatcat

SEQ ID NO: 8420 - DNA, 400 bp, Homo sapiens
aaaagctggagctcgcgcgcctgcaggtcgacactagtggatcaaagaattcggcacgagcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcct

SEQ ID NO: 8421 - DNA, 376 bp, Homo sapiens
  misc_feature 8, 19, 32, 36, 73, 91, 108, 236, 257, 259, 343, 362: n = A,T,C or G
aaactggngctcgcgcgcntgcaggtcgacantagnggatccaaagaaattcggcacgaggtttgacagaagngtgatatatgtaacttgngccatggaccaaatggncactttaccacagctaaaaatgagttacgatagcagcttgatggggattgtattgtattcctttaatcaaaaaggaaacacaatattctaagtatctttagcccaaataccatgacatattgagcatntttaaataaccagactgtatngnccttcatatgtgaagttgacactactgatttgtcaataccaaattttgggttaaagggttaaatttttatgtatttattttctngtggcctcaaaagatgatngcattctaactttt

SEQ ID NO: 8422 - DNA, 121 bp, Homo sapiens
  misc_feature 5, 18, 43, 98, 102, 106: n = A,T,C or G
aaaanaagcctggggctngcgcgccctgaaggtcgacactagnggatccaaagaaattcggcacgagctcgtgccgaattcggcacgagcaggttccntttntctnattcacaagatgctt

SEQ ID NO: 8423 - DNA, 400 bp, Homo sapiens
aaaagctggagctcgcgcgcctgcaggtcgacactagtggatccaaagaattcggcacgagctctgcttgacaagttcctgatcaagaactgcaatgatttccagtatgagagcaaggtgttttacctgaaaatgaagggtgattactaccgctacttagcagaggtcgcttctgggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccaggatgaagaagcaggagaaggcaactgaagatccttcaggtcccctggcccttccttcacccaccacccccatcatcaccga

SEQ ID NO: 8424 - DNA, 327 bp, Homo sapiens
  misc_feature 10, 12, 34, 38, 89, 103, 105, 154, 171, 196, 276, 283, 311,325: n = A,T,C or G
aaaagctggngntcgcgcgcctgcgggtcgacantagnggatccaaagaattcggcacgagattccagacagcattggaaaagacatanaaaaggcttgccantntatttatcctctccatgatgtcttcgttagaaaagtaaaaatgctgaanaagcccaagtttgaatngggaaagctcatggagcttcatggngaaggcagtagttctggaaaagccactggggacgagacaggtgctaaagttgaacgagctgatggatatgaaccaccagnccaagantctgtttaaagttcagacttcaaatagnggcaaataaaaagngc

SEQ ID NO: 8425 - DNA, 400 bp, Homo sapiens
  misc_feature 21, 38, 67, 88, 97, 104, 186, 203, 217, 238, 245, 253, 308,350: n = A,T,C or G
aaaagctggagctcgcgcgcntgcaggtcgacactagnggatccaaagaattcggcacgagctcatntacatcccacttcctgatganaagtcccgngttgccntcctcaaggctaacctgcgcaagtccccagttgccaaggatgtggacttggagttcctggctaaaatgactaatggcttctntggagctgacctgacanagatttgccagcgngcttgcaagctggccatccgngaatccntcgagagngagattaggcgagaacgagagaggcagacaaacccatcagccatggaggtagaanaggatgatccagtgcctgagatccgtcgagatcactttgaanaagccatgcgctttgcgcgccgttctgtcagtgacaatgacattcggaag

SEQ ID NO: 8426 - DNA, 100 bp, Homo sapiens
  misc_feature 4, 5, 91: n = A,T,C or G
cgtnnagtggatccaaagaattcggcacgaggccagtatgctgggggaggagaaataccgccaggacctgactgtgcctccaggctactgncagtacttc

SEQ ID NO: 8427 - DNA, 247 bp, Homo sapiens
  misc_feature 63: n = A,T,C or G
aataagctggagctcgcgcgcctgcggtcgacactagtggatccaaagaattcggcacgaggngctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgat

SEQ ID NO: 8428 - DNA, 143 bp, Homo sapiens
  misc_feature 6, 20, 46, 60, 112: n = A,T,C or G
ccttgnagtgggacactagnggatccaaagaaattcggcacgagtntatgtaacataagngaattctgggtttagtcttgggctccatccccaaggggtctcattatgtatntgtaaacattccagaaataaaaaaaaatatc

SEQ ID NO: 8429 - DNA, 130 bp, Homo sapiens
  misc_feature 35, 39, 77, 122: n = A,T,C or G
aaaagctggagctcgcgcgccctgcgggtcgacantagnggatccaaagaattcggcacgagtaggagcagactgtntaccaggaacacaatgagtactttatggccacctcgagtagtaanaacgagga

SEQ ID NO: 8430 - DNA, 302 bp, Homo sapiens
  misc_feature 23, 26: n = A,T,C or G
aataagctggagcctcgcgcgcntgnggttcgacactagtggatccaaagaattcggcacgagtgggaggccaaggtggacagatcacgaggtcaggagttcaagactagcctggccagtatggtgaaaccctgtccttaaaaatacaaaaattagctgggtgcagtggtgcacgccttgtaatcccagctactcgggaggctgaggcaggagaatcgcttgaacccgggaagcagaggttgcagtgagctgagatcgtgccactgccctccagcctgagcgacagagtgagactccatctc

SEQ ID NO: 8431 - DNA, 400 bp, Homo sapiens
  misc_feature 12, 21, 29, 316: n = A,T,C or G
aataagctggangctcgcgcncctgcagntcgacactagtggatccaaagaattcggcacgaggtctcacagaaagttctccgctcccagacatgggtccctcggcttcctgcctcggaagcgcagaagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatggnggttgtgggcattgtgggctaccgtggaaacccctcgaggcctccggaccttcaagactgtctttgctgagcacatcagtgatg

SEQ ID NO: 8432 - DNA, 174 bp, Homo sapiens
  misc_feature 12, 58, 59, 63, 88, 90, 95, 100, 109, 110, 112, 113, 118,122, 123, 124, 128, 131, 142, 145, 150, 154, 155, 159, 161,163, 166, 168: n = A,T,C or G
ctcgcgcgcccngcggggtcgacactagtggatccaaagaattcggcacgagctcgtnnggcntatggcacaacgcctagtgtaaaancntctcnaaaanatcacctcnngnnaatangatnnntttnaancttaaccaaanatnaactntttnnttgnananctntntcatgg

SEQ ID NO: 8433 - DNA, 147 bp, Homo sapiens
  misc_feature 2, 45, 86, 128, 136: n = A,T,C or G
anttcggcacgagccggcctgaccctgtggccccgggacccagcngagctgggggagggatcagcccccaaagaaatgggggtgcntgctgggcctggccccctggcccacccccactttccagggcngaaagggnccagggttctt

SEQ ID NO: 8434 - DNA, 122 bp, Homo sapiens
  misc_feature 51, 122: n = A,T,C or G
aataagctggagctcgcgcgcctgcaggtccgacactagtggatccaaagnaattcggcacgagcttaaatatatggaaaaatgaaataagggtgaagctgaataaagttctacttactgtn

SEQ ID NO: 8435 - DNA, 199 bp, Homo sapiens
  misc_feature 9, 17, 45, 169, 178, 183: n = A,T,C or G
ctggggctngcgcgccncgcaggtcgacactagtggatccaaagnaattcggcacgagctgtcattctacagggctctaatgatgttgaacttgttgctgagggcaacagcaggttcacttacactgttcttgtagatggctgctctaaaaagacaaatgaatgggggnaagacaatnattgnatacaaaacaaataag

SEQ ID NO: 8436 - DNA, 100 bp, Homo sapiens
  misc_feature 7, 20, 28, 29, 51, 53, 58, 61, 64, 79, 84, 98: n = A,T,C or G
acatttntctgggggctggnggaccctnnggggcgacactagtggatccananaattnggnacnagcttttttctcatnctagnatgacaaatggagnga

SEQ ID NO: 8437 - DNA, 152 bp, Homo sapiens
  misc_feature 4, 14, 49, 122: n = A,T,C or G
cggncaaggtgaangagtcctggggtcgccactgggccgccgccccccncccgttgttacccggtattgtaagaacaagccgtacccaaagtctcgctttctgcccgaggtgtcccttgatnccaagattcgattttttgacctggggcggg

SEQ ID NO: 8438 - DNA, 326 bp, Homo sapiens
  misc_feature 4, 6, 268: n = A,T,C or G
cggncnagaacctgggccgggttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaaggaggagacaattatgtncctgagggctcagccttggatcaggaggattattggaagtagatcctgacacttaagg

SEQ ID NO: 8439 - DNA, 160 bp, Homo sapiens
  misc_feature 16, 31, 33, 34, 36, 38, 39, 40, 45, 144, 146: n = A,T,C or G
gggtttgggggggggnacccgggtttgggcngnntntnnncgccngcggtcgacactagtggatccaaagaattcggcacgagctcgtgccgaattcggacgaaaaatggtcattgatgtccttcaccccgggaaggcgacagngnctaagacagaaatt

SEQ ID NO: 8440 - DNA, 373 bp, Homo sapiens
  misc_feature 65, 334: n = A,T,C or G
tggagctcgcgcgcctgcaggtcgacacttgtggatccaaagaattcggcacgaggtggattctngccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccatagacctgataaattatatagacgttgcccagcaagatggaaagttgccttttgttcctccggaggaagaatttattatgggaggtttccaagtatggnataaaagtatcaacatcagatcaatatgatgttttgcac

SEQ ID NO: 8441 - DNA, 100 bp, Homo sapiens
  misc_feature 29, 40, 75, 76, 96: n = A,T,C or G
acactagtggatccaaagaattcggcacnagggctgaccnttttttgtggtgtactccgtgccatcatgtccgtnnctgacgccgctgctgctgcngggg

SEQ ID NO: 8442 - DNA, 340 bp, Homo sapiens
  misc_feature 3, 25, 213, 214, 221, 224, 226, 227, 228, 235, 238, 245,251, 259, 262, 266, 268, 279, 289, 292, 303, 306, 310, 312,318, 326, 333: n = A,T,C or G
ctntgtagagttagagaatattgcnctgagacataaagtatagcgatgattgatgataacattaaatgtttctaccgcaattttactacgcatttaacgtacattatctcatttagtcttcacatcctccaatgttaccattcccactcatatttccctgaagaggcaactaaagtttaaagagattaaggtgaattacttgaagtcaagggnnccccccnggntnnnttccccnttngagggcntttttncacccccnttngagnanaaatttttttncccccccggnggngatttggcccnaanttcntnaaaagngcccccgngggagtnacccggg

SEQ ID NO: 8443 - DNA, 236 bp, Homo sapiens
  misc_feature 2, 4, 41, 96, 125, 190, 223: n = A,T,C or G
ancnaaagctggagctcgcgcgcctgcaggtcgacactagnggatccaaagaattcggcacgagttatgagctaccgggtaaatgaattacatgcnctttgaagtaaataggttttctattgggngtcaacaacgctgatttctcccaaaactatagtttctcttacggtcttttcctcctttaccctgnggatatacactcaggaataatctgacattttanaaaagccgaacag

SEQ ID NO: 8444 - DNA, 400 bp, Homo sapiens
aataagctggagctcgcgcgcctgcaggtcgacactagtggatccaaagaattcggcacgagcaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagc

SEQ ID NO: 8445 - DNA, 388 bp, Homo sapiens
  misc_feature 13, 26, 212, 293, 302, 306, 328, 349, 352, 357, 387: n = A,T,C or G
cgcctgagggtcncacttgtggatcnaagaattcggacgagggaagctggagcgcatcgcgcgcctggaggacaaggtgaagacgctcaaggccgagaacgcggggctgtcgagtaccgccggcctcctccgggagcaggtggcccagctcaaacagaaggtcattgacccacgtcagcaacggctgtcaagctgctgcttggggtcaaggnacacgccttctgaacgtccccttgcccttttacggacaccccctcgcttggacggctgggcacacgccttaggggcgccgnaaaccaaantggnactccgggccttcctaccctgngcccaagtcctttccaccttnaangtttncaaagcccccccctttccactttttttttng

SEQ ID NO: 8446 - DNA, 398 bp, Homo sapiens
  misc_feature 1, 2, 28, 53, 388: n = A,T,C or G
nnaaaaaagctggagctcgcgcgcctgnaggtcgacactagtggatccaaagnaattcggcacgaggcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccaggttcgaatgcctaccaagactttgagaatcactacaagaaaaactccttgtggngaaggttcta

SEQ ID NO: 8447 - DNA, 125 bp, Homo sapiens
  misc_feature 3, 5, 38, 41, 58, 73, 95: n = A,T,C or G
ggngngggggggtttggggggggaaacccgggtttggnggngtggaacgcctgcggtngacactagtggatcnaaagaattcggcacgagctcgngcccaattcggcacgagcagaaattctaca

SEQ ID NO: 8448 - DNA, 400 bp, Homo sapiens
  misc_feature 10, 21, 29, 38, 76, 151, 288, 290, 303, 331, 350, 379, 395,396: n = A,T,C or G
aaaagctggngctcgcgcgcntgcaggtngacactagnggatccaaagaattcggcacgagcgacatttacatttntacatgtagtaacagtctactttgatatatgagtatttaaactaaggcattaagagatattagatatttcttaangttttcatagggctcaataggggtagtagcaatgatattacctctgaaaccaaatactcttttatccttgattccactatgggaccttataactagtccatgaaaccaagctcagaaaagctttaactcttatattngngtatatgtatgcngcttctgaaaatataatttttctaagtngtgggaatgactttaattngtaatcagctaaggcttaagatttcattngtttctaagtttctgnntttc

SEQ ID NO: 8449 - DNA, 181 bp, Homo sapiens
  misc_feature 11, 39, 41, 59, 64, 65, 66, 68, 137, 144: n = A,T,C or G
ctggagctcgngcgccctgcaggtcgacactagtggatntnaagaattcggcacgaggngaagnnncngacgccacccagccctggggggaggcccacgcctgctggaccaacgcgggttctggggtgcacaagccnccaggtntaacgctgaaaccctgcccccgcttgagcccaggagc

SEQ ID NO: 8450 - DNA, 127 bp, Homo sapiens
  misc_feature 12, 24, 27, 29, 50: n = A,T,C or G
ctttgtgagtcnaagaacttcggncgngnctggctgacgcctttagtgcncagaccccaaggccatcggccatcggaactaccatgcaggctactccatgtttggggctggcctcaccgtaggcctg

SEQ ID NO: 8451 - DNA, 312 bp, Homo sapiens
  misc_feature 3, 14, 28, 74, 173, 179, 254, 259, 277, 285, 295, 311: n = A,T,C or G
tcnaagaattcggncgagctcgtgccgngttgatatggttcctggcaagcccatgtgtgttgagagcttctcanactatccacctttgggtcgctttgctgttcgtgatatgagacagacagttgcggtgggtgtcaatcaaagcagtggacaagaaggctgcctggagctgncaaggncaccaagtctgcccagaaagctcagaaggctaaatgaatattatccctaatacctgccaccccactcttaatcanggggnggaagaacggtctcaganctgtttgnttcaattggncatttaagtttagtang

SEQ ID NO: 8452 - DNA, 111 bp, Homo sapiens
  misc_feature 5, 15, 96: n = A,T,C or G
gtgcncttgaagtgngacactagtggatccaaagaattcggcacgagcgagaacgacccccggaccgaccaaagcccgcgcgccgttgcttcccgngtccagcacctacgt

SEQ ID NO: 8453 - DNA, 162 bp, Homo sapiens
  misc_feature 27, 28, 32, 33, 49, 54, 71, 92, 98, 111, 132, 144, 160: n = A,T,C or G
ttttgggggggggaaacccggttttgnntggnntgcggaacgccctgcnggggngacactagtgggatttnaaagaattcggcacgagagangcccancattacctgcagngtctgcgctaccaggaagccnctgatttgtttngaaatgcacacttggncg

SEQ ID NO: 8454 - DNA, 131 bp, Homo sapiens
  misc_feature 4, 16, 111: n = A,T,C or G
gtcnaagaacttcggncgggggaaaggccccacttaaaagcagcagtctgataaaagtttgtaattcgtgtttaagaagacagagtagcaagtgttatcagtgagcctggncagaaaaccacactggaagg

SEQ ID NO: 8455 - DNA, 110 bp, Homo sapiens
  misc_feature 3, 5, 43, 94, 99: n = A,T,C or G
aancnaaagcctggagctcgcgcgcctgcaggtcgacactagnggatccaaagaattcggcacgagcggcacgaggcctgaaatcatatttcanagttngcttttttttt

SEQ ID NO: 8456 - DNA, 400 bp, Homo sapiens
  misc_feature 5: n = A,T,C or G
aaccnaagctggagctcgcgcgcctgcaggtcgacactagtggatccaaagaattcggcacgaggaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtcccgcacagtcgaagccacacctggtctgttttctgtgcactgtagccttagtgtcacct

SEQ ID NO: 8457 - DNA, 400 bp, Homo sapiens
  misc_feature 4, 7, 53, 310, 384: n = A,T,C or G
accnaantctggagctcgcgcgcctgcaggtcgacactagtggatccaaaganttcggcacgaggcgactccgccgcgatggtgacccggttcctgggcccacgctaccgggagctggtcaagaactgggtcccgacggcctacacatggggcgctgtgggcgccgtggggcttggtgtgggccaccgattggcggctgatcctggactgggtaccttacatcaatggcaagtttaagaaggataattaattacacaaacccttcacagactgctctggtgcctgggtggcgctagcttcctcccacctnagcacctgctgcatctggagcagcccaagcctcaggatggacaagaggaaacccacagctcagcttcaggcttnttatgtttctgaaaac

SEQ ID NO: 8458 - DNA, 218 bp, Homo sapiens
  misc_feature 20, 23, 28, 37, 73, 79: n = A,T,C or G
aaactggaagctcgcgcgcntgnaggtngacactagnggatccaaaaaattcggcacgagcgcaacctggganagctgngccagcgcctcgtacgcaacggggagtactaccagagcaactatgtgttcgtgttcctgggcctcatcctgtactggggggggacgtcccctatgttgctgggggctctggctgtctttttcggcgcctgttacattct

SEQ ID NO: 8459 - DNA, 341 bp, Homo sapiens
  misc_feature 14, 23, 36, 40, 71, 83, 96, 113, 140, 150, 164, 218, 238,244, 255, 288, 316: n = A,T,C or G
aaagcctggaagcntcgcgcgcntgcaggtcgacantagnggatccaaaaaattcggcacgagcaggccanatgggaattcgnggccttccgggcnttaaggggccccctggngctcttggtttgaggggacctaaaggngacttggganaaaagggggagcgnggccctccaggaagaggtcccaacggtttgcctggagctataggtctcccaggngacccaggccctgccagctntggcanaaatggccganacggtgagcgaggcccccccagggggggcaggnatttcttggagtgcttgaccccccggancctctgggctttccgggtttttgga

SEQ ID NO: 8460 - DNA, 189 bp, Homo sapiens
  misc_feature 20, 22, 32, 176: n = A,T,C or G
tggtgatccaagaattcggncnaggaaaactntgatcaaacatatttgttatgctcttctcttgttaacctgtcattgttatataggtgtcacgccatgactgttaggatgggaaggaaaggaattaatccctaaccagcttctacactgtgctttaagaaactatataataaggngtaaccaggaaat

SEQ ID NO: 8461 - DNA, 133 bp, Homo sapiens
  misc_feature 13, 66, 92: n = A,T,C or G
cgagtgcccaccnaaccctctaaatccccttgtaaatttaactgtgagtccaaagaggaacagctntttggacactaggaaaaaaccttgtngagagagtaaaaaatttaacacccatagtaggcctaaaagc

SEQ ID NO: 8462 - DNA, 190 bp, Homo sapiens
  misc_feature 4, 14, 126: n = A,T,C or G
gccntgttggccanggctggtctcgaactcctgacctcaagtgatcccctcccccccacctcgacctcccaaagtgctgagattaccacgcccggccttgtccattccattttgtagtcccatgtncagctcaggtcttagcacgcagtaggagctttcatctaacgcagagcctggagtttaagtagtg

SEQ ID NO: 8463 - DNA, 131 bp, Homo sapiens
  misc_feature 4, 6: n = A,T,C or G
aggngnggaccggactgggcgaggcggccttgagtctcagtacgagtgtgcgtgagtgtgagccaccttggcaagtgcctgtgcagggcccggccgccctccatctgggccgggtgactgggcgccggctg

SEQ ID NO: 8464 - DNA, 126 bp, Homo sapiens
  misc_feature 3, 9, 41, 42, 44, 49, 61, 68, 70, 73, 84, 97, 101: n = A,T,C or G
tcnaagaanttcggacagctcgtgccgaattcggcacgagnnanccganatcttccagganttctgcnanaangacgaacacanagggaaagagganaggnacccgatatatgttctctaggcctt

SEQ ID NO: 8465 - DNA, 400 bp, Homo sapiens
  misc_feature 4, 19, 30, 58, 59, 61, 209, 277, 344: n = A,T,C or G
tggngctcgcgcgcctgcnggtcgacactngtggatccaagaattcggcacgagcccnngnactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgngagtcaaatgccccctgagtgactgcccccagcccaggccagaagacctcccttcaggtgccgggcngcaggaactgtgtgtgtcctacacaatggtgctattctgtgtcaaacacctctgta

SEQ ID NO: 8466 - DNA, 319 bp, Homo sapiens
  misc_feature 248, 299: n = A,T,C or G
ctggagcctcgcgcgcctgcaggtcgacactagtggatccaaagaattcggcacgaggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgngaaagttggagataaagttcttctcccagaatatggaggcaccaaagtagntctagatgacaaggattatt

SEQ ID NO: 8467 - DNA, 400 bp, Homo sapiens
  misc_feature 3, 22, 39, 77, 183, 260, 264, 286, 360: n = A,T,C or G
aanaagctggagctcgcgcgcntgcaggtcgacactagnggatccaaagaattcggcacgaggctgctgtagcgaanagagtttggcgcgatgtctcacaccattttgctggtacagcctaccaagaggccagaaggcagaacttatgctgactacgaatctgtgaatgaatgcatggaaggngtttgtaaaatgtatgaagaacatctgaaaagaatgaatcccaacagtccctctatcacatatgacatcagtcagtngttngatttcatcgatgatctggcanacctcagctgcctggtttaccgagctgatacccagacataccagccttataacaaagactggattaaagagaanatctacgtgctccttcgtcggcaggcccaacaggctggga

SEQ ID NO: 8468 - DNA, 256 bp, Homo sapiens
  misc_feature 14, 23, 27, 36, 94, 102, 187, 215: n = A,T,C or G
aaactggagctcgngcgcttgangttngacactagnggatccaaagaaattcggcacgaggcagcaggctcaagtagagaaggaggacttcagngacatggnggctgagcacgctgccaaacagaagcaaaaaaaacggaaagctcagccccaggacagccgggggggcaggcaagaaatataaggngttcaagttttaggtcccctcacactanccctttttttggccctacgtctggatgcctgggcttcacac

SEQ ID NO: 8469 - DNA, 161 bp, Homo sapiens
  misc_feature 156, 158, 159, 160: n = A,T,C or G
gctggagctcgcgcgcctgcaggtcgacactagtggatccaaagaattcggcacgaggtagaggatactatttccagaatagtgtttagctcacctagggggatatgtttgtatacacatttgcatatacccacatggggacataagctattttgnannna

SEQ ID NO: 8470 - DNA, 235 bp, Homo sapiens
  misc_feature 5, 44, 191: n = A,T,C or G
atttngctggagctcgcgcgcctgcaggtcgacactagtggatncaaagaattcggcacgagaaaaacctcaccataaaaactgagagcactttgaaaacaacacagttttcttgtaccctgggagagaagtttgaagaaaccacagctgatggcagaaaaactcagactgtctgcaactttacagatggngcattggttcagcatcaggagtgggatgggaaggaaagcacaat

SEQ ID NO: 8471 - DNA, 209 bp, Homo sapiens
  misc_feature 4, 29, 57, 58: n = A,T,C or G
tgangctcgcgcgcctgcggtcgacactngtggatccaagaattcggcacgagcgcnngttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaag

SEQ ID NO: 8472 - DNA, 400 bp, Homo sapiens
  misc_feature 16, 21, 29, 38, 70, 101, 111, 118, 215, 235, 375, 391: n = A,T,C or G
aaagcctggagctcgngcgcntgcaggtngacactagnggatccaaagaattcggcacgaggccccgttntatcaggttgcagcggcagagagccatcctntataagcggntgaaagngcctcctgcgattaaccagttcacccaggccctggaccgccaaacagctactcagctgcttaagctggcccacaagtacagaccagagacaaagcangagaagaagcagagactgtnggcccgggccgagaagaaggctgctggcaaaggggacgtcccaacaaagagaccacctgtccttcgagcaggagttaacaccgtcaccaccttggggggagaacaagaaagctcagctggggggggattgcacacgacgnggatcccatcgagctnggttggctt

SEQ ID NO: 8473 - DNA, 399 bp, Homo sapiens
  misc_feature 2: n = A,T,C or G
anaagctggagctcgcgcgcctgcaggtcgacactagtggatccaaagattcggcacgagcattatcttagccccagaacacagaatgttcttggtgagaagggccggcggattcgggaactgactgctgtagttcagaagaggtttggctttccagagggcagtgtagagctttatgctgaaaaggtggccacctagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttggggatggcctgatgatccacagcgg

SEQ ID NO: 8474 - DNA, 271 bp, Homo sapiens
  misc_feature 19, 21, 27, 29, 54: n = A,T,C or G
ccatatagtggagtctgtntnaccttnangctgggacgctagtggatccaaagnaattcggcacgaggcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacag

SEQ ID NO: 8475 - DNA, 163 bp, Homo sapiens
  misc_feature 6, 14, 27, 40, 107, 129, 138: n = A,T,C or G
aataancctggtgntcgcgcgcttgcnggtcgacactagnggatccaaaaaattcggcacgagtttagccttattgcacaccaactcccaaaatataggttactctngttcaaaaggaaaaaaaaaatngggattttntttgaggggtatatgttattaatta

SEQ ID NO: 8476 - DNA, 400 bp, Homo sapiens
ataagctggagctcgcgcgcctgcaggtcgacactagtggatccaaagaattcggcacgaggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagc

SEQ ID NO: 8477 - DNA, 400 bp, Homo sapiens
  misc_feature 2, 51: n = A,T,C or G
cngaagctggagctcgcgcgcctgcaggtcgacactagtggatccaaaganttcggcacgagagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagca

SEQ ID NO: 8478 - DNA, 208 bp, Homo sapiens
  misc_feature 9, 24, 28, 37, 121, 148, 157: n = A,T,C or G
aaagctggngctcgcgcgcttgcnggtngacactagnggatccaaagaattcggcacgaggaaagctcagaaggctaaatgaatattatccctaatacctgccaccccactcttaatcagngggggaagaacggtctcagaactgttngtttcaatnggccatttaagtttagtagtaaaagactggttaatgataacaatgcatcgt

SEQ ID NO: 8479 - DNA, 178 bp, Homo sapiens
aataagctggagctcgcgcgcctgaaggtcgacactagtggatccaaagaattcggcacgagctatgctgcagagaaactatgcattaggtctcttttcaattagaaacctttactatttccaatgtatgtttgttaaaaataataataataaaaccaaaagcctttgtggaaaccca

SEQ ID NO: 8480 - DNA, 279 bp, Homo sapiens
  misc_feature 5, 24, 28, 41, 130, 148, 158, 225, 240: n = A,T,C or G
aaaanaagctggagctcgcgcgcntgcnggtcgacactagnggatccaaagaattcggcacgagggcaaactaagccgattttccggaaaaaggctaaaattacaaagaagattgtgctaaggcttgagngcgttgagcccaactgcngatctaaganaatgctggctattaaaagatgcaagcattttgaactgggaggagataagaaggagaaagggccaagngatccagttctaagngtcatcttttattatgaagacaataaaatcttgagttta

SEQ ID NO: 8481 - DNA, 310 bp, Homo sapiens
  misc_feature 3, 5, 49, 271: n = A,T,C or G
tangnctggagctcgcgcgcctgcaggtcgacactagtggatccaaagnaattcggcacgagtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgaagggccgcccggnaactgctgacgcttgatgagaaggacccacggcggtctg

SEQ ID NO: 8482 - DNA, 207 bp, Homo sapiens
  misc_feature 16, 18, 37, 46, 120, 123, 159: n = A,T,C or G
aaaaaaaaagcctggngnctcgcgcgccctgcaggtngacactagnggatccaaagaaattcggcacgagctcactgtcttaaatagaatttttaaatagtatatattcaggggcatttnggngaacaaagggaatttacttcgacttcttaaattttngtaaaagactataagtttagacatctttctcattcaaatttaaagata

SEQ ID NO: 8483 - DNA, 400 bp, Homo sapiens
  misc_feature 49: n = A,T,C or G
aaaagctggagctcgcgcgcctgcaggtcgacactagtggatccaaagnaattcggcacgagaatggatgtgggttagaaaaagacttggaagttatcatcacagaagtgataataagatgtaatggaattaacaagaaaacctaggaaaaggtatgaaatggaaaaacaagagaaacaaagtctgagtcttaaggaactcgggcatataaaagtctggtactgcaggaagagacagtaaaaatactaaaagggattcaatttctttctggttcaatcttggaagggcgtatgtgtccaggaatttatccatttcttctagatttgctagtttatgtgcatagaggtattcataatattccctgagggttgtaacagactaataatgaggtctgaaattg

SEQ ID NO: 8484 - DNA, 128 bp, Homo sapiens
  misc_feature 40, 97: n = A,T,C or G
caataagctggagctcgcgcgcctgcaggtcgacactagnggatccaaagaattcggcacgagctcgtgccgaattcggcacgagggaaattctgangagcattactattcactgatgcagaaagacg

SEQ ID NO: 8485 - DNA, 114 bp, Homo sapiens
  misc_feature 11, 15, 37, 79, 83, 90, 105: n = A,T,C or G
aaaaagctggngctngcgcgccctgcgggtcggacantaggggatccaaagaattcggcacgagcattcttgagcaatngctnggtccgnggacaataaacagtnttatcaaag

SEQ ID NO: 8486 - DNA, 400 bp, Homo sapiens
aataagctggagctcgcgcgcctgcaggtcgacactagtggatccaaagaattcggcacgagctccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagg

SEQ ID NO: 8487 - DNA, 400 bp, Homo sapiens
  misc_feature 352, 363: n = A,T,C or G
aataagctggagctcgcgcgcctgcaggtcgacactagtggatccaaagaattcggcacgaggacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactggggtcagggctcttnctgcttcgggnggcttgtgcaacctttgggccaaggttccctcaacct

SEQ ID NO: 8488 - DNA, 398 bp, Homo sapiens
  misc_feature 38, 88, 109, 121, 155, 210, 218, 258, 288, 312, 356: n = A,T,C or G
aaaagctggagctcgcgcgcttgcaggtcgacactagnggatccaaagaattcggcacgagcatcagaatcagaggtatcaatggagngagcccaaaggttcgaaaggngttgcaggcttnttcgccttcgtcaaatcttcaatggaacctttgngaagctcaacaaggcttcgattaacatgctgaggattgtagagccatatattgcntgggggtnccccaatctgaagtcagtaaatgaactaatctacaagcgnggttatggcaaaatcaataagaagcgaatngctttgacagataacgctttgatngctcgatctcttggtaaatacggcatcatctgcatggaggattngattcatgagatctatactgttggaaaacgcttcaaagaggc

SEQ ID NO: 8489 - DNA, 397 bp, Homo sapiens
  misc_feature 3, 10: n = A,T,C or G
aanaataagnctggagctcgcgcgccctgcaggtcgacactagtggatccaaagtaattcggcacgaggccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcattcgatgttgtctacaatgcatctaataacgagctggttcgtaccaagaccctggtgaagaattgcatcgtgctcatcgacagcacaccgtaccgacagtggtacgagtcccactatgcgctgcc

SEQ ID NO: 8490 - DNA, 300 bp, Homo sapiens
  misc_feature 10, 21, 38, 115, 261, 263, 296: n = A,T,C or G
aaaagctggngctcgcgcgcntgcaggtcgacactagnggatccaaagaattcggcacgagcagaaggctaaatgaatattatccctaatacctgccaccccactcttaatcagngggggaagaacggtctcagaactgtttgtttcaattggccatttaagtttagtagtaaaagactggttaatgataacaatgcatcgtaaaaccttcaaaaggaaaggagaatgttttggggaccactttggttttcttttttgcgngnggcagttttaagttattagtttttaaaatcagnactt

SEQ ID NO: 8491 - DNA, 312 bp, Homo sapiens
  misc_feature 4, 9, 56, 71, 111, 235, 294: n = A,T,C or G
gacnctagnggatccaaagaattcggcacgaggggacttgaaatcaaatgtttggnaatggggcccttggnggcaacctcccattttagatgtttaaaggaccctatatgnggcattcctttctttaaactataggtaattaaggcagctgaaaagtaaattgccttctagacactgaaggcaaatctcctttgtccatttacctggaaaccagaatgattttgacatacagganagctgcagttgtgaaagcaccatcatcatagaggatgatgtaattaaaaaatggccagngggcaaagaaaagaactg

SEQ ID NO: 8492 - DNA, 268 bp, Homo sapiens
  misc_feature 4, 6, 213, 220, 238: n = A,T,C or G
gtgngnactagtggatccaaagaattcggcacgaggagagtagtttatgtcaaataaaacatgcaggtagagtcaatgtaacagacatcctaagttggatctgagcacaaaaaaggaaaacactgagtaacgtctggagtttaggtaatcatgttgtagccatgttcattttcttagctttttaatatgttaacattcagggggaacctgggngaacggnatacaggaactctctccnacactatctttgggattggctggggatcag

SEQ ID NO: 8493 - DNA, 399 bp, Homo sapiens
  misc_feature 2, 51, 304, 353: n = A,T,C or G
cntaagactggagctcgcgcgcctgcaggtcgacactagtggatccaaagnaattcggcacgaggggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgntgtctacaatgcatctaataacgagctgggttcgtaccaagaccctggngaagaattgcatcgtgctcatcgacagcacaccgtaccgacagtgg

SEQ ID NO: 8494 - DNA, 233 bp, Homo sapiens
  misc_feature 2, 13, 41, 72, 77, 120, 126, 183, 206, 221: n = A,T,C or G
ancgaaagctggngctcgcgcgcctgcaggtcgacactagnggatccaaagaattcggcacgaggcttcttntaggnggtcatgattacctgcttgctttgagctcagcagcagtcttcntaaacncatttaaaacaagatcctgggtttttggggtttgacttctatggggttttaaaaaancacagatttttagggttaatatngggaaaatgtactcnccttagggattc

SEQ ID NO: 8495 - DNA, 400 bp, Homo sapiens
aaaagctggagctcgcgcgcctgcaggtcgacactagtggatccaaagaattcggcacgagattcagtgcttggcaggttagtatatttttatgcctttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattgtattttaattattaactgtattaaatttacta

SEQ ID NO: 8496 - DNA, 393 bp, Homo sapiens
  misc_feature 1, 2, 28, 33: n = A,T,C or G
nnaaaaataagactggaagcctcgtgcncctgnaggtcgacactagtggatccaaagaattcggcacgaggcgaacgcggagaagcacgccatgaaggcctcgggcacgctacgagagtacaaggtagtgggtcgctgcctgccacccccaaatgccacacgccgcccctctaccgcatgcgaatctttgcgcctaatcatgtcgtcgccaagtcccgcttctggtactttgtatctcagttaaagaagatgaaagaagtcttcaggggagattgtctactgtgggcaggtgtttgagaagtcccccctgcgggtgaagaacttcgggatctggctgcgctatgactccccggagcggcacccacaacatgtaccgggaataccgggacctga

SEQ ID NO: 8497 - DNA, 180 bp, Homo sapiens
  misc_feature 10, 21, 29, 38, 161: n = A,T,C or G
aaagcctggngctcgcgcgcntgcaggtngacactagnggatccaaagaaattcggcacgagaaaatgatcgggcaagcaactgcggcagaccaggagaaaaaccctgaaggggatggcctccttgagtacagcaccttcaacttctggagagctcccatngccagcatccactccttcg

SEQ ID NO: 8498 - DNA, 127 bp, Homo sapiens
  misc_feature 25, 38, 72, 83, 97, 106, 118: n = A,T,C or G
aaaagctggagctcgcgcgcctgcnggtcgacactagnggatccaaagaattcggcacgagctcgtgccganttcggcacganccggccgcgaaggnggcaagaanaagccactgaancagcccaag

SEQ ID NO: 8499 - DNA, 384 bp, Homo sapiens
  misc_feature 271, 274: n = A,T,C or G
ataagctggagctcgcgcgcctgcaggtcgacactagtggatccaaagaattcggcacgaggataatgagccctttggctaaatggcaccgctctaaagagggtctgactgagcgctttgagctgtttgtcatgaagaaagagatatgcaatgcgtatactgagctgaatgatcccatgcggcagcggcagttttttgaagaacaggccaaggccaaggctgcagggtgatgatgaggccatgttcatagatgaaaacttctgtactgccntgnaatatggggctgcccccccacagctgggctgggggcatgggcattgatcgagtcgccatgtttctcacggactccaacaacatcaaggaagtactttctgtttcctgcca

SEQ ID NO: 8500 - DNA, 334 bp, Homo sapiens
  misc_feature 2, 278, 312: n = A,T,C or G
anaagctggagctcgcgcgcctgcaggtcgacactagtggatccaaagaattcggcacgaggctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcgggggatgtctcgcttctgtggcacaggggcncacggtcaagaggctgaaaaaggggcactgcacngagcacccttgccaagccatcg

SEQ ID NO: 8501 - DNA, 398 bp, Homo sapiens
  misc_feature 16, 21, 38, 112, 118, 126, 191, 203, 316: n = A,T,C or G
aaaagctggagctcgngcgcntgcgggtcgacactagnggatccaaagaattcggcacgagatttgcaatgccttattttaagggaaaatttcacccccccaaaaaaatcanacactntaaaatgngagcaacacataaaaccaaactataaccagactgttacaaaaatgcctgaacatgagaagtccanaaacttcatatngggggatagtaccacagtactgcttaagtcaaaggcaaggtttatgtatatacagtcttaaacaggcctaaataagttatttagagatatgcaaatatggaattgcacttttngtacaaaacgactgagggtttttcaaagcaaattaaattttacgggatgcttcaaaatggcacgcgacatgcagagttgagc

SEQ ID NO: 8502 - DNA, 355 bp, Homo sapiens
  misc_feature 2, 24, 38, 64, 81, 144, 186, 196, 215, 221, 263, 282: n = A,T,C or G
anaagctggagctcgcgcgcttgnaggtcgacactagnggatccaaagaattcggcacgagagnggcctcaggttcacagngcaccatgtcactgtgctatcctacgaaatcatttgtttctaagttgggtttattcctggagngacatgccaccccgaatggctcactttcactgaggatgctgncctctgattnagctgctgcctccagcctntggctngagaacttactaaaggcacttccttcctgttaaacccctgtnaactctccataaatttggngattctctgctaggcctaagattttgagttaacatctcttgaagccaaactccaccttctgtgctttttgctt

SEQ ID NO: 8503 - DNA, 102 bp, Homo sapiens
  misc_feature 80, 84: n = A,T,C or G
cagaagctggagctcgcgcgcctgcaggtcgacactagtggatccaaagaattcggcacgagctcgagtttttttttttngctngttggttggtttggaact

SEQ ID NO: 8504 - DNA, 210 bp, Homo sapiens
ataagctggagctcgcgcgcctgcaggtcgacactagtggatccaaagaattcggcacgaggaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttg

SEQ ID NO: 8505 - DNA, 399 bp, Homo sapiens
  misc_feature 2: n = A,T,C or G
anaagctggagctcgcgcgcctgcaggtcgacactagtggatccaaagaattcggcacgagggtaagcccaagagttcatgagcaactttcaggggttgctctcccgaagcccttcctcattgtaacctgcccagtagtgtctgggtccctgggctctaccttttcagccctccagccagcttgggtggttgaggcttgatttaccctactctctggtgcactttgactgaaccacgtcagagctaagcagcgagaagccagagagaaaaagcatgaaggtttccccaccctctggggacctcagactctctggttggaaaggaagtttgcctggcctgatgactttaattatctgccatttctcactagggccacaaaatttcttgaggtctggggca

SEQ ID NO: 8506 - DNA, 312 bp, Homo sapiens
  misc_feature 3, 34, 43, 82, 130, 161, 186, 191, 195, 247, 268, 290: n = A,T,C or G
aancgaaagcctggagctcgcgcgcctgcaggtngacactagnggatccaaagaattcggcacgagcgtaaggttattttgngtttttaagttggttttacaattctttcctggggaaattatttctggnggggaaaaagatccattctacgtatccttgnggagaaaagctaaataacctttaanaatgngggnggtattggagaaagaagatgaattatagctccggagaatcaagatcttaagngaagcctttctgttcagatgngatctataaaaaatcataattnggggaaagtttaagcaaatctg

SEQ ID NO: 8507 - DNA, 356 bp, Homo sapiens
  misc_feature 24, 28, 74, 334, 336, 355: n = A,T,C or G
agaattcggcacgagacgacgatnaggngacagtcacggaggataagatcaatgccctcattaaagcagccggngtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaaagaaagaagaatccgaggagtctgatgatgacatggggcctttgggtctttttgactaaacctctttttataacatgntncaataaaaagctgaacttnt

SEQ ID NO: 8508 - DNA, 400 bp, Homo sapiens
  misc_feature 3, 5: n = A,T,C or G
aanantaagactggagctcgcgcgcctgcaggtcgacactagtggatccaaagaattcggcacgagcaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgaccctaagaacaggatatggtgaggatgtcattggaagagaagagctctttccgtggtattctttggcaagagccatgtctactaagaggttaggtgacttcagtatacttataaaattcagtgagagtgccttcttctcttctaccacactctggcatagata

SEQ ID NO: 8509 - DNA, 399 bp, Homo sapiens
  misc_feature 4: n = A,T,C or G
accnaagactggagctcgcgcgcctgcaggtcgacactagtggatccaaagaattcggcacgagggtttctacactttcaaagagctgtaataacagattatggaattctgtaagtagaaaagccatggattctcctggtccattcagccagggtattcactgtgcacagactaaagtggggctaagatattcactgtgcacagactaaagtgggagagaggtggtgaaaagacggaaagagaacaacacaaaaatttaatttttaatctttggaaatttggatctcatagaagcaaagattgcagactatcatacttagaaacgatgtaatttttccaattcagccatctgccccattcacagacactctcaccaacagagtccttcattcaagaata

SEQ ID NO: 8510 - DNA, 143 bp, Homo sapiens
  misc_feature 2, 11, 112: n = A,T,C or G
gngacactagnggatccaaagattcggcacgagggacctttcccccttcaagaaaagaatccagccaactattcgaaggactgggctcgccgccctccgacactaccttttngggcctccaaagctccaccagcgccttcggg

SEQ ID NO: 8511 - DNA, 368 bp, Homo sapiens
  misc_feature 56: n = A,T,C or G
cagaaagctggaagcttcgcgcgccctgcaggtcgacacctagtggatccaaaganttcggcacgagctgagtgacatgcccaagattctgcagctagcaaatgctagtattgggattctaatcaaggactacttgcctccaaattctgcacttgtaaccattgctgtatctcttaccctaacccacaatcctacttttccatgtgaatttcacctgctagcaatgcatgctcccggtgggttgtgcatttggtgcagatgtctttgccatctcaaggataaaccatgtagatatttccctttctggccattttcaactcctgaagacaactgtggccagggaaccacagttcaaattgcaaatgctc

SEQ ID NO: 8512 - DNA, 100 bp, Homo sapiens
  misc_feature 2, 12, 31, 36, 37, 38, 43, 66, 81, 84, 86, 97: n = A,T,C or G
gngggtggacantaggggatccaaaaaattnggacnnngaaangcctccactgactatgacctatntgacaagagcataanccntntggggggcttngac

SEQ ID NO: 8513 - DNA, 399 bp, Homo sapiens
  misc_feature 20, 28, 33, 37, 130, 133, 192, 212, 217, 269, 277, 302, 304: n = A,T,C or G
aaacctggagctcgcgcgcntgcaggtngacantagnggatccaaagaattcggcacgagaagaaaatgaaaaagttgtcaaggtaggacatcaagcaaatgaccaatcttgacccatggctaggtcttntanactcctgaacccggaggcatgaagcctgggtctggcataaagccaaatctttgggcttnggtttctcatctttcaaaanaaggnaattgttctgcctgcctcctagggttactatgggaactggggaaaaggaaanaaaggtgnggaggttcctaggccttcatgaggngnggcaaaaaggagcctcggcccacccaggagggacccttgaacctgccctgctctgtgggtcagggagcaggttggccctcattgatcctacattt

SEQ ID NO: 8514 - DNA, 399 bp, Homo sapiens
  misc_feature 52, 233, 241: n = A,T,C or G
accgaagctggagctcgcgcgcctgcaggtcgacactagtggatccaaaganttcggcacgagctcgtgccgaattcggcacgagtgtagatattgcaccctatgacattggtggtcctgatcaagaatttggtgtggacgttggccctgtttgctttttataaaccaaactctatctgaaatcccaacaaaaaaatttaactccatatgtgttcctcttgttctaatcttgncaaccagngcaagtgaccgacaaaattccagttatttatttccaaaatgtttggaaacagtataatttgacaaagaaaaatgatacttctctttttttgctgttccaccaaatacaattcaaatgctttttgttttattttttttaccaattccaatttcaaaatg

SEQ ID NO: 8515 - DNA, 400 bp, Homo sapiens
cagaagctggagctcgcgcgcctgcaggtcgacactagtggatccaaagaattcggcacgagcagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcata

SEQ ID NO: 8516 - DNA, 400 bp, Homo sapiens
  misc_feature 13, 22, 74, 94, 117, 122, 153, 155, 176, 203, 231: n = A,T,C or G
gcgcttgaaggtngacactagnggatccaaagaattcggcacgagaacaatgcctccactgactatgacctatntgacaagagcatcaaccctntggggggctttgtccactatggngaagngaccaatgactttgtcatgctgaaaggctgngnggggggaaccaagaagcgggngctcaccctccgcaagtccttgctggngcagacgaagcggcgggctctggagaanattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggggggggtctcaataaaag

SEQ ID NO: 8517 - DNA, 302 bp, Homo sapiens
  misc_feature 2, 23, 31, 40, 146, 155, 227, 229, 262, 290, 293: n = A,T,C or G
cnaaagcctggagctcgcgcgcntgcaggtngacactagnggatccaaagaattcggcacgaggtcactgcactccagcctggggacagagcaagactccgtctccaaaaaaaagaaaaagaaaattattttctaatatatttcgnattttattnagggggtctgtttctcttccaccaggatttaagctccaccagggtaggggtttgtctgttttattcagggtngnatctccagggcctaggacaaaaccaaacatgcngcatatggtcaagacctattagttgagnggnggactgaat

SEQ ID NO: 8518 - DNA, 239 bp, Homo sapiens
  misc_feature 7, 20, 87, 101, 104, 118, 125, 139, 143, 144, 154, 176, 179,180, 182, 191, 203, 210, 212, 214, 219, 221, 222, 224, 227,231, 232, 233: n = A,T,C or G
gcaggtngacactagtgggntccaaaaaattcggcacgagcttcaacactctttatgataacaacactgtgttatattctttgaatnctagcccatctgcngancaatgactgtgctnaccagtnaaagataacctttntttnngaaatagggnaaatacgaaattagaaaagccntgnntnttttaactncctgaactgggnggaaacncngnttggntnntntgngggnnngaagat

SEQ ID NO: 8519 - DNA, 344 bp, Homo sapiens
  misc_feature 4, 39, 57, 92, 180, 291, 303: n = A,T,C or G
tggngctccgcgcgcctgcaggtcgacacttgtggatcnaagaattcggcacgaggntaaaaacaatataaaaaatttcagccgggcgcggnggctcacgcctgcaatcccagcactttgggaggccgaggtgggcagatcaggaggtcaaggcatcaagatcatcctggccaaaatggngaaaccctgtctctactaaaagtacaaaaattagctgggcgtggtggtgtagacctgtagtcccagctacttggcaggctgaggcaggagaatcccttgaaccagggaggnggaggttgcagntgagccaagattgtgccatttcaccccagcctggcaacaga

SEQ ID NO: 8520 - DNA, 114 bp, Homo sapiens
  misc_feature 3, 12, 45, 52, 54, 57, 71, 87, 107: n = A,T,C or G
ctnggtgagtcnaagaattcggagcgagctcgtgccgaattcggnacgaggngnagntggaggccattatnataaatgaattaatgnagggaatagaaaaataaatnctggaat

SEQ ID NO: 8521 - DNA, 109 bp, Homo sapiens
  misc_feature 3, 15, 40, 100, 105: n = A,T,C or G
tcnaagaacttcggncgggtcttcctgaagatctctaccntttaattaagaaagccgttgctgttcgaaagcatcttgagaggaacagaaaggataaggntgctnaatt

SEQ ID NO: 8522 - DNA, 399 bp, Homo sapiens
ataagctggagctcgcgcgcctgcaggtcgacactagtggatccaaagaattcggcacgaggcagtatatacccatgaagcagggaaaatctggagaataggaatcaaccaccctcacccattcttccctttctccctgctaagcaaatcttgagttccctgagcctgtttatgccatgaagcatggcctccttccatgtggtggggttcagttggcaggaatttgtcctgctcatttacattgtgcctgttgtctggctttggatccctcagacctggtttttctttctagggcctctgcctgaagcttggaatcaagtttgggaaggaaaaggtatttcagaggccctttgtgtctgtgtagtgtctcaaatgtgccctgctgaatttgcagttctc

SEQ ID NO: 8523 - DNA, 112 bp, Homo sapiens
  misc_feature 11, 12: n = A,T,C or G
gaggactgttnngcaggctgatgaataagatctaagagtacctggctacagaaagaagatgccagatgacacttaagacctacttgtgatatttaaatgatgcaataaaaga

SEQ ID NO: 8524 - DNA, 205 bp, Homo sapiens
  misc_feature 4, 14, 143, 146, 152, 167: n = A,T,C or G
cggncaacgctgangtcctcgcttggccattttgtatgccaagagggccagtgtcttcgtcaaattacagaagccaaatgctgccatccgagactgtgacagagccattgaaataaatcctgattcagctcagccttacaagnggngggggnaagcacacagacttntaggccactgggaagaagcagcccatgatcttgccctt

SEQ ID NO: 8525 - DNA, 399 bp, Homo sapiens
  misc_feature 22, 30, 39, 67, 136, 140, 157, 191, 207, 245, 250, 310, 371: n = A,T,C or G
gaaagcctggagctcgcgcgcntgcaggtngacactagnggatccaaagaattcggcacgagaaccntatcctggaaattctccccaggcagtaacctgaggcaatagtaaccctcatatcattgtttcacatctntcanatgtcattgttagatgngcactgtcttgcagtccatcattccagaaagatngtccatttttacatgngataagccatatctaatcccaataaatttttccacaangtttngtttcattcttccagcaactactctatcattactgtaccaccacctgtatggatctcgtngcccatatgaaactgagtaaggaacaatgggcatcacactcacagagaaagatggacaagngagctggcctttgtatcactaaagggga

SEQ ID NO: 8526 - DNA, 373 bp, Homo sapiens
  misc_feature 2, 6, 328, 338: n = A,T,C or G
anaatnagctggagctcgcgcgcctgcaggtcgacactagtggatccaaagaattcggcacgaggtctgagtgggcatagggtctgtgcccccagctccctgccctcacccttgcctttctccccaccctcctagaagtgagtgagtgtggaactgcagggccctgaacggcccagggcagggcatttgctttgcctgacttgctgggggccttgggacagccccttgcagagcaagggagacttggctgggagatctccaactttccttcccgccctcgcttttggggagtcccatgactttgctgtgtgacccttcaggggcgggngggaaggggntgagaatctgggtgaggctctcaaggctcaggaag

SEQ ID NO: 8527 - DNA, 400 bp, Homo sapiens
  misc_feature 7, 19, 27, 36, 138, 205, 208, 222, 330, 352: n = A,T,C or G
aagctgnagctcgcgcgcntgcaggtngacactagnggatccaaagaattcggcacgagaaggcattcaccacccaacacccattcagatccagggcatccccaccattctatctggccgtgacatgataggcatcgntttcacgggttcaggcaagacactggggttcacgttgcccgtcatcatgttctgcctggaacaaganaanaggttacccttctnaaagcgcgaggggccctatggactcatcatctgcccctcgcgggagctggcccggcagacccatggcatcctggagtactactgccgcctgctgcaggaggacagctnaccactcctgcgctgcgccctntgattgggggcatgtccgtgaaagagcagatggagaccatccgacacg

SEQ ID NO: 8528 - DNA, 101 bp, Homo sapiens
  misc_feature 2, 15, 39, 40, 46, 70, 97: n = A,T,C or G
gncgacactagtggntccaaagaattcggcacgagcggnncgaggnaacattttgtcatataagattcanatttacttcttatacatttgataaagnaagg

SEQ ID NO: 8529 - DNA, 253 bp, Homo sapiens
  misc_feature 3, 16, 67, 153, 171, 239: n = A,T,C or G
aangaacttcggacgngcaagcgttccgcctgccttagcgtcccagagtgctatggattactggggngagccaccggcacccaacctggccaaaaaattaaagtctgtgatgcttattagtttttgggaaataggcactcttacattacttgngaaagctaataaattttnaagagcctttatcgagattattttagcaatattgctggctgggatggcttacatttataatcccagcnctttggaggcagag

SEQ ID NO: 8530 - DNA, 259 bp, Homo sapiens
  misc_feature 19, 164, 171: n = A,T,C or G
tagaaacgcttaagcagtngccttttttaaacatcgatacgagacctctgaatttgtattttttcttgttaaccattttaatttgttggctggatgtataaagatgtttaaaaaattcagttgctttttggggtaatttgaattacttttttaatgactggggntccattngactgtttgcattgagattgcaatgtgcgcaattttttttgtagttgtggcatcttgttgacatcgaatatgactttgataataaata

SEQ ID NO: 8531 - DNA, 130 bp, Homo sapiens
  misc_feature 30: n = A,T,C or G
caaagaccgcaaaaagcatcctcgaacggnaagccaaatctcgccaagtaggaaaggaaaagggcaaatacaaggaagaaaccattgagaagatgcaggaataaagtaatcttatatacaagctttgatt

SEQ ID NO: 8532 - DNA, 498 bp, Homo sapiens
  misc_feature 2, 26, 45, 64, 103, 107, 189, 242, 303, 320, 341, 366, 383,446, 450, 491: n = A,T,C or G
gnacgaggagccctatgagtacgggncctcctatactcacacctnatttcttactgagcccctnaaaggagctataccattctatgaatgcaaggattgtggnaagncctttattcatagcacagtcctcactaaacataaggagcttcatctggaagaagaagaagaagatgaagcagcagcagctgnagcagctggcagcccaggaagttgaagccaatgtccatgttccacaagtagtnctgaggattcagggcttaaacgtagaggctgctgagccagaagtggaggctgccgagccanaagtggaggctgctganccagaagtggaggctgctganccaaacggagaggctgaagggccanatggagaggctgcagancccattggagaggctggacagccaaatggagaggccgagcagccaaatggggatgctgatganccanatggggcaggttttgaagaccccaaaaaaagagctgaaganccgaggg

SEQ ID NO: 8533 - DNA, 329 bp, Homo sapiens
  misc_feature 73, 322: n = A,T,C or G
cagtcgccaatatgcagctctttgtccgcgcccaggagctacacaccttcgaggtgaccggccaggaaacggncgcccagatcaaggctcatgtagcctcactggagggcattgccccggaagatcaagtcgtgctcctggcaggcgcgccccttggaggatgaggccacttctgggccagtgcggggtggaggccctgactaccctggaagtagcaggccgcatgcttggaggtaaagtccatggttccctggcccgtgctggaaaagtgagaggtcagactcctaaggtggccaaccgggagaagaagaagaagaagacnggtcggg

SEQ ID NO: 8534 - DNA, 500 bp, Homo sapiens
  misc_feature 38, 45, 71, 93, 99, 202, 469, 475, 490: n = A,T,C or G
tcgagaggaaagagagaaatcttccataactcccaggntgctggngaaggaccatgtgtacggtgttaagngacgctgactaaagtttagggngcctgngggatagccgacttgtgacagcaggtaagcatttaatatgcagatgtgaagctcaagatagaggtcatgagctgaagatagaattttgaacatcggcagtggntaaaaccacaaaaactgaggacttaataatgagagacatcaaaatgtacaggccagggagaggactttgagtagggactttgtttgggtcagtgttgtatcctcagacatcccctagcacatagtaggctcaaaaatgtttctttaatgaataaatgaataataataataataaacattctattcaatacgaactcttctaattgtggcagcataatatttcattgagtaaatacagcacaatttacatatctatttccttattggnccagtnatcaatggctgccgnaacaaattgc

SEQ ID NO: 8535 - DNA, 500 bp, Homo sapiens
  misc_feature 21, 23, 37, 39, 67, 78, 96, 278, 441: n = A,T,C or G
cttcttgggaaaaaaccccgntntttggggcgcttgnangacccacactagtggatccaaagaattntttttcgaggnaacacgagaaagcacatnccaaggccaccacacaccacctgtccaaaaaggccttcgatacgggataatcctatttattacctcagaagtttttttcttcgcaggatttttctgagccttttaccactccagcctagcccctaccccccaactaggagggcactggcccccaacaggcatcaccccgctaaatcccctanaagtcccactcctaaacacatccgtattactcgcatcaggagtatcaatcacctgagctcaccatagtctaatagaaaacaaccgaaaccaaataattcaagcactgcttattacaattttactgggtctctattttacccccctacaagcctcagagtactncgagtctcccttcaccatttccgacggcatctacggctcaacattttttgtagccacag

SEQ ID NO: 8536 - DNA, 438 bp, Homo sapiens
  misc_feature 1, 19, 29, 49, 60, 62, 144, 363: n = A,T,C or G
nacaaaaaccctggttttngggcgcttgnaggtccgacactagtggatncaaagaattcntnacgagcactgcttaagtacattcctggatgtttggaagatttttaagcgccatagagagggtacttatgctatggaaattgngtttatatatatatgcataattgccactgaaattctgaacagacccaaaggaagaaaaatactgtgatttaaataaagctaacataattaatttatatctattttatatttgacttagtgggataaattgttttgtggaaaaccatattataaaatagtctaagttttttatagttgaggaagaatttgaggtgaaagatcatgttaattgtaacaatngccagtactttgtgtccactatgtgtctggcactgatttatgtttattaatttactacatcctcagaacaattca

SEQ ID NO: 8537 - DNA, 209 bp, Homo sapiens
  misc_feature 12, 22, 28, 52, 54, 85, 88, 92, 97, 179, 194: n = A,T,C or G
accctggttttngggcgcttgnaggtcnacactagtggatccaaagaattcntnacgagacactttttacatatatgcacatagnatngttngcttnttatgttgaccatcagcctcgtgttgagccttaaagaagtagctaaggaactttacatcctaacagtataatccagctcagnattttagttttgttntttggttgtttgttt

SEQ ID NO: 8538 - DNA, 102 bp, Homo sapiens
gggaaatttgtcataaagaatttcttttatttttgaaatcgagtttgtaaatgtccttttaagaagggagatatgaatccaataaataaactcaagtcttgg

SEQ ID NO: 8539 - DNA, 164 bp, Homo sapiens
  misc_feature 2, 61, 66, 76, 77, 101, 104, 144, 153, 154: n = A,T,C or G
gnaggccagggtgctcggggcaaggcggctgggagcggccctcacattgatggctcctgcnccctnctccgcaggnntgctccctgaggccaagaagcctnggntccctgacggcacccctgatcatgaaggacagcgtgagtnccaggacgnncttttggagg

SEQ ID NO: 8540 - DNA, 500 bp, Homo sapiens
  misc_feature 55, 66, 146, 150, 328, 405: n = A,T,C or G
cttcttgggaaaaaaacccggttttcgggcgcttgcaggtccacactagtggatncaaagaattcntttcgagctgcggagtctgctgctattctccgagcttcgcaatgccgcctaaggacgacaagaagaagaaggacgctggnaagncggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctntgagagactgaagattcgaggctccctggccagggcagcccttcaggagctccttagtaaaggacttatcaaactgntttcaaagcacagagctcaagtaatttacaccagaaataccaagggtggagatgctccagctgcctggtgaagatgcatgaataggtccaaccag

SEQ ID NO: 8541 - DNA, 495 bp, Homo sapiens
  misc_feature 5, 19, 29, 31, 36, 49, 60, 82, 415: n = A,T,C or G
ggganaaaacccggttttngggcgcttgnangtccnacactagtggatncaaagaattcntttcgagcacgccgccgcttgngctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgngaagacctggagcgactgaagaagattcgggcccatagagggctgcgtcactttctggggccttcgtgtccgaggccagc

SEQ ID NO: 8542 - DNA, 500 bp, Homo sapiens
  misc_feature 11, 13, 30, 40, 44, 54, 120, 334, 467, 478: n = A,T,C or G
ggggcgcttgnangaccacactagtggatncaaagaattntttncgagcgtggncccaagaagcatctgaagcgggtggcacgctccaaagcattggatgctggataaattgaccggtgngtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggaganaatttccgtctgatctatgacaccaagggtcgctttgctgtacatcgtattacacctgaggaggccaagtacaagttgtgcaaagtgagaaagatctttgtgggcacaaaaggaatccctcatctggtgactnatgatgcccgnaccatccgctaccccgatcccc

SEQ ID NO: 8543 - DNA, 118 bp, Homo sapiens
  misc_feature 29: n = A,T,C or G
tacgagggagatcgccattatccccagcnaaaagctccgaacaagatagcaggttacgtcacgcatctgatgaagcgaattcagagaggcccagtaagaggtatctccatcaagctgc

SEQ ID NO: 8544 - DNA, 488 bp, Homo sapiens
  misc_feature 32, 221, 337, 340, 385, 469: n = A,T,C or G
cgggtccaaagggtgaacagggtgcctctggngaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggnctgcctggtgtccagggccctccgggtagagcaccgacagatcagcacattaagcaggtttgcatgagagtcatacaagaacattttgctgagatggctgccaagtcttaagcgtncanactcaggtgccacttgggcttcctggaaggcctggccctcctggnccccccggccctcctggagaaaatggtttcccaggccaaatgggaaattcggggcctttccggcatttaaggggccccctgggnctcttgggtttgaggggac

SEQ ID NO: 8545 - DNA, 208 bp, Homo sapiens
  misc_feature 107, 198: n = A,T,C or G
gctggagcctcgcgcgcctgcaggtcgacactagtggatccaaagaattcggcacgagcggcacgaggctgtgatcgcctccttcgaccagctgtacgacgcctggnggggcgggctggactggtgcaatgccggctggctcagtgatggctctgtgcaatatcccatcacaaagcccagagagccctgtgggggccngaacacagtg

SEQ ID NO: 8546 - DNA, 400 bp, Homo sapiens
gctggagctcgcgcgcctgcaggtcgacactagtggatccaaagaattcggcagaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaag

SEQ ID NO: 8547 - DNA, 400 bp, Homo sapiens
  misc_feature 392: n = A,T,C or G
gacaataagctggagctcgcgcgcctgcaggtcgacactagtggatccaaagaattcggcacgagcagattcctttatatgtagtggaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagngttctaag

SEQ ID NO: 8548 - DNA, 400 bp, Homo sapiens
  misc_feature 4, 8: n = A,T,C or G
cacntganggtgggacgctagtggatccaaagaaattcggcacgagcacttttctggctgtcataaagatataaagagaaaaatcagaatggatagctcaaaaatgtcatcttcattttatagctgaagaagctgaggctcatagtgctaaggtagtctcagatcacacaggtaggaagtggagaagctgcatatgactcctaatgccatgttcactcacagaacaaatatctacatagaggccacatctccattctgagttttttcagtggcctcctaaaaagatatcacaaacttgggcatgaccattgggagcaaggcattgcctgagatcttgccagattggtctccattaacacacagtctcatgcgtatccccaaactcataaagaaaacatgc

SEQ ID NO: 8549 - DNA, 383 bp, Homo sapiens
  misc_feature 164, 168, 183, 210, 217, 298, 332, 336, 339, 370: n = A,T,C or G
cgaacaataagctggagctcgcgcgcctgcaggtcgacactagtggatccaaagaattcggcacgaggtgcttcttagcatcatcttcatgaatggaaatcggtccagtgaggctgtcatctgggaggtgctgcgcaagttggggctgcgccctgggatacatnattnactctttggggacgngaagaagctcatcactgatgagtttgngaagcanaagtacctggactatgccagagtccccaatagcaatccccctgaatatgagttcttctggggcctgcgctcttactatganaccagcaagatgaaagtcctcaagtttgcctgcnaggnacnaaagaaggatcccaaggaatgggcagctcancaccgagaggcga

SEQ ID NO: 8550 - DNA, 400 bp, Homo sapiens
gtctggggcctcgcgcgcctgcaggtcgacactagtggatccaaagaattcggcacgagggaaagacacaagcatcatgcagtggcgcgtcatttagtacccaccgagagctgtggggagcagcatgggcaaggaagacacagactcgcattacccttggtcactgtgatttctgttttgtttaaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaac

SEQ ID NO: 8551 - DNA, 208 bp, Homo sapiens
  misc_feature 47: n = A,T,C or G
tctggggctccgcgcgccctgaaggtcgacactagtggatccaaagnaattcggcacgagcttggactactttaatttggatcctttgggtttggagaaagggaatgtgaaagctgtcattacagacaacaggtttcagtgatgaggaggacaacactgcctttcaaactttttactgatctcttagattttaagaactcttgaattg

SEQ ID NO: 8552 - DNA, 374 bp, Homo sapiens
  misc_feature 24, 28, 221, 236, 304, 334, 354: n = A,T,C or G
cgacaaaagctggagctccgcgcncctnaggtcgacactagtggatccaaagaattcgccacgaggcgtgtttcagcatttgaaattgtattacacttcttggactgttggccagttttgagattttcatcatactttttttttcttcatgtctttttatgccagttaggaaggatctattgacctatcttcaagctctttgattcttttctcaactgagnccgatctccacgtgnccatcaaagacattctttatttttattatagggctttggattcctgtttcctttacagtttttctcgnctaatacctctgctttcactggccatctgntttgcatactttctaccctnaccattaaaatccattaaac

SEQ ID NO: 8553 - DNA, 336 bp, Homo sapiens
gacaaaagctggagctcgcgcgcctgcaggtcgacactagtggatccaaagaattcggcacgagtctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagga

SEQ ID NO: 8554 - DNA, 274 bp, Homo sapiens
  misc_feature 9, 56, 183, 190, 199, 216, 268: n = A,T,C or G
gaacaatangctggagctcgcgccgcctgcgggtccgacactagtggatccaaagnaattcggcacgagctcgtgccgaattcggcacgagctgctacacaagaccctgagaactgacctgcagggacgaaaccatgaagagcctgatccttcttgccatcctggccgccttagcggaggtancttttgngttatgaancacatgaaagcatggantcttatgaccttaatcccttcattaacaggagaaatgcaaaatcccttcatntcccct

SEQ ID NO: 8555 - DNA, 397 bp, Homo sapiens
gaacaataagctggagctcgcgcgcctgcaggtcgacactagtggatccaaagaattcggcacgagagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtggagttgtgcaattcacagcaaagtagtcaggaatcgatctcgtgaagccccgcaaggaccgaacacccccaccccgatttagacctgcgggtgctgccccacgt

SEQ ID NO: 8556 - DNA, 400 bp, Homo sapiens
  misc_feature 19, 28, 32, 87, 372, 389: n = A,T,C or G
gacaataagctggagctcnccgcctcgnggtngacactagtggatccaaagaattcggcacgagctgaaacccagtttcagcaaggnaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggnaattgaaactttatggnggagaatggat

SEQ ID NO: 8557 - DNA, 400 bp, Homo sapiens
  misc_feature 28: n = A,T,C or G
gacaataagctggagctcgcgcgcttgnggtcgacactagtggatccaaagaattcggcacgagaagtgatcttgggtctaaaaatatagcctaaggaaataatatgaatcgcatatgaagatttataaatgtttattaccatcttatctgtaatacaaaaaatggaaacaaagccccaataacaaaatatttaaataaattagtgtagtttatatatctatattgataaaactcagttacaaaagttttttaaaaatttaatgacttggaaatatacttgcaatgtattccgtaaaaaagtgaaatttaatatattatcttatgtgtaaaatataattttgaaataaatatataaaattcatttaatcaaaagtatttattaagctgttactctaagac

SEQ ID NO: 8558 - DNA, 400 bp, Homo sapiens
gacaataagctggagctcgcgcgcctgcaggtcgacactagtggatccaaagaattcggcacgaggaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaac

SEQ ID NO: 8559 - DNA, 124 bp, Homo sapiens
  misc_feature 7, 16, 20, 23, 26, 32, 34, 38, 39, 55, 62, 66, 71, 72, 74,81, 82, 86, 90, 93, 100, 120, 121: n = A,T,C or G
aggaaangaatttcanaatntgnagncggctntnccannggcaacgagtgaatgnccgatangtancaaanngncattcanncgantgcnccncgctganacccccataaacaaaatggnngaa

SEQ ID NO: 8560 - DNA, 103 bp, Homo sapiens
  misc_feature 4, 9, 34, 44, 55, 57, 60, 62, 69, 81: n = A,T,C or G
tgcncgccnctatctgtgcccgactcggttcacngggcaagaangcaatttttcnanacntnttggtantcggctgatcancacgggcagaccgagtgcaatg

SEQ ID NO: 8561 - DNA, 108 bp, Homo sapiens
  misc_feature 9, 18, 38, 43, 50, 62, 67, 74, 79, 87, 88, 90, 101: n = A,T,C or G
cgttttgcngctggtcanaggaaaagaatttcacaatntggtntgggctntacgagcggcantcganttgaatngccgnttattacnngnacacaattcanctcgatg

SEQ ID NO: 8562 - DNA, 100 bp, Homo sapiens
  misc_feature 2, 11, 13, 14, 28, 54, 55, 56, 66, 74, 82, 83, 88, 99: n = A,T,C or G
angcatttcananngtggtgttcggctntccgacggcgcgagtgaatggcgatnnntcctaacacncattcagncgttgccnngctgntaccccgaaana

SEQ ID NO: 8563 - DNA, 120 bp, Homo sapiens
  misc_feature 7, 8, 9, 10, 19, 20, 30, 41, 49, 51, 53, 56, 67, 70, 75,83, 92, 97, 98, 106, 118: n = A,T,C or G
aggggcnnnnaaaatgganncagtgaatgncgagcagtgcnaaaaggananancgngaggaagaganganacccnaaaaaaangagaaaagngaggnntataaaanagggaaaggagnaa

SEQ ID NO: 8564 - DNA, 128 bp, Homo sapiens
  misc_feature 2, 5, 12, 15, 16, 20, 31, 32, 46, 50, 56, 57, 62, 66, 75,76, 84, 95, 106, 112: n = A,T,C or G
cnatntgttggngannatangattgccagcnngtgaatgggcgatnttcnataacnngcatncgcnggcgcactnngtgacacnccattaacaangttgagaattntgtctnacgagactgctaaagt

SEQ ID NO: 8565 - DNA, 100 bp, Homo sapiens
  misc_feature 16, 27, 31, 33, 63, 65, 66, 68, 74, 89: n = A,T,C or G
ttcgcgatcgcatcanacgcgttttgngccntnttcccgctggtcacaggaaaacgcatttcncnntntggtgncggctgtcacgcagnggcgcgagtga

SEQ ID NO: 8566 - DNA, 100 bp, Homo sapiens
  misc_feature 8, 17, 28, 33, 39, 49, 52, 54, 57, 62, 67, 70, 82, 90: n = A,T,C or G
ccacgccnttagcgccnttttgccgctngtcanaggacnacgcatttcnccntntgntgtgngaatntangattgccagccngtgaatgngcgattttcg

SEQ ID NO: 8567 - DNA, 111 bp, Homo sapiens
  misc_feature 5, 7, 8, 9, 30, 35, 46, 52, 55, 56, 61, 74, 84, 85, 86, 109: n = A,T,C or G
ttcanannntggtgtcgggctatcagcagnggcancgagtgcaatnccccgnttnntcctnaacacgcattcanccgttgccgnnntgttaccccacaacaaaaggganaa

SEQ ID NO: 8568 - DNA, 101 bp, Homo sapiens
  misc_feature 2, 7, 8, 11, 12, 21, 26, 36, 40, 43, 47, 52, 64, 87, 88, 89: n = A,T,C or G
tnaagannggnntttttctcncaggntatcagaggnggtntgntgcnctatntgccggatggtnacaggaagaagcattttctagcnnngttggtagtgcg

SEQ ID NO: 8569 - DNA, 106 bp, Homo sapiens
  misc_feature 10, 11, 13, 14, 15, 16, 17, 18, 20, 28, 36, 41, 46, 49, 58,60, 63, 75, 82, 83, 88, 103, 105, 106: n = A,T,C or G
gccattttcnntnnnnnngnaagcacgntaatactngcagncgctnctnaaccagtgngngantatatttattcncgatacnnaagtnccagcacccggatcnann

SEQ ID NO: 8570 - DNA, 105 bp, Homo sapiens
  misc_feature 16, 19, 49, 51, 53, 56, 81: n = A,T,C or G
ctatctctgcccgacncgnggtgcacagtgcaagaacgcaatttttcancncntcnttggtagttcgggctgattcacgcngcgtgcagacgaagttggcagatg

SEQ ID NO: 8571 - DNA, 100 bp, Homo sapiens
  misc_feature 4, 17, 31, 33, 41, 46, 49, 54, 61, 66, 77, 78, 81, 88, 90,93, 96: n = A,T,C or G
cagnaacgccgtttacngtcgttacgatgcncnagacagtnccagngantttgncgcgtgntggtngaaaaattagnnttncagccgngnggnacngcca

SEQ ID NO: 8572 - DNA, 100 bp, Homo sapiens
  misc_feature 8, 14, 28, 34, 41, 55, 61, 70, 73, 79, 82, 83, 84: n = A,T,C or G
cctttacntgtctnttacgatgcgcaangtagtnccgtgantttgtcgcgtgctngtcganaaattaggnttncagccngtnnnactgccatttttcgct

SEQ ID NO: 8573 - DNA, 103 bp, Homo sapiens
  misc_feature 9, 10, 13, 36, 41, 48, 64, 65, 72, 74, 87: n = A,T,C or G
cattttcannctnttggtagtcgggctgtcagcagngtgcngacgagntgcaatgcccggtttnngtaatgnancacccattcaccncggttgccccttgtgg

SEQ ID NO: 8574 - DNA, 100 bp, Homo sapiens
  misc_feature 22, 27, 29, 45, 49, 51, 61, 62, 63, 64, 66, 71, 78, 86, 91: n = A,T,C or G
ttccgatcgcatcaacgcggcntgtgncnttttcccgctggtcanaggnantcgcatttcnnnntntggtntcggctntcacgagnggcancgagtgaat

SEQ ID NO: 8575 - DNA, 100 bp, Homo sapiens
  misc_feature 3, 4, 5, 6, 8, 13, 15, 20, 27, 32, 33, 40, 49, 50, 57, 63,67, 69, 76, 78, 87, 89: n = A,T,C or G
tcnnnntntggtntnggctntccgagnggcanngagtgantgcccgttnntattgancaccantcantngttgccntntgatacccnanacaaaattgaa

SEQ ID NO: 8576 - DNA, 134 bp, Homo sapiens
  misc_feature 13, 25, 30, 40, 82, 83, 85, 99: n = A,T,C or G
caccgcataggcnatccagacggcngggcntggtcgcccntatcttgcccgctcggtgcacaggcaagaccgcaatttcacnntntggtagttcggctntcacgcagcgtgcagacgagttgcaatggccgatt

SEQ ID NO: 8577 - DNA, 376 bp, Homo sapiens
  misc_feature 3, 349: n = A,T,C or G
ganaataagctggagctcgcgcgcctgcaggtcgacactagtggatccaaagaattcggcacgaggccagcctcaggctgagtgaggaggagctgctggacaagctagagatcttctttggcaagactaggaacggaggtggcgatgtggacgttcaggagctactgccagggagtgtcattgctggggtttgctagggatggagtgcctcagcgtctgtgccaaatcggccagttcacagtgccactgggtggcaagcaagtccctctgagagtctctccgtatgtgaatggggagatccagaaggctgagatcaggtcgcagcccagttcccccgctcggacttggngctcaacattcctgatatcttggatgg

SEQ ID NO: 8578 - DNA, 400 bp, Homo sapiens
  misc_feature 3, 25: n = A,T,C or G
ganaataagctggagctcgcgcgcntgaggtcgacactagtggatccaaagaattcggcacgaggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcacctgattcccagttagggggtgccctaactgagcagtagggatagaaggtgtgaaccttgggagtgcttttataaattattttccttgtagattttatttttaatttatctctgtgacctgccagggagaggggagagagagagagatgctgttgagcacatgacaaaataaaataaaat

SEQ ID NO: 8579 - DNA, 373 bp, Homo sapiens
  misc_feature 2, 5, 54, 303: n = A,T,C or G
cnagnggctccaaagaattcggcacgaggagagccagaaggggcagttcctgcnaagaggcagagagaggctgctgttgagaagcaagctgcggattcccttcggacaaccatgcaaacctgttttaaccatcacaacaattgtgccacttgcttcccctagccatttccccttaccacctaggtcctctccattttccagttatgcttaacacccaggctggaaaataagaccccagcagaaggtagggaagaattgttctccatgttccaaagagtgcgggccatactgaagccatcttgntatctcgcagaacacctagcagggtgcctcatctcttccaggcagattggtttgtaatggatgcatatat

SEQ ID NO: 8580 - DNA, 398 bp, Homo sapiens
acaaaagctggagctcgcgcgcctgaggtcgacactagtggatccaaagaattcggcacgagccagaagacagcaatggtgccagtgccccctccagagcccaaagaccagtaccctccagccttccatctcagggcgcttcccaagaatatgtcccacccgttttgaaagctccatttgagctcgtgccgaattcggcacgaggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggcttgtaaggaacagattgagaaac

SEQ ID NO: 8581 - DNA, 112 bp, Homo sapiens
  misc_feature 6, 9, 56, 61, 67: n = A,T,C or G
gtgagncgngtacatttaggtgggacgctagtggatccaaagaattcggccgagantacgngggggnctgagtattaagactactggcttacatcctctgatgtcattactt

SEQ ID NO: 8582 - DNA, 113 bp, Homo sapiens
  misc_feature 24, 83: n = A,T,C or G
aggacaataagctggagctcgccncctgaggtcgacactagtggatccaaagaattcggcacgaggggcggcgggctccgccnagccgtttgtccttgatctgcccgcggggc

SEQ ID NO: 8583 - DNA, 100 bp, Homo sapiens
  misc_feature 22, 72, 80, 86, 91, 93: n = A,T,C or G
gaaaatgctggagctcggcgcntgcaggtcgacactagtggatccaaagaattcggcacgagctcgtgccgntttggcangaaganaagcngngatgacg

SEQ ID NO: 8584 - DNA, 400 bp, Homo sapiens
  misc_feature 22, 28, 31, 34, 160: n = A,T,C or G
cgacaataatgtctggagctcngcgccnccntgnaggtcgacactagtggatccaaagaattcggcacgagcaagagctgagcagaccacctcctttatgtaggcaaaacttccatcattttggcttttgttctaaacagaactaaatgacatgcatagnatgggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacaggatagtttaaaatatgtagccacggggaaaggggaggcatgtaaatgtcttgaagaggagaaaaagt

SEQ ID NO: 8585 - DNA, 400 bp, Homo sapiens
  misc_feature 77, 307, 313, 377: n = A,T,C or G
gaaaaagctggagctcgcgcgcctgaggtcgacactagtggatccaaagaattcggcacgagctcgtgccgggcttntgcgacgagcgcctcgtgcccttcgatcacgccgagagcacgtacggcctctaccggacgcattttctctccagactgccgatcccagaaagccaggtgatcaccattaaccccgagctgcctgtggaggaggcggctgaggactacgccaagaagctgagacaggcattccaaggggactccatcccggtttttcgacctgctgatcctgggggtgggccccgatggtnacaccntgctcactctttccagaccacccccttcctacaggagcgggagaagattggggctccaatcagngactccccgaagccacccgccac

SEQ ID NO: 8586 - DNA, 400 bp, Homo sapiens
  misc_feature 22, 24: n = A,T,C or G
gaaaaagctggagctccgcgcncntgcaggtcgacactagtggatccaaagaattcggcacgagcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaacggcacgagagtacttctagagcggccgcggccccatcgattttccacccgggtggggtaccaggtaagtgtcccaattc

SEQ ID NO: 8587 - DNA, 400 bp, Homo sapiens
gaacaataagctggagcctccgccgccgccttgcgggtcgacactagtggatccaaagaattcggcacgagactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaaggtgttg

SEQ ID NO: 8588 - DNA, 327 bp, Homo sapiens
  misc_feature 66: n = A,T,C or G
gacaaaagctggagctcgcgcgcttgcggtccgacactagtggatccaaagaattcggcacgagcntacgaggatctgaaaagacaaggactgctctagtgttgagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcaagggttgagatgtgttttatctgttttatattttaaaagattctgccagaaaataaaaccagaccttgttct

SEQ ID NO: 8589 - DNA, 333 bp, Homo sapiens
  misc_feature 7, 315: n = A,T,C or G
gacaatnttgctggagctccgcgcgcttgcaggtcgacactagtggatccaaagaattcggcacgagcttgggcttgcgggcccagttccagaggtggaagttacagaagaggaggtactgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaantaaactgaaaaaaaaaac

SEQ ID NO: 8590 - DNA, 199 bp, Homo sapiens
  misc_feature 91, 108, 113, 132, 144, 146: n = A,T,C or G
gacaataagctggagctcgcgcgcctgcaggtcgacactagtggatccaaagaattcggcacgagctcgtgccgaattcggcacgagctcntgtgcagacctgcgcgngtggncacctaaccatttaccggngggaggtgattncntctaaaaataaaatataacaaatctgagagagagtctagggtttcaggggctg

SEQ ID NO: 8591 - DNA, 400 bp, Homo sapiens
  misc_feature 17, 346: n = A,T,C or G
gacaaaagctggagctngcgcgcttgaggtcgacactagtggatccaaagaattcggcacgagcagcaaggctgtggattgctggtccataggtgtcatcgcctacatcttgctctgggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgagcacccatggattgcaggagatacagctctagataagaatatccaccagtcggngagtgagcagatcaagaagaactttgccaagagcaagtggaagcaagccttcaa

SEQ ID NO: 8592 - DNA, 331 bp, Homo sapiens
  misc_feature 39, 57, 64, 111: n = A,T,C or G
tacgagctcccctgggccactaaccatcctggcccgggntgcctgtctgacctccgngcctagncgtggctctccatcttgtctcctccccgtgtccccaatgtcttcagnggggggccccctcttgggtcccctcctctgccatcacctgaagacccccacgccaaacactgaatgtcacctgtgcctgccggcctcggtccaccttgcggcccgggtttgactcaactcagctcctttaacgctaatatttccggcaaaatcccatgcttgggttttgtctttaaccttgtaacgcttgcaatcccaataaagcattaaaagtcatgat

SEQ ID NO: 8593 - DNA, 317 bp, Homo sapiens
  misc_feature 273: n = A,T,C or G
gagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggcttccaagagtgtggcccgccgggncctccaagccctggagggctgaaaatggtggaaaaggaccaaga

SEQ ID NO: 8594 - DNA, 348 bp, Homo sapiens
ctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggttgaagggg

SEQ ID NO: 8595 - DNA, 100 bp, Homo sapiens
  misc_feature 10, 12: n = A,T,C or G
gcccgaattngncccgagtgaaggtgctccttgcccgccgccctcatcgcggggtccgggttcttcctgctgctgccgggagccttcggcggccgatgag

SEQ ID NO: 8596 - DNA, 237 bp, Homo sapiens
  misc_feature 25, 36, 38, 45, 66, 78, 112: n = A,T,C or G
cgcttgaggtcgacactagtggatncaaagaattcntnacgaggnggctcacaggccgggcgtggnggctcacgcctntctgtaatcctaggacttcgggaggccgaggcgngtgggttgcctgagctcaggagttcaagcctagtctgggcaacacggtgaaaccccttctctactaaaacacaaaaaaattaactgtgtgtgtcgtccagcctgagcaacagagtgagactccat

SEQ ID NO: 8597 - DNA, 500 bp, Homo sapiens
  misc_feature 3, 30, 41, 126, 162, 234, 362, 388, 428: n = A,T,C or G
cgngcgcttgaaggccgacactagtggatncaaagaatttngcacgagggtgaagcgagctgagaggctttgtcctcgtgccagtaactctgaaatctctcttaattcctgctgtccaggcagcanaatgccatggtttccccaagtaggtagctgctttancagttaaagcccaaatgtctgttctgttgatcagaggtctctgaatttctgaagtggtgtttcgtttctggngactgagttaatcctttacaatccctcttgtaaagtgtgctaatagaaagaatccacctttcaaagctgcagaaccagaccgtgccctaaattgaccaacgtaactgatgtgcctcaggaagtctctngccagctgtccctgtgaagacccccnctactcccccccagctgctgccttgcacacttgaagcatntcagactgtgcaaagccatgtagtcatcaagacagtaaatcccagggcttggttaagtgctgtgtgataact

SEQ ID NO: 8598 - DNA, 456 bp, Homo sapiens
  misc_feature 81, 202, 288, 376, 382, 400, 428, 454: n = A,T,C or G
gcattctcagccacaaccaaaaaaaaataaaaagggcagccctccttaccactgtggaagtccctcagaggccttggggcntgacccagtgaagatgcaggtttgaccaggaaagcagcgctggtggagggttggagaaggaggtaaaggatgagggttcatcatccctccctgcctaaggaagctaaaagcatggccctgntgcccctccctgcctccacccacagtggagagggctacaaaggaggacaagaccctctcaggctgtcccaagctcccaagagcttncagagctctgacccacagcctccaagtcaggtggggtggagtcccagagctgcacagggtttggcccaagtttctaagggaggacttnctcccntcgcccattagtgccagnccctgctggctggggcctgagcccttanacagcccccctgccccgaggcctgcntt

SEQ ID NO: 8599 - DNA, 488 bp, Homo sapiens
  misc_feature 7, 26, 37, 71, 148, 186, 235, 393, 440, 462: n = A,T,C or G
cgcttgnaggccgacactagtggatncaaagaatttngcacgaggagacgacgtgcacgaaatggcacctngaaaggggaaggaaaagaaggaagaacaggtcatcagcctcggacctcaggtggctgaaggagagaatgtatttggngtctgccatatctttgcatccttcaatgacacttttgnccatgtcactgatctttctggcaaggaaaccatctgccgtgtgactggngggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctgnggcccagtcggccctcagagcccttgcccgctcgggtatgaagatcnggcggattgaggatgtcacccncatcccctctgacagcactagcagga

SEQ ID NO: 8600 - DNA, 110 bp, Homo sapiens
  misc_feature 18, 20, 21, 22: n = A,T,C or G
tacttctagagcggccgngnnnccatcgattttccacccgggtggggtaccagggtaagtgtacccaattcgccctatagtgagtcgtattacaattcactgggccgaca

SEQ ID NO: 8601 - DNA, 445 bp, Homo sapiens
  misc_feature 27, 43, 87, 258, 426: n = A,T,C or G
gccaataaacaaaaacaactgtttggnttacctcagttgcagnagttattttcatttagaagttgttctcagattattgtttcagtnatatagaggattactaggactagttatgaagaaaccccactacattcaatggaattggggcttaaaatctcatcgatgtgctgtctctggagtgataagaaagggctacatctcccgaaatgatttctttacgtcatgtattggtttccttcttcaccttgaacttttgtngaactgtatgtactttaccccaaacctgttaatattttgagcgcttctatgtgaaagcaaagaaataattttaatactctggcattcataaattttattgatgagattatttattttaaaggtttgagggaacatctctggttgtaccaaagaagaaataaatatggnttcttaatctcttgcatgt

SEQ ID NO: 8602 - DNA, 298 bp, Homo sapiens
  misc_feature 24, 42, 66, 68, 204, 233: n = A,T,C or G
cttcttgggaaaaaaacctggttnttcgggcgcttgaggtcnacactagtggatccaaagaattcntnacgagggctatgggggcccctcacacagggggagtgaaacttggctggacagatcatcctcactcagttccctggtagcacagactgacagctgctcttgggctatagcttggggccaagatgtctcacaccctanaagcctagggctgggggagacagccctgnctgggagggggcgttgggtggcctctggtatttatttggcatttataaatatataaactcctttt

SEQ ID NO: 8603 - DNA, 496 bp, Homo sapiens
  misc_feature 22, 60, 113, 204, 210: n = A,T,C or G
acacattaactgcccgactagnggatccaaagattttttcgagaaaacgttcagcatctnctgagtcatcatcatcatcgtcaaagaagaagaaaacaaaggtagaacatggnggatcgtcaggctctaaacaaaattctgatcatagcaatggatcatttaacttgaaagctttgtcagggaagctctggatataagtttggngttctngctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaag

SEQ ID NO: 8604 - DNA, 161 bp, Homo sapiens
  misc_feature 24, 90: n = A,T,C or G
ctcgcctgcatctactcggccctnattctgcacgacgatgaggtgacagtcacggaggataagatcaatgccctcattaaagcagccggngtaaatgttgagcctttttggcctggcttgtttgcaaaggccctggccaacgtcaacattgggagcctcat

SEQ ID NO: 8605 - DNA, 457 bp, Homo sapiens
  misc_feature 11, 18, 31, 42, 222, 249, 302, 341, 347, 366, 388, 450: n = A,T,C or G
cgggcgcttgnaggtccnacactagtggatncaaagaattcntacgagcatacaagaacattttgctgagatggctgccatgtcttaagcgtccagactcaggtgccacatgggcttcctggaaggcctggccctcctggtccccccggccctcctggagagaatggtttcccaggccagatgggaattcgtggccttccgggcattaaggggccccctggngctcttggtttgaggggacctaaaggngacttgggagaaaagggggagcgtggccctccaggaagaggtcccaacggttngcctggagctataggtctcccaggtgacccaggccctgncagctnttggcaaaaaatggccganacggtgagccaaggccccccangggtggcaaggaattcctggagtgcctggaccccccggaacctcctgggcttcccgggtttntgggagc

SEQ ID NO: 8606 - DNA, 249 bp, Homo sapiens
  misc_feature 28, 29, 72, 73, 98, 242: n = A,T,C or G
ctttcctgggggaaaaaaacccctgttnnttggggcgccttgaggcccgacactagtggatccaaagaattnntgcacgagtataaccacaaattgtncgtgtgtgtgtgtgtttattgcaactaatactaatatgctgtttcaaccaaaacattcatctggaaggaagacaatttgctttaaaaaaaattccccaaggtgagcttttggggcttaccctgattctgcattgacttcttttncctccat

SEQ ID NO: 8607 - DNA, 497 bp, Homo sapiens
  misc_feature 17, 30, 41, 44, 69, 293, 295, 300: n = A,T,C or G
gggcgcttgcaggtccnacactagtggatncaaagaattcngtncgagattaaaaatgtccttgtgggntttttggaggaaggtaggtagaggtaagacagcatagaatcatgatgatgatgatgatgatgatttttattattattcagaatgattatttcttgtacaacccccaaaagtcaatagaatacaagacacaaaaagagagcataatttctatcaccagttagtagaggtgctggaaattatgctctctcaaaatttcaaaggaaatttcattacttgtgaaatgngnagggncttatattctgtattttacccatttttacagttgaaatggcacccagcagtatcttttgtgtagaaaacattcacagtaaatttgtgggttttaagattatagtttgagtttatccctcctctatgaagctgaaaaacagtacagaggagaaatttttaatatgtcaccgagacttgcaggataaggcagaacccag

SEQ ID NO: 8608 - DNA, 427 bp, Homo sapiens
  misc_feature 2, 377, 411: n = A,T,C or G
gnaactttacatgctttctcatgatttatttgcacatttagagtgctgtagacatagaaacatttccattttgatttattcatttagaaatatttattgagcacttacaatgtgaatatcagtaggtcccgcttatctgcaaggcaagagacatgctccacaacccccagtggatgcctgaaaccatggatagtaccagactctgtacagtatatgttatgttttttccatctgataattgaggcaggatatatagcgtgggtaaagctggacaaagagatgattcaggtccagggttagctggagcaggatggcttgagatttcaccttgcttctcagaacagcacataattaaaaacatatgaattgtgtatttntggaattttccatttaacattttcagactttggntgactgtaggtaaatg

SEQ ID NO: 8609 - DNA, 101 bp, Homo sapiens
  misc_feature 5, 8, 94: n = A,T,C or G
ggaanccngcttaattgcttttcaaaaagttgaatcaacctaagcatttaacactaggaagttgtttaaatcattgacagaatatccatcccgnggaaacc

SEQ ID NO: 8610 - DNA, 297 bp, Homo sapiens
  misc_feature 9, 15, 32, 54, 60, 167, 215, 246, 261: n = A,T,C or G
aaaaaaacncctgtntttggggcgcttgaggnccgacactagtggatccaaagnaatttnttacgaggttcggcgagagcatgaccgatggattccagttcgagtatggcggccagggctccgaccctgccgatgtggccaatccagctgaccttcctgcgcctgangtccaccgaggcctcccagaacatcacctaccactgcaagaacagcgnggcctacatggaccagcagactggcaacctnaagaaggccctgctnctccagggctccaacgagatcgagatccgcgccgag

SEQ ID NO: 8611 - DNA, 334 bp, Homo sapiens
  misc_feature 2, 20, 45, 47, 229, 265, 296: n = A,T,C or G
tncttgggcgcttgaggtcnacactagtggatccaaagaattcgntncgagcttcagctctaaggatattagcaacaatgataaaacttggccttgaagaaatttacacaactagttagaacttgttactattgtaaaggaagagtcaactggaaaattcaaggagttaataaaatttgtttactttggtcccagcttttgagagataaatcccttatgaatccctggnctaaaatactttcctacagctgtgtaaaatactggncaaggagaactttttccttttacctcatgtngtaaacttaagtggctcaataaaaattgatccactgtc

SEQ ID NO: 8612 - DNA, 152 bp, Homo sapiens
  misc_feature 20, 24, 78: n = A,T,C or G
ggttggggttttttgtgtcntggngtcaatctgagagtctttctctttcaatgaaggagttttacccattaatagtcnttgttataagataaatacactctctcatctataaaagtgatcttcaaaaaggttaagtaaaaggcatttcagga

SEQ ID NO: 8613 - DNA, 500 bp, Homo sapiens
  misc_feature 17, 23, 30, 35, 45, 58, 94, 215, 299, 310, 359, 422, 483,496, 497: n = A,T,C or G
cttcttgggaaaaaaancctggnttttcgngcgcntgcaggtccnacactagtggatncaaagaattcttacgagggcctctgggccgtttggnagtaatcacccaggggctggtaaagcccctcctcttggcacctcagaatcacagtgttactgatcagggatgtgaggctgctgttgggggtggggggaggggaatgggcaggcaagccagncttctgtcttcctttgctaacttagggttttgagcaggttggggtatggtgcctgtcatacccacctgccaccctgggaacctnactgttctctntttcagcctagacctgctgatccagggtgtgtgtgagttgagggtgggnggaggggtttgcagtgtgggaatgtggccctgcagttgacctgagctgcttcacatggttgtncattctggggcttaaagaactgggaccagaccaagtagaggccttggtgctggttgggggnggggcctgcagannctt

SEQ ID NO: 8614 - DNA, 183 bp, Homo sapiens
  misc_feature 100, 127, 155, 158: n = A,T,C or G
ggggcccattatggaccaggggaccttgccttgactgaggcactttcatgagctcagtgagaagggccctgtattcacctccactgcccccagggcctgnggacaaaccggctgggggactgcccancttcccacctgtttatttaacttatttnagngctttataataaaggaaaccctaac

SEQ ID NO: 8615 - DNA, 222 bp, Homo sapiens
  misc_feature 2, 20, 33, 53, 161, 181, 198, 202: n = A,T,C or G
tnttgggcgcttgaggtccnacactagtggatncaaagaattcggtacgaggntttaccaggggatagaaattgtaatcccctaaacatctctgctacattaaatggacttttgtatgtctcctttgaacactgattttttttttttaaattgtcaaactnggaaaaaagcaccagcgtgnccaagtttctctagggncttnatttcattttcaggttttca

SEQ ID NO: 8616 - DNA, 500 bp, Homo sapiens
  misc_feature 25, 146, 359, 440: n = A,T,C or G
tcgaggctagataggaacctctgcnccagaattgccaggataattattggagggtcataactattcttcatatttttttttcttttttctcctttggtttctgggttatctttcttaacctcacgtatttctttatcctttttagngggggcctgtaattcaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatatacctttngcattctttttctgataattgggctattaggcagaagacacaagttaccacgttgtgtattaaaagcagtaggtaggttgngccagtattttttcagccagtaagcatatacaggtaacttatataattaaaaattgggtt

SEQ ID NO: 8617 - DNA, 230 bp, Homo sapiens
ctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaac

SEQ ID NO: 8618 - DNA, 497 bp, Homo sapiens
  misc_feature 13, 225: n = A,T,C or G
gggcgcttgaggnccccactagtggatccaaagaattctttcgagcggaacctgtatccgggcccaacctgaaaacatcccagccaagaactggtataggagctccaaggacaagaaacacgtctggctaggagaaactatcaatgctggcagcctgtttgaatataatgtagaaggagtgacttccaaggaaatggctacccaacttgccttcatgcgcctgtnggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcgggg

SEQ ID NO: 8619 - DNA, 412 bp, Homo sapiens
  misc_feature 6, 42, 44, 80, 284, 323, 405: n = A,T,C or G
tgtgancttgaagatgcgacactagtggatccaaagaattcntnacgagagaagtcaaagctaaccgaggctgtgccttncgagacccccgggatggcccctgggaggccaaggagtcggggactgggtacccggagcagagtcactgtggccactggagaaccgcagcttgagctttatgaagccacgtggccacacctcccggtgcctccaccccaagcaaacacagatcgctcagaaaatgggaacccagggcaaattgtatgtgctcctttactgggttngttataagtgtcacatgttttttataataaaacataggngatttcaccttaaacacagttttcacacagcccctgctgcattctctgtccatctgtctgtttctattaataaagatttgtngatctgt

SEQ ID NO: 8620 - DNA, 496 bp, Homo sapiens
  misc_feature 2, 5, 30, 41, 122, 131, 189, 198, 222, 452: n = A,T,C or G
gngancttgaaatgcccacactagtggatncaaagaattcntttcgaggaaaagtgtgccatgaccgctctgagctccaagctgatctcccagcagaaagctttctttgctaagatggtggnggatgcagngatgatgctcgatgatttgctgcagcttaaaatgattggaatcaagaaggtacagggnggagccctngaggattctcagctggtagctggngttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtctngtccaaactccccattggggatgtggccacccagtactttgctg

SEQ ID NO: 8621 - DNA, 377 bp, Homo sapiens
  misc_feature 3, 12, 104, 118, 148, 190, 191, 197, 279, 280, 355: n = A,T,C or G
tgngagcacatnaagatgccccgactagtggatccaaagaattcttttcgagtagaagtctccctgcacagccctctagtgtccggggaccttgtgggaccagncccacaccgctggnccctgccctcccctgctcccaggttgaggngcgctcacctcagagcagggccaaagcacagctgggcatgcnntgtctngagcggcgcagagccctccaggcctgcaggggcaaaggggctggcttggagtctcagagcacagaggtaggagaactggggnncaagcccaggcttcctgggtcctgcctggccctccctcccaaggagccattctatgtgtgactctgggaggaagngcccaagcccctgcccctacgg

SEQ ID NO: 8622 - DNA, 251 bp, Homo sapiens
  misc_feature 2, 19, 106, 136, 149, 223: n = A,T,C or G
gnggctcatacctgtaacnccttgcactgtggggggccagaggtgagaggactgcttgaggccatggagctcaagaccagcctgggcaacatagaaagacctgggnggcatacacctgtggaccctactacttggnaggatgaggtggnaggattcatcacttgatcccaggagtttcaggctgcagtaagccatgatcacaccactgcacttcagcctgggngacagagccagaccatgtctcaaaaagt

SEQ ID NO: 8623 - DNA, 423 bp, Homo sapiens
  misc_feature 6, 19, 113, 141, 174, 308, 322, 345, 402, 419: n = A,T,C or G
caggtngaagcagataganggtaattttaaagttaatttattatgaatcattttcccctaatctgctaaatgaattagaactgattttaataaaaatattctgtgtaaaaagnactcagaaaaacatctaaagctgttggngaagagggactcatataaatagttggattgcgntttgctttttatttctttataaaaatatgtcaaaaacagtttttaattttagaaatcttatacttgaaagaaacctcaattatcagtggctttatgaagtaaagttaaaaacaaacataggaaatgtgaaaatntttgtgtttgtttngtctgactaacttgctgctaaangctatctttaggtgtgtgaaagttctttgatatgttattgtccttttacatcttgtnaaatagccattgctttngaga

SEQ ID NO: 8624 - DNA, 449 bp, Homo sapiens
  misc_feature 2, 17, 42, 52, 54, 82, 129, 170, 208, 210, 293, 366: n = A,T,C or G
gnccccactagtggatncaaagaattcttttcgagctggctngaagcctagngncttcataatgtaattcaatgaaaactgntggagaaatatttaaacacctcaatgtaggtacagttacactcttgntgcggggaggggatttaccagaatacagtttatttcgtganttctaaaaaacaaaaagatgaatctgtcagtgatatgngngtattataacttattaatcttgctgttgagctgtatacctggtttaaaaaatagtactgtttaatgctaagtaaggcagcagncatttgtgtattcaggctttttaaataaaattagagctgtaaggaaaatgaaaagccacaaatgcaagactgntcttaaatggaaggcatagtcagcgagggtaaatcctataccactttaggaagtattaaaaatatttttaagatttgaaatat

SEQ ID NO: 8625 - DNA, 500 bp, Homo sapiens
  misc_feature 2, 20, 36, 46, 48, 73, 145, 192, 275, 347, 440: n = A,T,C or G
tntttggggcgcttgaaggnccgacactagtggatncaaagaattntntacgagattcagccggcggttcggngcgacggactctccattccagaaccatggcccaatttgtccgtaaccttgtggagaagaccccggcgctggngaacgctgctgtgacttactcgaagcctcgattggccacattttggnactacgccaaggttgagctggttcctcccacccctgctgagatccctagagctattcagagcctgaaaaaaatagtcaatagngctcagactggtagcttcaaacagctcacagttaaggaagctgtgctgaatggtttggtggccacgtgaggngttgatgtggttttatgtcggagagattataggcaagcggggcatcattggctatgatgtttgaagaccaatctttaacatctgattatattngatttattaatttgagtgttggtggaccatgtgtgatcagactgctatctgaataaaata

SEQ ID NO: 8626 - DNA, 110 bp, Homo sapiens
tacttctagaagcggccggggccccatcgattttccacccgggtggggtaccagggtaagtgtacccaattcgccctatagtgagtcgtattacaattactgggccgaca

SEQ ID NO: 8627 - DNA, 362 bp, Homo sapiens
  misc_feature 1, 11, 31, 45, 93: n = A,T,C or G
ngggcgcttgnaggtcccacactagtggatncaaagaattctttncgagctctggcgtggtgaccaagcatgaagatgcagaggaccattgtnctccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 8628 - DNA, 496 bp, Homo sapiens
  misc_feature 4, 18, 23, 52, 63, 64, 66, 72, 101, 131, 161, 176, 482, 491: n = A,T,C or G
gggnacaaaaacccaggnttttngggcgcttgcaggtccacactagtggatncaaagaattcnntncgaggngaacctcagccagcaccatctgggtcctntcccggcctccccactccttgtgtaactgngtcagtagcccagacccccatgtagtcggngttattggggctttngcaccaaaagaactgaatgttttgttttttgggtggccttgactatatatcaagacatcagccaccaacacaattgtctaaaatttaagaccatcctgactaacaaggatgttaaaatacacattaatgtacttacattccaggattacttagagctaatcctgcagggttgaatctctctagaagccctgctccctgagcttagagtgtcttagcacctgataccagtccgtttagacaggtgtttggaggaacgaagaatagaaatggacaaaagatcaaaacgggtccatagctattactcanaagagctgngcaag

SEQ ID NO: 8629 - DNA, 492 bp, Homo sapiens
  misc_feature 2, 18, 34, 230, 281, 323, 354, 355, 420, 432: n = A,T,C or G
cntttgcctacataagtnctcatttatttgtgtnttatttattacagggctgctattttcataatgtacatgaacaatgtcacagaacttttttaatttttttgaataattataagtatcagtaaaggaagtgaaagacaggattgcatttaatagataaaacgtttaggcgataattgaacaaaagaatcctggcatatttctaacactaatggcaatttacttatggnatttattttcagtagtaaagacccagcttgaatgtaaattttgtatagtgnaagtatgaagaacatagtgcaactgtacaggtagtcaccagntattgtgatatgataaataattgggctattnngatgaagaaaactttgttcatttgtttctactttctaagagaaattgccacgattcctctgcttntcaacatttcgnatgacttttttttcgggtgggaataaaaagctgtgaaattgttcaacctactttgtaacc

SEQ ID NO: 8630 - DNA, 100 bp, Homo sapiens
  misc_feature 10, 11, 49, 58, 68, 72, 98: n = A,T,C or G
gcgggagcgnnccaaatgaagtttaatccctttgtgacttccgaccgangcaagaatngcaaaaggcntttnaatgccccttcccacattcgaagganga

SEQ ID NO: 8631 - DNA, 175 bp, Homo sapiens
  misc_feature 36, 53, 54, 60, 135: n = A,T,C or G
gtcaaaataaatggattatcacctgaggcttggaantcttacatggtaatatnnatttantgagactttgcctttactgcagagtagaagcaatcttccctttagaaataaattctgaaagtttacctgtaattntgatatttgaaatttaggttatgttgtatagaaactatgt

SEQ ID NO: 8632 - DNA, 470 bp, Homo sapiens
  misc_feature 4, 41, 71, 73, 294: n = A,T,C or G
cttntttggggaaaaaaaaccctggtttttcgggcgcttgnaggtcgacactagtggatccaaagaattcntnacgaggacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgncatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaat

SEQ ID NO: 8633 - DNA, 110 bp, Homo sapiens
  misc_feature 1, 18, 20, 81: n = A,T,C or G
nacttctagagcggccgngngcccatcgattttccacccgggtggggtaccagggtaagtgtacccaattcgccctatagngagtcgtattacaattcactgggccgaca

SEQ ID NO: 8634 - DNA, 498 bp, Homo sapiens
  misc_feature 1, 11, 41, 43, 101, 395, 425, 446, 457, 493: n = A,T,C or G
ngggcgcttgnaggcccacactagtggatccaaagaatttntnacgagccgacaggatgggcaagtgtcgtggacttcgtactgctaggaagctccgtagncaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttgggcgcaaaggtcatgctgttggngatattcctggagtccgctttaaggttgtnaaaagtagccaatgtttcttnttttggccctntacaaaggcaagaaggaaagaccaagatcataaatnttaat

SEQ ID NO: 8635 - DNA, 175 bp, Homo sapiens
  misc_feature 5, 103, 109, 136, 151, 171, 173: n = A,T,C or G
ctggngtgagtcaaatgccccctgagtgactgcccccagcccaggccagaagacctcccttcaggtgccgggcgcaggaactgtgtgtgtcctacacaatggngctatnctgtgtcaaacacctttgttttttttnaaaacatcaatgggntattaaaaatgaaaagattntngg

SEQ ID NO: 8636 - DNA, 495 bp, Homo sapiens
  misc_feature 100, 124, 128, 224, 244, 262, 283, 305, 350: n = A,T,C or G
atttaattaagacatgcccacattatttcttacttttcaaggaacaacatgttttacgacttgagattatctgtctagtgaccttagagctgcacagctngagaaacagagtcttcacaatgcntggnatgagggagagatgagtctcactagccacagagagaaaaacaggcagttaattttaaaggactccagccctttctcttcctcaaggggaattgggntttcttacatacaactgagnttttgcttacacagtctntaatttcttttaattcctgtnccataatgacaaaggggccagntcaccaggaagatataacggttatatctgcatctgacagcagagngctcaaatgtgtgacataaacgtttagaggattgaagggagacatagtagcacaatgtaaataggggactgtctgaccttgtatgtagagaaccctaaagatcccaaacacacaaaaaatgttacagctcatgaacaaattcagc

SEQ ID NO: 8637 - DNA, 101 bp, Homo sapiens
  misc_feature 2, 44, 55, 69, 83, 87: n = A,T,C or G
tntgccctttttagcaagaaagagcaggcctcagagccttctgnctagatagaangaatgatatagtgntgtggcatggtatntatntaattaattacctt

SEQ ID NO: 8638 - DNA, 104 bp, Homo sapiens
  misc_feature 24, 26, 59, 75: n = A,T,C or G
cactagtggatccaaagaattctntncgaggaatttatcaatgtgcctgtcccacagtnagcagatagggatccngccaacagttgctcatgactttaacaaga

SEQ ID NO: 8639 - DNA, 156 bp, Homo sapiens
  misc_feature 33, 110: n = A,T,C or G
caaacgggccctcaaatttatcaagaaaagggnggggacgcacatccgcgccaagaggaagcgggaggagctgagcaacgtactggccgccatgaggaaagctgctgccnagaaagactgagcccctcccctgccctctccctgaaataaagaaca

SEQ ID NO: 8640 - DNA, 491 bp, Homo sapiens
  misc_feature 33, 35, 37, 53, 64, 175, 232, 245, 260, 308, 432, 441, 470: n = A,T,C or G
cttgggaaaaaaacccggattttgggcgcttgnangncccacactagtggatncaaagaattcntttcgagggcgagagcatgaccgatggattccagttcgagtatggcggccagggctccgaccctgccgatgtggccatccagctgaccttcctgcgcctgatgtccaccgnggcctcccagaacatcacctaccactgcaagaacagcgtggcctacatggaccagcngactggcaacctnaagaaggccctgctnctccagggctccaacgagatcgagatccgcgccgagggcaacagccgnttcacctacagcgtcactgtcgatggctgcacgagtcacaccggagcctggggcaagacagtgattgaatacaaaaccaccaaagacctcccgcctgcccatcattcgatgtggccccctttgnacgtttggngccccagaccaggaattcggcttcgacgnttggccctgtctgcttcctgg

SEQ ID NO: 8641 - DNA, 118 bp, Homo sapiens
  misc_feature 21, 29, 32: n = A,T,C or G
caagcaatgtgtctgtcaagnatgttcgncgnggcaaccgttgctggtgacagcaaaaatgacccaccaatggaagcagctggcttcactgctcaggtgattatcctgaaccatcagc

SEQ ID NO: 8642 - DNA, 374 bp, Homo sapiens
  misc_feature 26, 32, 45, 71, 73, 109, 114, 154, 315, 348, 362: n = A,T,C or G
acttttttggggaaaaaaacccctgntttttngggcgcttgaggnccgacactagtggatccaaagaattntncacgagtaaggaacaaatgaaaactctgggctgggnggagnggctcatacctgtaatcccagcactttgggaggctacggngggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggnggaggttgcattcaactgagatcataccacttnattccagcctgggngacagagcaaga

SEQ ID NO: 8643 - DNA, 500 bp, Homo sapiens
  misc_feature 5, 11, 30, 41, 44, 50, 109, 483: n = A,T,C or G
tgggngcttgnagggccccactagtggatncaaagaattcnttncgaggnttatttttgtaaatcaagttacaccagaacacaggcacatccatttctttgcatattgnctatgggtgttttcaaacttcgatggcagagttgagttgttacaaaagagaatgtttgaagcccagtctatttactattttttataaactaggaaaagtttgcaagacccctgataatccaactttttctatatcgtacaggggagaaagcaaagcccagagagggaaaatgactcaaaggcacgtgaacattccacaatggggcagggcttcaccccttacctgctccttgcagtacattgcacctcagtttactcaatggggtgagacggtaaaagggattctacctatcagcatggactcagcttccatttcacaatgagtcactcatctccatcaagggcacaggaaggccctgaagagagggcaaggcncaaggaaaaagatcaca

SEQ ID NO: 8644 - DNA, 156 bp, Homo sapiens
  misc_feature 39, 60, 94, 144, 149, 154: n = A,T,C or G
actgcaaaataaaatctcggagttctatttatttattgncttcctgtaagaccttcgggncaaggcagaggcagggaaactaactggtgtgagncaaatgccccctgagtgactgcccccagcccggcaaaaaaaaaacctctnttttngtccngg

SEQ ID NO: 8645 - DNA, 500 bp, Homo sapiens
  misc_feature 25, 50, 66, 85, 148, 270: n = A,T,C or G
cttcttggggacaaaaacccggatnttgggggcttgaggaccccactagnggatccaaagaattcnttcgagcccgatatggcgnttccccgcataaacaacataagcttctgactcttacctccctctctcctactcctgctcgcantgtgctatagtggaggccggagcaggaacaggttgaacagtctaccctcccttagcagggaactactcccaccctggagcctccgtagacctaaccatcttctccttacacctagcaggtgnctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctatacc

SEQ ID NO: 8646 - DNA, 262 bp, Homo sapiens
  misc_feature 20, 24, 28, 38, 57, 67, 70, 206, 247: n = A,T,C or G
cttcttgggaaaaaaccccnggtntttngggcgcttgnaggtccacactagtggatncaaagaattnttncgagaatttttcttctgtaccatttagcactcccactaagcacttgataattctagttgctctacattctgaccaaaatttggagccaggtgaggtgcttcacgcctgtaatccctgcactttgggaggcccaggngggagaatcagctgaggccaggagttcaagaccggcctggncaacatagccagacc

SEQ ID NO: 8647 - DNA, 215 bp, Homo sapiens
  misc_feature 7, 9, 38, 51, 57, 104, 111, 114: n = A,T,C or G
cgcttgnangtcccacactagtggatccaaagaattcntttcgagcttggntttagntatgtggaactttagcatgggcgacttcatttctgtgtgttttttgntgttgtngtnttgagacagtttctctctgtcacccaagttagaatgcagtggcgcgatcatagcctcacttgcagtctggcctgccaggttcaacacattctcatgcttta

SEQ ID NO: 8648 - DNA, 424 bp, Homo sapiens
  misc_feature 17, 29, 67, 144, 172, 227, 315: n = A,T,C or G
gggcgcttgaaggtccncactagtggatncaaagaattcgtttcgagaaaacttccaaggccctgcnttttttcttaaaagtactttaaaaaggaaatttggttgtattttttatttacattttatatttttgtacatattgtnagggtcagccatttttaatgatctcggntgaccaaaccagccttcggagcgttctctgtcctacttctgactttacttgtggngtgaccatgttcattataatctcaaaggagaaaaaaaaccttgtaaaaaaagcaaaaatgacaacagaaaaacaatctattccgagcnttccagtaacttttttgtgtatgtacttagctgtactataagtagttggtttgtatgagatggttaaaaaggccaaagataaaaggtttctttttttttccttttttgc

SEQ ID NO: 8649 - DNA, 228 bp, Homo sapiens
  misc_feature 26, 37, 40, 66, 131, 158: n = A,T,C or G
cgcttgcaggtcgacactagtggatncaaagaattcnttncgagcaggaaactaactggtgtgagncaaatgccccctgagtgactgcccccagcccaggccagaagacctcccttcaggtgccgggcgcnggaactgtgtgtgtcctacacaatggngctattctgtgtcaaacacctctgtattttttaaaacatcaattgatattaaaaatgaaaagattattgg

SEQ ID NO: 8650 - DNA, 416 bp, Homo sapiens
  misc_feature 7, 11, 27, 33, 38, 40, 41, 293, 302, 329, 374, 393, 395, 411: n = A,T,C or G
cgcttgnaggnccgacactagtggatncaaagnaattntnncacgagggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcnccccatgcngttgattgctaaatgtaacagtctgancgtgacgctgaataaatgtcttttttttaaaaaaaagagtacttntagagcggccgggggcccntngattttccacccgggnggggt

SEQ ID NO: 8651 - DNA, 496 bp, Homo sapiens
  misc_feature 5, 20, 65, 96, 99, 129, 212, 256, 291: n = A,T,C or G
ggtgntcgatgagtatctgnagaccacagggaagccgattgaagccagcatccgaggggagctgnctggggactttgagaagctaatgctggccgnagngaagtgtatccggagcaccccggaatattntgctgaaaggctcttcaaggctatgaagggcctggggactcgggacaacaccctgatccgcatcatggtctcccgtagtgagntggacatgctcgacattcgggagatcttccggaccaagtatganaagtccctctacagcatgatcaagaatgacacctntggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcactgcggaaagccatgaaggga

SEQ ID NO: 8652 - DNA, 328 bp, Homo sapiens
  misc_feature 11, 31, 45, 92, 95, 101, 172, 221: n = A,T,C or G
cgggcgcttgnaggtccgacactagtggatncaaagaattctttncgagattccatcagggtgggaatcacatactcattgttggctagcgngtntgcagngcctaggacagaacctggcacttgataggcatttactgaatattttttgaataaaagaagaacgaaatggntgacagtaaataagtcttttaaaaacgttgaatcaaggctgggcatagnggctcatacctgtaatcccaacactttggaaggcagaggtgggagggttgcatgtgcttaggagttcaaaaccatcctgagcaatgtagtgagacctcgtctccacc

SEQ ID NO: 8653 - DNA, 310 bp, Homo sapiens
  misc_feature 11, 14, 39, 42, 77, 144, 236: n = A,T,C or G
ggggcgcttgnggnccacactagtggatccaaagaattnttncgagcttgtctgtggctgaaacacttacctgctgnggaaagccgagcaaggaggaggtaaacattggagatgtttgtgaaaatattactcttgctgtgaggntttagtttgttttgaatgagaaaagactaagtaacttaatccatctcaatgtagtgttttaataaaaaaggaacctaatatttgaaatgggnctcagacatgtctacaaatatgggtactatttttatgcccgtgtattttcacatttaataaaaatatttatggt

SEQ ID NO: 8654 - DNA, 397 bp, Homo sapiens
  misc_feature 122, 235, 327, 334, 350, 364, 368, 383: n = A,T,C or G
cgaaggtgaggagcctgagaacttcttctgggtgggcattggggcacagaagccctatgatgacgatgccgagtacatgaaacacacacgtctcttccggtgctccaacgagaagggctacntttgcagtgactgagaaatgctccgacttttgccaagatgacctggcagatgatgacatcatgttgctagacaatggccaagaggtctacatgtgggtggggacccagactanccaggtggagatcaagctgagcctgaaggcctgccaggtatatatccagcacatgcggtccaaggaacatgagcggccgcgccggctgcccntggtccncaaggccaatgagcancacgcctttacccnttgntccatgcttggagcnccttttgcaaggcc

SEQ ID NO: 8655 - DNA, 206 bp, Homo sapiens
  misc_feature 3, 36, 91, 94, 116, 168: n = A,T,C or G
acnctttggggaaaaaaaccctggttttcgggcgcntgcaggtcgacactagtggatccaaagtttttttttttaccattttactcttttnatnctgctcattaatgatctgaaanaagaagatggggaaaaggggattccaccacaaggctccaaagaaccaagagngcaaatcagcccatttcactttcactgtctgagatagg

SEQ ID NO: 8656 - DNA, 282 bp, Homo sapiens
  misc_feature 8, 16, 255, 265: n = A,T,C or G
gcagcagnagagaganagagaaagagacagacagagatggacagagagacagagacagagagagaaacagacagacagggagggagggacggagacaggcagagagagagagacaggcagacagccagagaaagagagtaagacagaagataggcacagaaagagagacagacacagagagagacagagagacagagaaaaagaaagagagagacagacagacagagaaagagacagacagagagagagagaggnagagagaganacagacagacagggaga

SEQ ID NO: 8657 - DNA, 430 bp, Homo sapiens
  misc_feature 27, 33, 38, 51, 64, 86, 147, 277, 346: n = A,T,C or G
tgggaacaaaaacccaggttttcgggngcttgnggtcnacactagtggatncaaagaattcttncgagtgaaatcatgactgaccnaggcagtcggcaagaaaaggggctttgcctttgtaacctttgatgatcatgactccgtggntaagactgtcattcagaaataccatactgtgaatggccacaactgtgaaattaggaaaggcctgtcaaagcaagagatggtgagtgcttcatccagccaaagaggtcaaagtacttctggaaactttggnggtggtcgtggaggtggtttcggtaggaatgacaactttggttgtgaaggaaatttcagtggtcatggnggctttggtggcagctgtggtggtggtggatatcgtgcagtggggatggctataatggatttggtaatgatggaagcaattttg

SEQ ID NO: 8658 - DNA, 417 bp, Homo sapiens
  misc_feature 18, 64, 70, 119, 193, 263, 280, 290, 306: n = A,T,C or G
tacgagcgcggccgcggnttcagccctggaggagctcagggtggccggcattcacaagaaaggnggcccnggaccatcggcatttctgtggatccgaggaggcggaacaagtccacggngcccctgcaggccaacgtgcagcgggttgaaggagtaccggttccaaactcatcctcttccccaggaagccctnggcccccaagaagggagacagttctgctgaagaactgaaactggccacccagctgaccggaccggcattncccgtccggaacgtctntaagaagganaaagctcgagtcctcnctgaggaagagagaatttcaaagccttcgctagtctccgtatggcccgtgccaccgcccggtttttgggtttcgggcaaaaaggacccagggagcccgagaacaggatgtt

SEQ ID NO: 8659 - DNA, 201 bp, Homo sapiens
  misc_feature 15, 128, 156, 192: n = A,T,C or G
cccccctgggccccnaggacccccaggctccattggtcaccctggcgctcgaggaccccccggataccgcggtcccactggggagctgggagaccccgggcccagaggaaaccagggtgacagagganacaaaggcgcggcaaggagcagggctgnacgggcctgaaggagaccaggggcccaaggaccccnaaggcgtgc

SEQ ID NO: 8660 - DNA, 313 bp, Homo sapiens
  misc_feature 36, 214, 255, 256: n = A,T,C or G
atttattcaagtgtctattgcttaattgttaattgngagcagatttattgaatgcctattctattttctgcagtttacaatacaataactctttgagtaagttgaagtttaattgtgcaacaaatttgtattaggagtacaatttaaagtgtttttctctatagccttttttgactggggaagcaaggggtaatgttaattagtacactttgtncttgtactagctatgtttctataagatatggagccctgtgnntcccagagatgctagaaaactgttctttgctcctatttgtgggttctgtttttgtgg

SEQ ID NO: 8661 - DNA, 495 bp, Homo sapiens
  misc_feature 8, 31, 41, 43, 144, 186, 281, 288, 303, 427, 449, 481: n = A,T,C or G
cgggcgcntgcaggtccgacactagtggatncaaagaattntncacgagtcactgtgttagccaggatggtctcgatttcctgacctcgtgatccgcccacctcggcctcccaaagtgctgggattacaggcgtgagccaccgngcccgaccttattccagttttgaaatgatcacactggtagtncctcactgttcgctgatgagggccacagttctaaggagactggggaaggaatcaggagtccttctggcagtcaggatcagtttctacctggctgngtatggngccagcaagtgtggncacctataggccccagtctcccagtgggtcaggcagcagggcaaggtgagctgtgaggaacccttagctccccaagagcctctgacctaagggaagtgtttctctggtgaaactgcctggcttnggtctcaactcccacccttgtngctgcaaacaaaccactcctctctgagctctnataatactgcactt

SEQ ID NO: 8662 - DNA, 399 bp, Homo sapiens
  misc_feature 5, 18, 29, 32, 53, 151, 229, 260, 271, 278, 313, 314, 330,362, 382, 393: n = A,T,C or G
gtccnacactagtggatncaaagaattcnttncgagggattccagttcgagtntggcggccaggggtccgaccctgccgatgtggccatccagctgaccttcctgcgcctgatgtccaccgaggcctcccagaacatcacctaccactgcnagaacagcgtggcctacatggaccagcagactggcaacctcaagaaggccctgctgctccagggctccaacgagatcnagatccgcgccgagggcaacaagccggtttnacctacagcgncactgtngatggctgcacgagtcacaccggagcctggggcannaaagtgattgaatacnaaacaccaagacctcccgcctgcccattattnaatgtggcccccttggacgntggggccccanaacaag

SEQ ID NO: 8663 - DNA, 384 bp, Homo sapiens
  misc_feature 4, 11, 33: n = A,T,C or G
aatnttttggnaaaaaaaaccctggtttttcgngcgcttgcaggtcgacactagtggatccaaagattcggtacgagtcttactgggttggtgaagattccacatacaaattttttgaggttatcctcattgatccattccataaagctatcagaagaaatcctgacacccagtggatcaccaaaccagtccacaagcacagggagatgcgtgggctcgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaattta

SEQ ID NO: 8664 - DNA, 245 bp, Homo sapiens
  misc_feature 11, 41, 123, 142, 206: n = A,T,C or G
ggggcgcttgnaggccgacactagtggatccaaagaatttngcacgagtcttgggtcccctcctctgccatcacctgaagacccccacgccaaacactgaatgtcacctgtgcctgccgcctnggtccaccttgcggcccgngtttgactcaactcagctcctttaacgctaatatttccggcaaaatcccatgcttgggttttgnctttagccttgtaacgcttgcaatcccaataaagcatta

SEQ ID NO: 8665 - DNA, 323 bp, Homo sapiens
  misc_feature 55, 62, 89, 95, 120, 176, 201, 284: n = A,T,C or G
gaactagtctcgagttttttttttatcagaatggcaacagacagaagtactttgnagagatngacttcctaagctacttaagacaactngccccnctaagaaaaaaatgtagaaccattnggaaaaatgaaatttagtagttccaagtttcaaagaaatgtcaacattttattccnttcaataaagaacaaaaccaatagngtttttattactttcatctgaaacattccatgttttaatctgagccttgcagactttcatttggagtttgaacccgttttggntgcatttcatttttggagaacttaattaacgtgagattg

SEQ ID NO: 8666 - DNA, 428 bp, Homo sapiens
  misc_feature 20, 23, 28, 73, 174, 312: n = A,T,C or G
cgcgagataaaatataggantanccttnggaaacatatcaagaagacatgcgtggtggagaaaacaagccagnctccacctttggcaaccttggtgaaaaaatgaatggaataatcatggtgtctgggatggagggatggcccctacatgtatcacgtaggggccgtgtatcangttccttgcatgggctatcaacagcaaggactgatgccaagtcctacttttggcaccatcaattgaagaccagtgaatcagtttttggtaagttggaggagagactattcatcctcactggaatagatacataatttnttatgagtttgccttccctgctgacagccttttggcaagcaacagcgtggaagaatcagggaatatctagattatcagcatgggatattacagatattatactggaccaggggagc

SEQ ID NO: 8667 - DNA, 360 bp, Homo sapiens
  misc_feature 112, 174, 206, 235, 344, 353, 356: n = A,T,C or G
cctactggaaaaagagtggaaatttattaaaatctgaaagtatgagatcctgttatgttaagggaaatccaaattcccaattttttttggtctttttaggaaagattgttgnggtaaaaagtgttagtataaaaatgataatttacttgtagtcttttatgattacaccaatgnattctagaaatagttatgtcttaggaaattgnggtttaatttttgacttttacaggtaagngcaaaggagaagtggtttcatgaaatgttctaatgtataataacatttaccttcagcctccatcagaatggaacgagttttgagtaatcaggaagtatatctatatgancttgatatngtnttat

SEQ ID NO: 8668 - DNA, 289 bp, Homo sapiens
  misc_feature 121, 143, 210, 247, 257: n = A,T,C or G
tacaagcattgcttttggcaaattaaagtgcatgtcatttcttaatacactagaaaggggaaataaattaaagtacacaagtccaagtctaaaactttagtacttttccatgcagatttgngcacatgtgagagggtgtccangtttgtctagtgattgttatttagagagttggaccactattgtgtgttgctaatcattgactgtagncccaaaaaagccttgtgaaaatgttatgccctatgtnacagcagagnaacataaaataaaagtacattttataaaccat

SEQ ID NO: 8669 - DNA, 110 bp, Homo sapiens
  misc_feature 77, 104, 108: n = A,T,C or G
tacttctagagcggccgagggcccatcgattttccacccgggtggggtaccagggtaagtgtacccaattcgccctntagtgagtcgtattacaattcactggnccgnca

SEQ ID NO: 8670 - DNA, 427 bp, Homo sapiens
  misc_feature 13, 19, 98, 326, 410: n = A,T,C or G
ctgtgaaaatggntcgctnttcacttgacccggagaaccccacgaaatcatgcaaatcaagaggttccaatcttcgtgttcactttaagaacactcgngaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgttgcacatgcttaaaaacgcagagagtaatgctgaacttaagggnttagatgtagattctctggtcattgagcatatccaagtgaacaaagcacctaagatgcgccgccggacctacagagctcatggncggattaacccatacat

SEQ ID NO: 8671 - DNA, 359 bp, Homo sapiens
  misc_feature 56, 81, 176, 206, 233: n = A,T,C or G
cagatcagcacattaagcaggtttgcatgagagtcatacaagaacattttgctganatggctgccagtcttaagcgtccanactcaggtgccactgggcttcctggaaggcctggccctcctggtccccccggccctcctggagagaatggtttcccaggccagatgggaattcgnggccttccgggcattaaggggccccctggngctcttggtttgaggggacctaaaggngacttgggagaaaagggggagcgtggccctccaggaagaggtcccaacggtttgcctggagctataggtctcccaggtgacccaggccctgccagctatggcagaaatggccgagacggtgagcga

SEQ ID NO: 8672 - DNA, 449 bp, Homo sapiens
  misc_feature 86, 131, 352, 439: n = A,T,C or G
ggttatcaataagctcctagtccagacgccatgggtcatttcacagaggaggacaaggctactatcacaagcctgtggggcaaggngaatgtggaagatgctggaggagaaaccctgggaaggctcctggntgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgngaaatgtgctggtgaccgttttggcaatccatttcggcaaagaattcacccctgaggtgcaggcttcctggcagaagatggtgactngcagtggcca

SEQ ID NO: 8673 - DNA, 500 bp, Homo sapiens
  misc_feature 3, 5, 32, 58, 64, 113, 139, 175, 194, 223, 241, 333, 338,362, 377, 407, 409, 411, 450, 470, 480: n = A,T,C or G
gtntnacattactgcccgctggcggatccaangaattttttcgagagaaagcttaggntattgntgtaaaacctgcagaggaagaacatttggatcacaaattataaattttntgtcttgctgattaattgctaccttngtaaagcactcttcccttttgctttgaggagcctgnattatatatacataggctngtaactccatgcgtgatacaatacctggnaccttctgggcgttcagntaatgttgatgtagccaagtcatagagtccatatttgtattttcataagtccagaataacacacttacctatttaaagaattccaactgagngtggncaaaaaccctgacaggtataaatngtgaaaaggtctagncttcatttttctccccatatgaactccttngngngctaatgataagcatgttcattgtaaatatggattttgnggcattcactatgtatcgtnccatggcagntagttgtaagtattctctta

SEQ ID NO: 8674 - DNA, 424 bp, Homo sapiens
tctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttcttt

SEQ ID NO: 8675 - DNA, 258 bp, Homo sapiens
  misc_feature 164, 171, 197, 199: n = A,T,C or G
atcaattccctggtgcggtaccagtgcacagaggggtttgtccagcgccacatgcccaccatccggtgccagcccagcgggcacatgggaggagcctcagatcacctgcacagaccccaccacctacaaacgcagactacagaagcggagctcacggcaccctnggagganccgccccagcacagcccactgagaanancttccaggacgcacccaggacgctgagcccaggagcctgccaggctgacgtgcatccca

SEQ ID NO: 8676 - DNA, 469 bp, Homo sapiens
  misc_feature 2, 5, 29, 30, 32, 205, 226, 424, 453: n = A,T,C or G
angcnacactagtggatccaaagaattcnntncgagccggcgccggagggggcccggggtacccagcccccagcccgacgtgaccatgctgtcccgcctcctaaaagaacaccaggccaagcaggaatgaacgcaaggagcttgcagggaaaagaggaggcgagaggctatcacttgcagcgaccctgcctgacagaagctttgnaggatcacctcaatgtggggngtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactganctggaatatgtctacaaagggcagctggngtcttgccctttccta

SEQ ID NO: 8677 - DNA, 116 bp, Homo sapiens
  misc_feature 85, 108: n = A,T,C or G
ggggcgccaaggagctaaagaacatccacgtgtgcctgggtggcctgttcgtgcctgaggcgtacatcactgccaccaggcagtntggggcccaggccaacagctggnccctggag

SEQ ID NO: 8678 - DNA, 402 bp, Homo sapiens
  misc_feature 3, 6, 27, 51, 54, 86, 91, 118, 195, 227: n = A,T,C or G
ccnggnccttgggcgcttgcaggtccnacactagtggatccaaagaattcngtncgagcataaaatcatatattcctgttgaagtnctttngaagtcctatctctatttattatattngaaagttggcaagccaccagtcatccagaatttccttcctgaatctccatgctcatatgcaatgtctacatcaaggncttcttaatgactattattctcagggtttagntttctaccttctgcctactattttggtctgacatttttgtagccttctgttattattggaaataggctcttacataagctgatttcgagaactttcaaaatctcacatagctaatggaagttgctttctgctttcttatgactgtttttataaataaactgtttcataaataatg

SEQ ID NO: 8679 - DNA, 496 bp, Homo sapiens
  misc_feature 9, 13, 28, 77, 386, 412, 461: n = A,T,C or G
tctttgggnaaanaacccctgttttttngggcgcttgaaggccgacactagtggatccaaagaattttgcacgaggncatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatnaaatcttggatttggggctgaggggngggagggagggcagagctctgcacactcaaaggctaaactggtgtcagnccttttttcctttgttccaaataaaagattaaacc

SEQ ID NO: 8680 - DNA, 320 bp, Homo sapiens
  misc_feature 2, 30, 36, 42, 124, 138, 148, 201: n = A,T,C or G
tngggcgcttgaggccgacactagtggatncaaagnaatttngcacgaggggttggaaagtccaagccgtaggacccagtttcctttcttagctgatgtctttggccagaacaccgtgggctgntacttgctttgagntggaagcggnttgactttacgcctgtaaatgtattcattcttaatttatgtaaggtttttttngtacgcaattctcgattctttgaagagatgacaacaaattttggttttctactgttatgtgagaacattaggccccagcaacacgtcattgtgtaaggaaaaataaaagtgctgccgta

SEQ ID NO: 8681 - DNA, 415 bp, Homo sapiens
  misc_feature 67, 130, 158, 189, 255, 351: n = A,T,C or G
tcgagcaggcactcagaatggtccagcgtttgacataccgacgtaggctttcctacaatacagcctntaacaaaactaggctgtcccgaacccctggtaatagaattgtttacctttataccaagaaggntgggaaagcaccaaaatctgcatgtggngtgtgcccaggcagacttcgaggggttcggngctgtaagacctaaagttcttatgagattgtccaaaacaaagaaacatgtcagcagggcctatggnggttccatgtgtgctaaatgtgttcgtgacaggatcaagcgtgctttccttatcgaggagcagaaaatcgttgtgaaagtgttgaaggcacaagcncagagtcagaaagctaaataaaaaaatgaaacttttttgagtaataaaaatgaaaagacgctgt

SEQ ID NO: 8682 - DNA, 178 bp, Homo sapiens
  misc_feature 3, 7, 159: n = A,T,C or G
tgngagncttgaagatgcgacactagtggatccaaagattcgtttcgagctccttcaaagaagttttatttttggtccagagtacttgttttcccgatgtgtccagccagctccgcagcagcttttcaaaatgcactatgcctgattgctgatcgggtnttaactttttcttttcctg

SEQ ID NO: 8683 - DNA, 103 bp, Homo sapiens
tacttctagagcggccgagggcccatcgattttccacccgggtggggtaccagggtaagtgtacccaattcgccctatagtgagtcgtattacaattcactgg

SEQ ID NO: 8684 - DNA, 420 bp, Homo sapiens
  misc_feature 169, 220, 314, 373, 399: n = A,T,C or G
cccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtntttgaagccgtgtacagcccaccgcctgccgacttgtgtaatgccctacgntggtataatcacatcaagtcttacgaaaaggaaaaggccagcctgccaggagtgaagaaagctttgggcaaatatggtcctgccgatgtggaanacactacaggaagtggagctacagatagtaaaagatgatgatgacattgacctctttgnatctgatgatgaggaggaaagtgaanaagcaaagaggctaagggaag

SEQ ID NO: 8685 - DNA, 483 bp, Homo sapiens
  misc_feature 4, 20, 66, 233, 339, 405, 454, 461, 481: n = A,T,C or G
gggnaaaaaaacccaggatntttcgggcgcttgcaggtccgacactagtggatccaaagaattcgntacgaggaatatatcatcactaactgtagtcaccatgctatacagtagagctcttgaacttattcctgtctaactgtaattatgtatcctttagacccacatctccccattccccctcccctaaccacttcagcctatggaaagaaaattctgctttccacttccgngagatcaccttttacagattccacaaatgagtgagatcatgtagtatttgtctgtgtctggcttatttcagttaacatagtctcttccaggttcatccattttgtngcaaatgataggattttattcatttttatggctgaatagtattccattgtgtatatacactatatntcctttatccattaatggacatttgttgattccatatcttggctgttgnaaatagngctgcaataaacatgtgagngc

SEQ ID NO: 8686 - DNA, 293 bp, Homo sapiens
  misc_feature 4, 22, 37, 73, 74, 80, 134, 256, 265, 286: n = A,T,C or G
cttntttgggaaaaaaaacccnggattttcgggcgcntgcaggtccgacactagtggatccaaagaattcgtnncgaggntgcatcagtaccccattctatcatcaacgggtacaaacgagtcctggccttgtntgtggagacggattacaccttcccacttgctgaaaaggtcaaggccttcttggctgatccatctgcctttgtggctgctgcccctgtggctgctgccaccacagctgctcctgctgctgtgnggccccagnttaaggttgaagcaagaaaanatcggag

SEQ ID NO: 8687 - DNA, 436 bp, Homo sapiens
  misc_feature 9, 17, 56, 66, 69, 167, 222, 398: n = A,T,C or G
cttgggganaaaacccnaggtttttttgggcgcttgaaggtccacactagtggatncaaagaattnttncgagcatggttaacgtccctaaaacccgccggactttctgtaagaagtgtggcaagcaccaaccccataaagtgacacaagtacaagaagggcaaggnttctctgtacgcccagggaaagcggcgttatgacaggaagcagagtggctatggngggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagngtcatcttttattatgaagacaataaaatcttgagttt

SEQ ID NO: 8688 - DNA, 500 bp, Homo sapiens
  misc_feature 22, 43, 95, 189, 463, 472, 474: n = A,T,C or G
ctttttggggaacaaaaacccnggattttgggcgcttgcaggnccacactagtggatccaaagaattcgttcgaggcggacgggttgtgcctggnggtggaggggaagatggtcagtaggacagaaggtaacattgatgactcgctcattggtggaaatgcctccgctgaaggccccgagggcgaaggnaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcaggaacaaatcaagcacatccttgctaatttcaaaaactaccagttctttattggtgaaaacatgaatccagatggcatggttgctctattggactaccgngaggatggngngaccccatatatgattttctttaagg

SEQ ID NO: 8689 - DNA, 500 bp, Homo sapiens
  misc_feature 14, 19, 49, 60, 62, 63, 86, 146, 204: n = A,T,C or G
aaaaaaacccaggnttttngggcgcttgcaggtccgacactagtggatncaaagaattcntnncgagccagtgtttaccgaggttngcccaaatccaagatctagtgggaggggaaagagcaaatgtctgctccgaggagggcggngtgttgatctttggaggaaaaatatgttctgttgttcagctggatttgccgtggcagnaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcacttcgggaggctgaggtgggcggatcatttgaggtcaggagttcgagaccagcctggccaacatggtgaaaccccatctctactaaaaatacaaaaattagccgg

SEQ ID NO: 8690 - DNA, 497 bp, Homo sapiens
  misc_feature 16, 41, 43, 83, 156, 165, 307, 412, 448: n = A,T,C or G
gggcgcttgcaggtcnacactagtggatccaaagaattcgntncgagcttgattcatgtattgggaagctacagggactacgnaatacctgcttatcacataggaaaattatgtccatgattctgagctcccttcttcaaaagtttcctcctgggngttctatgntctctctttatcctgaaatacatttattaggttgtgaggtatgttgaagaagtagaagccaggggtatgctttcagcatttattgcaaccaaaagttaaccccatcacggttaacgagcatctttggtctcttgtggaattngaactaaaactatgagccttattcaatatctataattctatgatttttttaaattatgggaaattaatgaaagatgtttacatgaataatgtttgcccttactgngttatgaatgagttttttgtagtgtgtctgggtgcntgatgcaagagagtaggaaaaatgtttctgaaacaaaacttgacaaata

SEQ ID NO: 8691 - DNA, 396 bp, Homo sapiens
  misc_feature 4, 72, 98, 135, 310: n = A,T,C or G
cttntttggggaacaaaaaccctggttttcgggcgcttgcaggtcgacactagtggatccaaagaattcttnacgagcaccaattgaatgctggttgntgtacacaatagaagctaaaagtaacatgtgcagcgnggccatgttaatattgctaaagaaacctttagttgaatagtatgattttagagctttagttcaaagtcgtaatatcgcaatagcattacttttgcaaaatacacaaatctttcttctatatgaaaaatgtggattaaaaaagacttgcttgttcaagctttaactacagtagttncttacatgccttcagagctttgggggaagcatatgctctttgtgactatacctgtaattttagaatcatgtagcccaaatggatag

SEQ ID NO: 8692 - DNA, 388 bp, Homo sapiens
  misc_feature 5, 14, 27, 38, 41, 382: n = A,T,C or G
gcgcntgcaggtcnacactagtggatncaaagaattcnttncgagcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccacctttacaagctgcaccaccactgacgtccccatccccgagagggggagggtagagcctcgcagctgcatctttgggtcatcgggaagtccttgagtcagtgcaggcaaagacctgtgatgtctgaggctagccaccatgancaccgc

SEQ ID NO: 8693 - DNA, 396 bp, Homo sapiens
  misc_feature 27, 133, 135, 184, 220, 264, 277, 295, 301, 372: n = A,T,C or G
aaaaattcttgggccctaccccagggntactgaatcagaaacttggttggggcctagcagtgttttcatgagccctccattgatcttgatgcagctgaagtgccgggcaccagtgaaagggaagggctgcggnancgattccattgattcctgctttgatggaagttatggcctcacaggttanacgttgcaagttgagttggccctcttgcctaggtgngcctccttgccttgggattctgacatgaacaggtgaagtctctncatgatttttttngttgttgtggttaatggnatgctngctattatggccaatatgtaaatgttactctgaatacatatttatataccatgttacttagtgacattatncaaacatttgtatgcgtatttggg

SEQ ID NO: 8694 - DNA, 411 bp, Homo sapiens
  misc_feature 41, 221, 234, 253, 278, 316, 385: n = A,T,C or G
tggcggcgaacgcggagagcacgccatgaaggcctcgggcncgctacgagagtacaaggtagtgggtcgctgcctgcccacccccaaatgccacacgccgcccctctaccgcatgcgaatctttgcgcctaatcatgtcgtcgccaagtcccgctttctggtacttttgtatctcagttaaagaagatgaaagaagtcttcaggggagattgtctacttgngggcagggtgttngagaagtcccccctgcggntgaagaacttcgggatctggctgcnctatgactcccggagcggcacccacaacatgtaccggnaataccgggacctgaccaccggaggcgctgtcacccagtgctaccgagacatgggtgcccgggacccgngcccgagccccttcattcagatatga

SEQ ID NO: 8695 - DNA, 114 bp, Homo sapiens
  misc_feature 1, 18, 56: n = A,T,C or G
ntaagatggtatctcatngtgatttgatttgcatttctctaacaattggagatgtngagcattttttcatatacttgttggccacatgtatgtcttcttttaagaagtgtctgt

SEQ ID NO: 8696 - DNA, 270 bp, Homo sapiens
  misc_feature 3, 16, 27, 30, 222: n = A,T,C or G
ccnacactagtggatncaaagaattcnttncgaggccaaagaagaggttgcaggtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcaggncctgaaagcagcggacctgggctgttctgtgttgaaggagtgtgccca

SEQ ID NO: 8697 - DNA, 193 bp, Homo sapiens
  misc_feature 2, 17, 27, 30, 48, 183, 184: n = A,T,C or G
gncgacactagtggatncaaagaattnttnacgaggctgagggcaggngggaagcaaacccggacgcatcgcagcagcagcagcagcagcagaagcagcagcagcagcctccgagtccctccagagacatggatccccagacagcaccttcccgggcgctcctgctcctgctcttcttgcatnntggctttcc

SEQ ID NO: 8698 - DNA, 495 bp, Homo sapiens
  misc_feature 12, 215, 372, 451, 467: n = A,T,C or G
tcgaggttttgngtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacaggtatgtgtngttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaatgagggncgctgtctgcccattgatagaggccagattgtcttggaagttccaaagttgcaacgatttctggctagtgccacgaggnttaccttgactgttgngtgaaaagctgataagaaaaccatccag

SEQ ID NO: 8699 - DNA, 395 bp, Homo sapiens
  misc_feature 2, 9, 31, 42, 175, 196, 229, 321: n = A,T,C or G
tngggcgcntgaaggccgacactagtggatncaaagaatttngcacgaggctgacctgacctgatgtccattcatcccaccctctcacagttcggacttttctcccctctctttctaagagacctgaactgggcagactgcaaaataaaatctcggagttctatttatttattgncttcctgtaagaccttcgggncaaggcagaggcaggaaactaactggtgtgagncaaatgccccctgagtgactgcccccagcccaggccagaagacctcccttcaggtgccgggcgcaggaactgtgtgtgtcctacacaatggngctattctgtgtcaaacacctctgtattttttaaaacatcaattgatattaaaaatgaaaagattattggaaag

SEQ ID NO: 8700 - DNA, 498 bp, Homo sapiens
  misc_feature 1, 32, 54, 65, 67, 119, 172, 245, 293, 392, 401, 438, 469: n = A,T,C or G
nttgggaaaaaaaaccctggttttcgggcgcntgcaggtcgacactagtggatncaaagaattcntnacgagctcgtgccggtggaaatgcctccgctgaaggccccgagggcgaaggnaccgaaagcacagtaatcactggtgtcgatattgtcatgaaccatcacctgcnggaaacaagtttcacaaaagaagcctacaagaagtacatcaaagattacatgaaatcaatcaaagggaaactngaagaacagagaccagaaagagtaaaaccttttatgacaggggctgcngaacaaatcaagcacatccttgctaatttcaaaaactaccagttctttattggtgaaaacatgaatccagatggcatggttgctctattggactaccgngaggatggngtgaccccatatatgattttctttaaggatggtttanaaatggaaaaatgttaacaaatgtggcaatnattttggatctatcacctgtcatcataac

SEQ ID NO: 8701 - DNA, 500 bp, Homo sapiens
  misc_feature 33, 37, 63, 65, 84, 93, 105, 123, 138, 179, 276, 279: n = A,T,C or G
tgggaaaaaaaaccctggttttcgggcgcttgnaggnccgacactagtggatccaaagaattntncacgagctacaaaattggnggtattggnactgttcctgtnggccgagtggagactggngttctcaaacccggnatggtggtcacctttgctccagtcaacgttacaacggaagnaaaatctgtcgaaatgcaccatgaagctttgagtgaagctcttcctggggacaatgtgggcttcaatgtcaagaatgtgtctgtcaaggatgttcgncgnggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtc

SEQ ID NO: 8702 - DNA, 425 bp, Homo sapiens
  misc_feature 13, 27, 40, 55, 65, 90: n = A,T,C or G
actttttgggaanaaaccctgtttttngggcgcttgaggncgacactagtggatncaaagaattntgcacgagcacatcatgggccagantgttgcaagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatg

SEQ ID NO: 8703 - DNA, 244 bp, Homo sapiens
  misc_feature 30, 41, 43, 44: n = A,T,C or G
cgggcgcttgcaggtcgacactagtggatncaaagaattcntnncgaggagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacacttttgtgagaaccaatgggaaggagcctgagctgctgga

SEQ ID NO: 8704 - DNA, 359 bp, Homo sapiens
  misc_feature 6, 133, 186, 239, 258, 303, 318, 320, 353: n = A,T,C or G
cccagngcctccttgtgcctagaccttcttctcccacccccttctgcccctgggtccccggccatccagcggggctgccagagaaccccagacctgcccttacagtagtgtagcgccccctccctctttcggntggtgtagaatagccagtagtgtagtgcggtgtgcttttacgtgatggcgggngggcagcgggcggcgggctccgggcagccgtctgtccttgatctgcccgcggngccccgtgttgtgttttgngctgtgtccacgcgctaaggcgaccccctcccccgtactgacttntcctataagcgcttntnttcgcatagtcacgtagctcccaccccaccctnttcctg

SEQ ID NO: 8705 - DNA, 446 bp, Homo sapiens
  misc_feature 19, 225: n = A,T,C or G
ctcctccccaccgatcgcnggtccccacatctggggcgcttttgggttggaaaaccaccccacactgggaatagccaccttgcccttgtagaatccatccgcccatccgtccattcatccatccgtccgtccatccatgtccccagttgaccgcccggcaccactagctggctgggtgcacccaccatcaacctggttgacctgtcatggccgcctgtgccctgnctccacccccatcctacactcccccagggcgtgcggggcttgtgcagactggggtgccaggcatctcctccccacccggggtgtccccacatgcagtactgtataccccccatccctccctcggtccacttgaacttcagagcagttcccattcctgccccgcccatctttttgtgtctcgctgtgatagatcaataaatattttattttttttggcctgg

SEQ ID NO: 8706 - DNA, 139 bp, Homo sapiens
  misc_feature 54, 92: n = A,T,C or G
gggagacaagcccagcccgcacgcgctcatctttcttcgttttttgatcagttnattcagaattgctctataatttaccaattgtatgtatntaacctattcttgtggaaaaaaaaggtctttcattatatctttattt

SEQ ID NO: 8707 - DNA, 316 bp, Homo sapiens
  misc_feature 16, 53, 196, 259, 268: n = A,T,C or G
atgtatacatctgaangaaaagcaagagctagaatatgtttacagaccaaagngtgatttcacactgtttttaaatctagcattattcattttgcttcaatcaaaagtggtttcaatattttttttagttggttagaatactttcttcatagtcacattctctcaacctataatttggaatattggtgtggtcttntgttttttctcttagtatagcatttttaaaaaaatataaaagctaccaatctttgtacaattngtaaatgtnaagaattttttttatatctgttaaataaaaattatttccaacaacctt

SEQ ID NO: 8708 - DNA, 304 bp, Homo sapiens
  misc_feature 5, 10, 34, 37, 48, 109, 139, 176, 178, 190, 236, 241, 296,303: n = A,T,C or G
tgcangtccnacactagtggatccaaagaattcnttncgagccgaagncttcgccaccatgccgccctacaccgtggtctatttcccagttcgaggccgctgggcggcnctgcgcatgttgttggcagatcagggccanagctggaaggaggaggtggtgaccgtggagacgtggnangagggctcactnaaagcctcctgcctatacgggcagctccccaagttccaggacgganacctncccctgtaccagtccaataccatcctgcgtcacctgggccgcacccttgggcctntatgggna

SEQ ID NO: 8709 - DNA, 500 bp, Homo sapiens
  misc_feature 13, 32, 43, 46, 72, 474: n = A,T,C or G
actttcttggggnaaaaaacccctggtttttngggcgcttganggnccgacactagtggatccaaagaattntgcacgagctgaaacgctctctccctaagtgatccatgtccctgcggtaataccataaccactaagctaacacactcactgtaaaagtgttgcttctccatgaagcaccaagacttgatgaccatttgcagttctcattaactccactaagaccctaaaggctaaatgacaaccaagcctctgtcactctgcctgagtggatttaccacaaatatcaaatctgttcaatctattataagagctaaaaaggagaagcacatgaaatcacatttcattcttagctcttttatcttcccatttttcatttagacattgaatacatgaaccaaagtttagttctctgtattagtcaatttgccaatagctgtcaaccctttaaaagtctttaagatgctacaaggntcccaaagctatacttctagtaatgc

SEQ ID NO: 8710 - DNA, 500 bp, Homo sapiens
  misc_feature 3, 9, 30, 252, 424, 457, 495: n = A,T,C or G
aantgcccnctagtggatccaaagaattcntttcgagggctggagcagtgcctactcaatagaatcggtcatcatgcaaataaatgccaccttagtcaaaggcaaagccggagtgcagtttggagcaaataagaatcaatataatctagcaagagcccaacaatcctataattccattgtacagatacatgagaaaaatggctggtacacccctccaaaggaagatggctaaatatgttgactgttgtatgnttggactaatgttgctttaaagaaaatctttccaacatgcagacaaaagctttgagtgcccctattacagcagtaccgaagatgttagttaatagatattttagtggataatctgtcatctgacatccagtataagttacagcctttgcattttgctcattttagatatctnggactgagcagcggggcctttactgtatttttnctgataaatacacatactggccactccttatctctttntcttg

SEQ ID NO: 8711 - DNA, 500 bp, Homo sapiens
  misc_feature 18, 22, 37, 66, 68, 92, 200, 246, 336: n = A,T,C or G
cttcttgggaaaaaaccnggtncttgggcgcttgcangtccccactagtggatccaaagaattctntncgaggttatgttgctcaaacatangtggctcctttggcaatttctatatttgtggaaatttggaaaggcagtagtttcaacatgcaagaatgtaattatattgcttcatctaataatatctcacatatctgnctatcttcagattttagattttctttattaaaaaaaccatcatggnagctccatctcgtttgtaacttctccctctcaaatactcagaagaatgaagaggccaaattcagaaaatcatggcttcactgggaaatgntttaaatctacatgtagctaggatatgtgatttcatattttttaaaaatgtggagtaaataagtgtaaaaaattaccacttgcaaagtggctttattacagcgttaaagaaaatgactagaattctgatagattgtgctgatgaacctgggtgcgggcaattga

SEQ ID NO: 8712 - DNA, 265 bp, Homo sapiens
  misc_feature 18, 39, 40, 42, 57, 106, 130, 134: n = A,T,C or G
acatggcatgttagcagntctagaatttcaggtgttggnngncatcaaatcactggngacacttcgggagaatgggatttcaaactaagaagcctttgaccactgnatactttctttcttaacctgtggntttntagcactctcttttatcacctttacagcctctctacctctcagctagcaaaagaaaaatctgcctgaggcagaaaggttttatttttcagtttttcctgccctttaaaactgtagcagaaatttattattt

SEQ ID NO: 8713 - DNA, 395 bp, Homo sapiens
  misc_feature 54, 60, 266, 267, 286, 324, 394: n = A,T,C or G
atttaaaataaaatataccatacctatatgaatttgaattagaatgttcctggngatggnaatctgatgctaaaacatcatcatcatcatcattgtcatcatcatcacttcccagactctcctctgaatcatattcggctctactttgagaagagggtagaaaaggctaaaataaagaaatcatgaaatttagcagccacatatctaatttaatacattcaaacatacagtctaatagtaataattcatctcatttgcagatactnngttataagagagttaaggnaactattatcttaccatcctatgccctttgacatcaantgatactatgccattatttattcatccattcagcaaaaatttattaagtatccactgtgcggcaagaatnc

SEQ ID NO: 8714 - DNA, 422 bp, Homo sapiens
  misc_feature 1, 21, 26, 43, 56, 67, 70, 94, 120: n = A,T,C or G
ntttggaacaaaaacccaggnttttngggcgcttgcaggtccnacactagtggatncaaagaattcnttncgagtccatgcccatccgaaaggntgatgaagttcaggttgtaccgtggncactataaaggtcatgcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcagggaataaagtaatcttatatacaagctttgattaaaacttgaaacatag

SEQ ID NO: 8715 - DNA, 382 bp, Homo sapiens
  misc_feature 32, 37, 41, 65, 68, 238, 306: n = A,T,C or G
ctttggaaaaaaaacccaggttttcgggcgcntgcangtcnacactagtggatccaaagaattcnttncgagcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgatcgnggccaaggcatcgcgcactgagctgtgaccagcagccctgttgcgggtggcaccttctcatctccggngaagctgaaggggcctgtggccctgaaagggccaacacatcactggttttctaggagggactcttaagttttctac

SEQ ID NO: 8716 - DNA, 401 bp, Homo sapiens
  misc_feature 13, 41, 42, 146, 147, 376, 390: n = A,T,C or G
cgggcgcctgcangtccacactagtggatccaaagaattcnnttcgaggatgcctgtgacactttggcgttgccgagttagtcaacaattattctgggaaaaagcagaattgaattcttctctagatgtcctaccagggttggccnngggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaattttttnaaaaactgtatgtntctgtggtatg

SEQ ID NO: 8717 - DNA, 445 bp, Homo sapiens
  misc_feature 2, 4, 30, 53, 62, 109, 329, 367, 397: n = A,T,C or G
gncnacactagtggatccaaagaattcttnacgaggtcccgcccttgtgtganatgggccangatccttcggcaaggggcgcctggggctggggctgattgtgggcggnggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagngggtggacctaactgcccaggcaggcgagagctacttncagagccttccagtgcatgggagggcaggnctaggtgtagcggtgtctcctctttgaaattaagaactatctttcttg

SEQ ID NO: 8718 - DNA, 417 bp, Homo sapiens
  misc_feature 204: n = A,T,C or G
gaaactgttacaatacattgcaatcattcatttgaataaagcattcctattttccttctcaacaccgtcacagcttggatgggcaatgaactggccaactgaaatatggaaagttctgcctttgtatacaatatatttgtaattctaagaacctactcaaaatttattacatttatgcgacctcaaaatgaggaaggattttgncttagtccattttgtgttgatataaaggaatacttgaggctgggtaatttataaataaaagaggtttatttggctcacagttctgcaggctgtacaagaagcatggagccagcatctgctgtgagggcctcaactgtttccactcatggcagaagaggaaggggaatcaagcatgtgcagagatcacatgataagatgggaagtgagagagag

SEQ ID NO: 8719 - DNA, 216 bp, Homo sapiens
  misc_feature 37, 149, 152, 206, 209: n = A,T,C or G
gccgcgccgccatcatggacaccagccgtgtgcagcnctatcaagctggccagggtcaccaaggtcctgggcaggaccggttctcagggacagtgcacgcaggtgcgcgtggaattcatggacgacacgagccgatccatcattccganatntaaaaggccccgtgcccgagggcgacgtgctcacccttttggagtcaaagcganaancccggga

SEQ ID NO: 8720 - DNA, 285 bp, Homo sapiens
  misc_feature 40, 41, 67, 195, 209, 284: n = A,T,C or G
gggcgcttgcaggtccacactagtggatccaaagaattcnnttcgagattaccctctataatatggntgggccttagccaatcagttaaaggccttaagagagaaaagactgacgtcccctgaagaagaaagaactgtctccagactgccttgggacttgagctgcaacaactcttccctgggcctgcagcctgntggcctgccctgcngaatttggacttgccagccaccagcccacacaagcatgtaaccaattccttaaaataaaatcaatgtgtatcatnt

SEQ ID NO: 8721 - DNA, 498 bp, Homo sapiens
  misc_feature 7, 16, 33, 35, 40, 53, 64, 67, 91, 122, 184, 221, 482: n = A,T,C or G
tgggaanaaaaacccnggttttcgggcgcttgnangtccnacactagtggatncaaagaattcnttncgagccagttggaaagaagacagntgagcacttcaggatggtttttaaatttggnatgagattctctgccaacaccaagctctgagttaactgtgctttcttctcctggccctgacngagcactacagcatcaaagtaaatctttggggacagngtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggantctaggaggggcgggg

SEQ ID NO: 8722 - DNA, 405 bp, Homo sapiens
  misc_feature 7, 19, 69, 85, 299: n = A,T,C or G
ctttagngtgctatacctntgtgtcttatcgtgggccactgtgccaataaacaaaaacaactgtttggnttacctcagttgcagnagttattttcatttagaagttgttctcagattattgtttcagttatatagaggattactagactagttatgaagaaaccccactacattcaatggaattggggcttaaaatctcatcgatgtgctgtctctggagtgataagaaagggctacatctcccgaaatgatttctttacgtcatgtattggtttccttcttcaccttgaacttttgtngaactgtatgtactttaccccaaacctgttaatattttgagcgcttctatgtgaaagcaaagaaataattttaatactctggcattcataaattttattgatgaga

SEQ ID NO: 8723 - DNA, 495 bp, Homo sapiens
  misc_feature 10, 27, 37, 41, 67, 247: n = A,T,C or G
cttggggaanaaaacccctggtttttngggcgcttgnaggnccgacactagtggatccaaagaattntttacgaggagaagtcgcaaatcttgcgacctctagccacatgattcctgagcagtaagggattatagaatcttcacttacgttttagcagaattcaggctcttcccatgatcctaatcttgtggcctttcattagttttacaaaggcagcttcagcccctgaaaaaggaggggagcagntttagggaggggctgttattatccctgtttcaaagttaaattacaaactaaattcctcccatcgttagcttggcctacacctaggaatgagtgaagacagccagcctgtgaggctagaagcaagatggagtcagccatgctagacttttctgcctgtcttaatctttgcaaagacagtttcaatgagagtgtgaaagctgcatttcggtaatccagggtatggagaacatgttaaacagttagtcttg

SEQ ID NO: 8724 - DNA, 324 bp, Homo sapiens
  misc_feature 11, 31, 41, 202, 248, 312: n = A,T,C or G
cgggcgcttgnaggtccgacactagtggatncaaagaattntttacgagacattgcccaccccaagcttgggaagcgtgctcgtgcccgtattgccaaggggctcaggctgtgccggccaaaggccaaggccaaggccaaggccaaggccaaggatcaaaccaaggcccaggctgcagccccagctttcagttccagcttanggctcccaaacgtacccaggcccctacaaaggcttaagagtagatntctctgccaacatgaggacagaaggactggggcgacccccccaccccccgcccctgggctacantttgcatggggc

SEQ ID NO: 8725 - DNA, 500 bp, Homo sapiens
  misc_feature 15, 56, 62, 135, 220, 240, 305, 312, 316, 356, 357, 490: n = A,T,C or G
ggggaacaaaacccnggttttggggcgcttgaggtcgacactagtggatccaaagnaattcnttacgagaaactggggaaacaaaggatatatcctcatggctcgaaataagaacaacgcctgtggctttgccgncctggccagcttccccaagatgtgactccagccagccaaatccatcctgctcttccatttcttccacgatggggcaggtgtaacnatgcactttggaagggagtnggggtgctatttttgaagcagaggtggggatactgagattgtctgttcagtttccccatttgttngtgcttnaaangatccttcctactttgcttctctccacccatgaccttttnnactgtggccatcaggactttccctgacagctgggtactcttaaggctaagagatgagactacggcctgcccctgactgtgttgtcccagggctgatgctgtacaggtacaggctggagattttcacataggtnagattctcat

SEQ ID NO: 8726 - DNA, 104 bp, Homo sapiens
  misc_feature 7, 78: n = A,T,C or G
ctggagnctcgcgcgcctgcaggtcgacactagtggatccaaaaaattcggcacgagggagctgcggagccgcctggnctcccgcgtccatcggtccattcctg

SEQ ID NO: 8727 - DNA, 281 bp, Homo sapiens
ttccaggtcgacactagtggatccaaagaattcggcacgaggcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaac

SEQ ID NO: 8728 - DNA, 292 bp, Homo sapiens
gctggagctcgcgcgcctgcaggtcgacactagtggatccaaagaattcggcacgagggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaaccct

SEQ ID NO: 8729 - DNA, 140 bp, Homo sapiens
  misc_feature 2, 8, 28: n = A,T,C or G
tncagtgngacactagtggatccaaagnaattcggcacgagcttgaacaccaccactgaagagtttcatatacaccaaataatgtctcatctctatagtacagggaatataaaattggtttcctgtggtcatgatcaaga

SEQ ID NO: 8730 - DNA, 123 bp, Homo sapiens
  misc_feature 45, 62, 121: n = A,T,C or G
ctggagcctcgcgcgcctgcaggtcgacactagtggatccaaagnaattcggcacgaggccngctgacggacaactgagtctccggcccacctaccaccgccgcccgggtcccccaggtgngc

SEQ ID NO: 8731 - DNA, 132 bp, Homo sapiens
  misc_feature 10, 24: n = A,T,C or G
ctgggacgcnagtggatccaaagnaattcggcacgagcttagcacagttcctggtgctcaaagagttccaacacctgaaagcaccatggccctgtttgtttttcagtcaagatttctaaaagccgttattac

SEQ ID NO: 8732 - DNA, 171 bp, Homo sapiens
  misc_feature 2, 13, 112, 156: n = A,T,C or G
antggagtctgtnttacaattaactgggacactagtggatccaaagaattcggcacgagggccgcagaccccgtctgggaggtgaggagcatctctgcccggccgccccgtntgagaagtgaggagaccctccgcctggcaaccgccccgtctganaagtgaggagcccct

SEQ ID NO: 8733 - DNA, 102 bp, Homo sapiens
  misc_feature 6, 39, 45, 90: n = A,T,C or G
ctggangctcgcgcgcctgcaggtcgacactagtggatncaaagnaattaacccatcgttgagtcaaatttacccaattttattcaatangtcaatatcatg

SEQ ID NO: 8734 - DNA, 277 bp, Homo sapiens
  misc_feature 4, 8: n = A,T,C or G
gtgngacnctagtggatccaaagaattcggcacgagctcgtgccgaattcggcacgagcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacct

SEQ ID NO: 8735 - DNA, 397 bp, Homo sapiens
agctggagctcgcgcgcctgcaggtcgacactagtggatccaaagaattcggcacgagagaaatccttgaaatgccatagtttctggcagcatgattccaatctctgactctgtcttcaaatggctgtcttccttctctgtgtgtgtgtatctgtatctctgttgtgtcttcttttaaggatgtcagtcactggatgatggcctagccaattccggcatgacctcgtctttactagttacatctgcacagaccgtattttcaaacaatgtcacattccaagtttctaggtaggtatgaatattttggagggcattattctacccagtaaagattattttcaatattgttataagttcattgagaatagggaccgtgcatttctgctcattcttgcat

SEQ ID NO: 8736 - DNA, 360 bp, Homo sapiens
ctggaacctcgcgcgcctgcaggtcgacactagtggatccaaagaattcggcacgagcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaaccttac

SEQ ID NO: 8737 - DNA, 242 bp, Homo sapiens
  misc_feature 21: n = A,T,C or G
aagctggagctcgcgcgcctncaggtcgacactagtggatccaaagaattcggcacgagggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataa

SEQ ID NO: 8738 - DNA, 280 bp, Homo sapiens
tgcaggtcgacactagtggatccaaagaattcggcacgagcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcat

SEQ ID NO: 8739 - DNA, 164 bp, Homo sapiens
  misc_feature 6, 45: n = A,T,C or G
tctggngctcgcgccgcctgcaggtcgacactagtggatccaaanaattcggcacgagggaggactgtgagaattgttgctctggatcgaagttttcacattggctgttacaagtgcgaggagtgtgggctgctgctctcctctgagggcgagtgtcagggctg

SEQ ID NO: 8740 - DNA, 400 bp, Homo sapiens
  misc_feature 88, 205, 337: n = A,T,C or G
gaacaataagctggagctcgcgcgcctgcaggtcgacactagtggatccaaagaattcggcacgagctcgtgccgaattcggcacganaaaaaaacaaaaatctgatatttatttcaaaacgtattgaagcaacaaaatattaatattgtgccatatgacaacaaagtctttcctaaatactccatctgtttagtactgtattgnggaatattttgagttctatttccatacttgaaaacatggaggattttagagatgcctgaacaatattatttaagtagtatgtgaccgagctataaatttttgtttttgttctaagtagatttaatttggganctgacaggacaatgtttttaggtttagcattttgtttaaaaacctttaaagaaacctttagaa

SEQ ID NO: 8741 - DNA, 328 bp, Homo sapiens
  misc_feature 2, 247, 288: n = A,T,C or G
ancgaacaataagctggagcctcgcgcgcctgcaggtcgacactagtggatccaaagaattcggcacgagcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggnctgagctatgatatcaattggcttcctagggtttatcgggngagcacaccatatatttacagtaggaatagacgtagacac

SEQ ID NO: 8742 - DNA, 396 bp, Homo sapiens
  misc_feature 3, 9, 223, 232, 326, 328, 339, 343, 374: n = A,T,C or G
tantctggngcctcgcgcgcctgcaggtcgacactagtggatccaaagaattcggcacgagtaaaactgaactgcaatttttaagtacttaaaatattagatacagagtaatatacacacatgtaatcaacaaatattaatatatttaccagttagaattaataaatgatttacattggcttcaagtcttgttttatgtattaaaaaaaaaaagaagaaaaangactgggcncaatggcttatgcttataatccgaacactttgggaggctgaggcaggaggatcacttaaggccaggagttcgagaccagcctgggcaacatagngngaggccatctntacncaaagaaaacaaattagccagggggggtagncctagtttctcccgagactgaa

SEQ ID NO: 8743 - DNA, 400 bp, Homo sapiens
  misc_feature 16: n = A,T,C or G
gaacaataatgtctgnagctcgcgcgcctgcaggttcgacactagtggatccaaagaattcggcacgagtagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttc

SEQ ID NO: 8744 - DNA, 400 bp, Homo sapiens
  misc_feature 6, 221, 223, 298, 370, 388: n = A,T,C or G
gacaanaagctggagctcgcgcgcctgcaggtcgacactagtggatccaaagaattcggcacgagattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttncnagaactaccactggcaataaagtttttggtgccctgaagggagctgtggatggaggcttgtctatccctcacagnaccaaacgattccctggttatgattctgaaagcaaggaatttaatgcagaagtacatcgggaagcacatcantgggccagaatgttgcangattacatgcgc

SEQ ID NO: 8745 - DNA, 284 bp, Homo sapiens
gaacaataagctggagctcgcgcgcctgcaggtcgacactagtggatccaaagaattcggcacgagattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaa

SEQ ID NO: 8746 - DNA, 338 bp, Homo sapiens
  misc_feature 3, 308, 330: n = A,T,C or G
ganaataagctggagctcgcgcgcctgcaggtcgacactagtggatccaaagaattcggcacgagaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaactnggttctgcttcaataaatcttnggaaaaac

SEQ ID NO: 8747 - DNA, 400 bp, Homo sapiens
  misc_feature 2, 3: n = A,T,C or G
tnngctggagctcgcgcgccctgcaggtcgacactagtggatccaaagaattcggcacgagctcgtgccgaattcggcacgagggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaaga

SEQ ID NO: 8748 - DNA, 400 bp, Homo sapiens
gaacaataagctggagctcgcgcgcctgcaggtcgacactagtggatccaaagaattcggcacgagcggcacgagccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagcttggaagatggacgcaccctgtctgactacaacatccagaaagagtccactctgcacttggtcctgcgcttgagggggggggtgtcctaaagtttccccttttaaggtttcaacaaatttcattgcactttcctttcaataa

SEQ ID NO: 8749 - DNA, 400 bp, Homo sapiens
  misc_feature 376: n = A,T,C or G
gctggagctcgcgcgccctgcaggtcgacactagtggatccaaagaattcggcacgagctcgtgccgaattcggcacgagtgataatttactgtcaacagacctactctaaaagaagtgctaaaagaaattctttagacagaaggaaaatgataccacaaggaaatgtggaagattaagaatgaagaaagagcaacagaaatgttaaatatctggttaagtataatagacaaatctcctcttgaggtctttaaaatatgtgtgacaaccaaaagcaaaagttacaacaatatctgatgaggtttttattgtatgtaaatgtattaagataagacgactatgacatagattgtggaaaataaagagatgcatatggnggcaagattctacatttcactttg

SEQ ID NO: 8750 - DNA, 208 bp, Homo sapiens
  misc_feature 3: n = A,T,C or G
ganaataagctggagctcgcgcgcctgcaggtcgacactagtggatccaaagaattcggcacgagtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgc

SEQ ID NO: 8751 - DNA, 400 bp, Homo sapiens
  misc_feature 29, 163, 164, 170, 349: n = A,T,C or G
gacaataagctggagcctcgcgcgcctgnaggtcgacactagtggatccaaagaattcggcacgaggggatgtctgcctggccttattttatttatggaccatcccaaccctccagtcgtccactccgctttgcttgctcttcgatacttggcagaatgccgnncaaacnagagaaaagatgaaaggagaactgggtatgatgttgagcttacaaaatgttatacagaagtaagtacaatagacagtgtctcatttatttatatacttacttatattacttacttacagggcctcactatgttgcccatgctgggttcaagcgatccttccaccttggctttccaaagngctggaattataggcaatttttttattgaaatactgaaaggcaatttcagg

SEQ ID NO: 8752 - DNA, 236 bp, Homo sapiens
  misc_feature 6, 7, 113, 143, 149, 186, 195, 220: n = A,T,C or G
tctggnncctcgcgccgcctgcaggtcgacactagtggatccaaagaattcggcacgagctcgtgccgaattcggcacgagtatgaactcctttttaaggagggagtcatggnggccaagaaggatgtccacatgcctaagcncccggngctggcgggacaagaatgtgcccaaccttcatgtcantgaaggccntgcggtctctcaagtcccgaggctncgtgagggaacagttt

SEQ ID NO: 8753 - DNA, 159 bp, Homo sapiens
cgacaaaagctggagctcgcgcgcctgcaggtcgacactagtggatccaaagaattcggcacgagataaaatgaaatatatgtttcattttagagaaataactattactttagatctttccaaatctgaggaaagggaggcctagcatgtgttccaagg

SEQ ID NO: 8754 - DNA, 400 bp, Homo sapiens
  misc_feature 8: n = A,T,C or G
gaacaatntgctggagctcgcgcgcctgcaggtcgacactagtggatccaaagaattcggcacgagcggcacgagccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaaggaggcaggct

SEQ ID NO: 8755 - DNA, 400 bp, Homo sapiens
  misc_feature 4: n = A,T,C or G
aacnaacaatattgcctggagcctcgcgcgccctgcaggtcgacactagtggatccaaagaattcggcacgagtgcacatctctgccttgcatctttgttaatgctgtgttctcttcaatcccacaagcttctcttgatccattgatagtgaatattgttcacctctgtaagctggcaatgctttctctttccctggtatgcttgccagtattattcatgtggaaagctcagttacagtgtaagcttccgaagacaaggactgtatcttataatagtggctactgactgagctctttctatgggccagactaccacacaaggttatgcatgttgtgccgatgttcagctgtaggtggggcgatactcaaatcgtagcctaggctgctagtctttacatgc

SEQ ID NO: 8756 - DNA, 340 bp, Homo sapiens
  misc_feature 249, 273, 283, 318, 323: n = A,T,C or G
attctggaagctccgcgcgccctgcaggtcgacactagtggatccaaagtaattcggcacgagggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttttcttgtntataaagcatttaacccccctgtncacaactcantccttttaaagaaaaaaattgaaatgtaaggctgngtaanatttgtttttaaactgt

SEQ ID NO: 8757 - DNA, 307 bp, Homo sapiens
gctggagctcgcgcgcctgcaggtcgacactagtggatccaaagaattcggcacgagaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaaaaaaaaaaaaaa

SEQ ID NO: 8758 - DNA, 155 bp, Homo sapiens
  misc_feature 2, 6, 96, 152: n = A,T,C or G
gngacnctagtggatccaaagaattcggcacgagacaattgattcaaaagtgtcgttattagctaattttgaaatttttatgctattttcttttgnttatatttaaatataaataaaatattttaataatactgacttttctcacacaattnatg

SEQ ID NO: 8759 - DNA, 400 bp, Homo sapiens
  misc_feature 350: n = A,T,C or G
gaacaaaagctggagctcgcgcgcctgcaggtcgacactagtggatccaaagaattcggcacgagtgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggnggcgagtatgtaacacaagagcttaataagaccctcatagagcttgattc

SEQ ID NO: 8760 - DNA, 167 bp, Homo sapiens
  misc_feature 67, 79, 95, 123, 148, 166: n = A,T,C or G
ctggggcctcgcgcgcctgcaggtcgacactagtggatccaaagaattcggcacgagctcgtgccgnattcggcacgangcccagaagatgcagntgggctttcggctccagcagattgcagnctgctggggcacccttggtcccagntctttaggaacccagganc

SEQ ID NO: 8761 - DNA, 327 bp, Homo sapiens
  misc_feature 252, 285: n = A,T,C or G
ctggagctcgcgcgcctgcaggtcgacactagtggatccaaagaattcggcacgaggccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatcttgatgaagcgaattcagagnaggcccagtaagaggtatctccatcaagctgcnggaggaggagagagaaaggagagacaattatgttccctgagg

SEQ ID NO: 8762 - DNA, 171 bp, Homo sapiens
  misc_feature 8: n = A,T,C or G
gaacaatnagctggagctcgcgcgcctgcaggtcgacactagtggatccaaagaattcggcacgagggtacgagatctagcctgccctgcctgcctgccctgggcgatgaggtacggtggggaaggtgcctattttagagaactttgtcacagtattaaagttcccagaac

SEQ ID NO: 8763 - DNA, 352 bp, Homo sapiens
  misc_feature 22, 128, 282, 292, 299, 324, 336, 339: n = A,T,C or G
gacaaaagctggagctcgcgcncctgcggtcgacactagtggatccaaagaattcggcacgagctcgtgccgaattcggcacgagaaatctcggcgactcggccccgtctcctgagggtcctgctggngaccggcctggaccttggccctacagccctggaggccgctgctgaccagcactgaccccgacctcagagagtactcgcaggggccctgggctgcactcaagaccctcgagattaacggggctaaccccgtctgctccttccctcccgcagaggnctggggcctnggactgnacatgagagcccctttggggccccnagaggggctggngtncttactagaaaca

SEQ ID NO: 8764 - DNA, 400 bp, Homo sapiens
  misc_feature 10: n = A,T,C or G
aacgacaaangctggagctcgcgcgcctgcaggtcgacactagtggatccaaagaattcggcacgagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaaagaatgccaaaatcagcagtctcctggagga

SEQ ID NO: 8765 - DNA, 230 bp, Homo sapiens
  misc_feature 192, 203: n = A,T,C or G
gaaaatgctggagctcgcgcgcctgcaggtcgacactagtggatccaaagaattcggcacgagctcgtgccgaattcggcacgagttgcttaggtgaggcgcagacggggaagcggagccaacatgccagtggcccgggagctgggtttgtcgaaaaacttatgtgaccccgcggaggaccctttcgagaantctcgtctcgnccaagaacctgaagctgatcggcgagt

SEQ ID NO: 8766 - DNA, 400 bp, Homo sapiens
gaacaataagctggagctcgcgcgcctgcaggtcgacactagtggatccaaagttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttatttg

SEQ ID NO: 8767 - DNA, 182 bp, Homo sapiens
  misc_feature 7: n = A,T,C or G
tctgggnctcgcgcgcctgcaggtcgacactagtggatccaaagaattcggcacgagctcgtgccgctcgtgccgaattcggcacgaggttggatcaagtttaaatgactgtgctgcccctttcacatcaaagaactactgacaacgaaggccgcgcctgcctttcccatctgtctatctat

SEQ ID NO: 8768 - DNA, 400 bp, Homo sapiens
gaacaataagctggagctcgcgcgcctgcaggtcgacactagtggatccaaagaattcggcacgagagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtgggattggtgccccactggcttcaaggttggcatcaactaccagcctcccactgtggtgcctggtggagacctggccaaggtacagagagctgtgtgcatgctgagcaacaccacagccattgctgaggcctgggctc

SEQ ID NO: 8769 - DNA, 400 bp, Homo sapiens
  misc_feature 15, 26, 32, 35: n = A,T,C or G
cgaccataatgctgnagcctgtgtgncccttnagntgggacactagtggatccaaagaattcggcacgagtaaaggagagaaagacttagaacatacacagatcctaagtagaaccaggtaattgtctctttttctaataaggaatttgggtaatttttaattttttgttttttaaaaaataacctagactatgcaaaacatcagagtgaattttccatgaatgtttttaatattctcatctcaacattgtgatatatgctactaaaaaccttttcatatacatcttacctcatttcaagtgaattattttaatcttttcctctctttccaaaaatttacaggaatgtttagtgtaattggatttcgctatcagttcccatccttaagttttgatattca

SEQ ID NO: 8770 - DNA, 400 bp, Homo sapiens
  misc_feature 367: n = A,T,C or G
gaacaataatgctggagctcgcgcgcctgcaggtcgacactagtggatccaaagaattcggcacgagtgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagaggggcagnggccccgagtgggaccctgtctctgtggccatt

SEQ ID NO: 8771 - DNA, 302 bp, Homo sapiens
gaaaataagctggagctcgcgcgcctgcaggtcgacactagtggatccaaagaattcggcacgagccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggccccccctgaaccgcaccccatcccaccagc

SEQ ID NO: 8772 - DNA, 400 bp, Homo sapiens
  misc_feature 3: n = A,T,C or G
ganaataagctggagctcgcgcgcctgcaggtcgacactagtggatccaaagaattcggcacgaggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattcta

SEQ ID NO: 8773 - DNA, 400 bp, Homo sapiens
  misc_feature 3, 6: n = A,T,C or G
ganaanagctggagctcgcgcgcctgcaggtcgacactagtggatccaaagaattcggcacgagggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaag

SEQ ID NO: 8774 - DNA, 306 bp, Homo sapiens
gacaataagctggagctcgcgcgcctgcaggtcgacactagtggatccaaagaattcggcacgagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattaggtgaagttcgcaactaaactaaacctgtaaaattatgatgattgtattcaaaagattaatgaaaaataaacatttctgtccccctg

SEQ ID NO: 8775 - DNA, 303 bp, Homo sapiens
  misc_feature 10: n = A,T,C or G
aacgaacaantagctggagctcgcgcgcctgcaggtcgacactagtggatccaaagaattcggcacgagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtag

SEQ ID NO: 8776 - DNA, 397 bp, Homo sapiens
  misc_feature 102, 325, 359, 371, 389: n = A,T,C or G
gaacaataagctggagctcgcgcgcctgcaggtcgacactagtggatccaaagaattcggcacgaggcccgcgggggcagagcggggggccgtgcccttgcnaccggagggccggccagcaccccctcgcctgccgaggtcgcgggagcccagttaaaggaggcggtgtgtaagatgtgcaatgttcctgcatgggggttttgtagactttcatagccaaagaaaccggtttcgggtttctttaaaatccccgacgactcacctgattaacctgctgcagttctgaccctgccaaggtaactggtccaaattccttatcatcaanatctggagacagacatttgcatctggggcatttntttatttgcagnccctggttgaaatctaanattgctac

SEQ ID NO: 8777 - DNA, 400 bp, Homo sapiens
  misc_feature 384: n = A,T,C or G
gaacaataagctggagctcgcgcgcctgcaggtcgacactagtggatccaaagaattcggcacgagtgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttatttttttngagacagagtctcact

SEQ ID NO: 8778 - DNA, 400 bp, Homo sapiens
  misc_feature 24, 26, 31, 33, 35, 42: n = A,T,C or G
cgcccataatacgtgaagtctgtntnacaantnangcgtggnacgtctagtggatccaaagaattcggcacgaggatgaatctgaggcagcccccatgtggattctgtgctattcgtgctgtttatcttttaaaaatagggcagtggttacacagctgaggccctgagcctgcccagctccctgcacgaccctgcccgctccaaggctgatagcacttccttcctggcctcgcgtggcttcctgcacctggccttatcgccacacaaaacttgacactgtactggaatgcgctcagggtctgtaaatggaaatctcttgctttctacatttacaaacaactgtcatctataaaatgctttctttatttccagacttacactttctttacactagttggaa

SEQ ID NO: 8779 - DNA, 281 bp, Homo sapiens
  misc_feature 213: n = A,T,C or G
ctggggctcgcgcgcctgcaggtcgacactagtggatccaaagaattcggcacgaggtttattttatatttgaataagagtcaagactttaccttattgaaaattatcttttaacaggggaaacaattgtagaagcaagagaaatacaaaaccacatatatagtgggcaataaaggattatagaattatatgctttgaaaatcttagttttgntgcctcctctgtacctggaaacatgaacaataatttggttgtgaaagttctaaaaaaaaaaaaaaaaa

SEQ ID NO: 8780 - DNA, 399 bp, Homo sapiens
  misc_feature 8, 57: n = A,T,C or G
aaaacganatagtctggggctcgcgcgcctgcaggtcgacactagtggatccaaagnaattcggcacgagtgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaa

SEQ ID NO: 8781 - DNA, 242 bp, Homo sapiens
  misc_feature 3: n = A,T,C or G
ganaataagctggagctcgcgcgcctgcaggtcgacactagtggatccaaagaattcggcacgagctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatga

SEQ ID NO: 8782 - DNA, 400 bp, Homo sapiens
gaacaataagctggagctcgcgcgcctgcaggtcgacactagtggatccaaagaattcggcacgagcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacct

SEQ ID NO: 8783 - DNA, 400 bp, Homo sapiens
accgacaataagctggagctcgcgcgcctgcaggtcgacactagtggatccaaagaattcggcacgagaatttttccaggaaggtttgagggcgaattccgtgagaagtttttcaccagggatctcaggtactgtcattcctctggacaggaattgagtaggtgctgagatactcaccagttaattgcctttgggttagtggaagaagtaagtcacctagccagatcttatgcatttgcacaagtagagaatggaaacttccaatctgagtgagtttaattaaagattctagaatatttttaaaacagttcacactaattacttttagtttagggaataactcaaagttgggttaattgtgttgtcagttagtgaaaaccaacaactgacttgagaatgg

SEQ ID NO: 8784 - DNA, 241 bp, Homo sapiens
  misc_feature 8, 13, 58, 118, 124, 181: n = A,T,C or G
aaaacganattantctggagctcgcgcgcctgcaggtcgacactagtggatccaaagnaattcggcacgagtgccgccatcttggttccgcgttccctgcacaaaatgcccggcgaanccacanaaaccgtccctgctacagagcaggagttgccgcagccccaggctgagacagggtctnggaacagaatctgacagtgatgaatcagtaccagagcttgaagaacaggattccacccag

SEQ ID NO: 8785 - DNA, 399 bp, Homo sapiens
  misc_feature 5, 38, 41, 391: n = A,T,C or G
aaccntaatatgtgaagtctgtattaccatttactggnacnctagtggatccaaagaattcggcacgagtgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggngctcctgg

SEQ ID NO: 8786 - DNA, 184 bp, Homo sapiens
  misc_feature 18, 155, 178: n = A,T,C or G
gacaaaagctggagctcncgcgcctgcaggtcgacactagtggatccaaagaattcggcacgagcggcacgagagtacttctagagcggccgcgggcccatcgattttccacccgggtggggtaccaggtaagtgtacccaattcgccctatagngagtcgtattacaattcactggnccgtaa

SEQ ID NO: 8787 - DNA, 321 bp, Homo sapiens
  misc_feature 165, 266, 271, 310: n = A,T,C or G
tctggggctcgcgcgcctgcaggtcgacactagtggatccaaagaaattcggcacgagctcgtgccgaattcggcacgagcgagaatgaagactattctcagcaatcagactgtcgacattccagaaaatgtcgacattactctgaagggacgcacagttatcgngaagggccccagaggaaccctgcggagggacttcaatcacatcaatgtagaactcagccttcttggaaagaaaaaaaagaggctccgggttgacaaatggnggggnaacagaaaggaactggctaccgttcggactatttgtagncatgtacagaa

SEQ ID NO: 8788 - DNA, 355 bp, Homo sapiens
  misc_feature 248, 333, 336, 339: n = A,T,C or G
acgaaaataagctggagctcgcgcgcctgcaggtcgacactagtggatccaaagaattcggcacgagggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagcttgctgcttggggtcaagggacacgcctttntgaacgtccccctgcccctttacggacacccccctcgcttggacggctgggcacacgcctcccactggggtccagggagcaggcnggnggncacccacccttgggac

SEQ ID NO: 8789 - DNA, 400 bp, Homo sapiens
  misc_feature 13, 16: n = A,T,C or G
aaaaacgaaacantanctggggctcgcgcgcctgcaggtcgacactagtggatccaaagtaattcggcacgagctcgtgccgaattcggcacgaggaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagc

SEQ ID NO: 8790 - DNA, 303 bp, Homo sapiens
  misc_feature 8: n = A,T,C or G
aaaacganaatagctggggctcgcgcgcctgcaggtcgacactagtggatccaaagaattcggcacgagtcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctca

SEQ ID NO: 8791 - DNA, 206 bp, Homo sapiens
gtcgacactagtggatccaaagaattcggcacgagctcgtgccgaattcggcacgagaaaatagaaaaattagctgggcgtggtgccacgtgcccatagtcccagctacttgggaggctgaggcaggagaatcacttgaacccaggaggcagagattgccatgagccaacatcatgctattgtactccagagcgagactccatctc

SEQ ID NO: 8792 - DNA, 170 bp, Homo sapiens
gacaataagctggagctcgcgcgcctgcaggtcgacactagtggatccaaagaattcggcacgagacttcgcaaagcatacacaagtatcaatagccaaattgatcaagtggaagaaaggatatcagaggttaaagatcaactcaatgaaataaagcatgaaggcaagat

SEQ ID NO: 8793 - DNA, 400 bp, Homo sapiens
  misc_feature 206: n = A,T,C or G
gaacaataagctggagctcgcgcgcctgcaggtcgacactagtggatccaaagaattcggcacgagatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtatttt

SEQ ID NO: 8794 - DNA, 400 bp, Homo sapiens
  misc_feature 2, 20, 310: n = A,T,C or G
gngactagtggatccaaagnaattcggcacgaggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcngcgcctccgtcctagtgggtgttcctgtttctcctggccctgggtgggctagggcctgattcgggaagatgcctttgcagggaggggagg

SEQ ID NO: 8795 - DNA, 400 bp, Homo sapiens
gacaataagctggagctcgcgcgcctgcaggtcgacactagtggatccaaagaattcggcacgaggccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggc

SEQ ID NO: 8796 - DNA, 261 bp, Homo sapiens
  misc_feature 12, 13, 60: n = A,T,C or G
aaaacgaaacannaatctggggctcgcgcgcctgcaggtcgacactagtggatccaaagnaattcggcacgagctggaacagtatatggaggcttaatgtatatttcaggaggaattacccatgacactttccaaaatgagctcatgtgttttgacccagaaaaaaaaaaaaaaaaaaaaaaaaaaaaaaaaaaaaaaaaaaaaaaaaaaaaaaaaaaaaaaaaaaaaaaaaaaaaaaaaaaaattttttttttttttttt

SEQ ID NO: 8797 - DNA, 400 bp, Homo sapiens
  misc_feature 8, 18: n = A,T,C or G
aaaacganataatctggngctcgcgcgcctgcaggtcgacactagtggatccaaagaattcggcacgaggtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtc

SEQ ID NO: 8798 - DNA, 399 bp, Homo sapiens
  misc_feature 3, 37, 38, 51: n = A,T,C or G
gcncctatagtgagtcgtattacaattaactggccgnnaagtggatccaangaattcggcacgagtggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacct

SEQ ID NO: 8799 - DNA, 400 bp, Homo sapiens
  misc_feature 326, 349: n = A,T,C or G
gaaaataagctggagctcgcgcgcctgcaggtcgacactagtggatccaaagaattcggcacgaggtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggcttggtcagcgagcatttaacaaagggcctgacccttgaaaaggcttactgctgcatggntgtctgcatgaaccacgcctggngaaggagcctgggtgaaaaaaaccatccaaaagctgggcaaagatgattac

SEQ ID NO: 8800 - DNA, 400 bp, Homo sapiens
  misc_feature 105: n = A,T,C or G
gacaataagctggagctcgcgcgcctgcaggtcgacactagtggatccaaagaattcggcacgagaaacttacttgtattgagagcacacgcaattcctactggngaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaat

SEQ ID NO: 8801 - DNA, 201 bp, Homo sapiens
  misc_feature 18: n = A,T,C or G
agctggagctcgcgcgcntgcaggtcgacactagtggatccaaagaattcggcacgagcgcaccccctggatctggctgagggctcaggacacaggcccagccacccccaggggcctccacaggccgctgcatgacagcgatacagtacttaagtgtctgtgtagacaaccaaagaataaatgattcatggttttttttaa

SEQ ID NO: 8802 - DNA, 400 bp, Homo sapiens
  misc_feature 3, 293: n = A,T,C or G
gancaataagctggagctcgcgcgcctgcaggtcgacactagtggatccaaagaattcggcacgagtctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcngtctgcagtgccagcacgcaaatcccttcaccacagggtttcgttttgctggcttgaagacaaatggtcttagaattcattgagacccatagcttcatatggctgct

SEQ ID NO: 8803 - DNA, 168 bp, Homo sapiens
  misc_feature 19, 26, 123, 167: n = A,T,C or G
agtgagtcgtattacaatncactggncgactagtggatccaaagaattcggcacgagatctggttaggctggtgttagggttctttgtttttggggtttggcagagatgtgtttaagtgctgnggccagaagcggggggaggggggggggtttgggggaaatttttng

SEQ ID NO: 8804 - DNA, 400 bp, Homo sapiens
cgacaaaagctggagctcgcgcgcctgcaggtcgacactagtggatccaaagaattcggcacgaggccatatatgaaagcacattgagtttatggagtaaaaatgccttggtaaaacccaaggtgaagggctgggcgcggtggctcacgcctgtaatcccagcactttgggaggcttaggcgggtggatcacgaggtcaggagatcgagaccatcctggctaacacggtgaaaccccgtctctactaaaaatacaaaaaaattagccgagcctggtggcaggcatctatagtcccagctactcgggaggctgaggcaggagaatggcgtgaacccgggaggcggagcttgcagtgagccgagatggcgccacttgcactccagcccaggcgacagagcca

SEQ ID NO: 8805 - DNA, 400 bp, Homo sapiens
gaacaataagctggagctcgcgcgcctgcaggtcgacactagtggatccaaagaattcggcacgagcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatga

SEQ ID NO: 8806 - DNA, 360 bp, Homo sapiens
  misc_feature 3: n = A,T,C or G
ganaataagctggagctcgcgcgcctgcaggtcgacactagtggatccaaagaattcggcacgagaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 8807 - DNA, 400 bp, Homo sapiens
  misc_feature 3, 6, 388: n = A,T,C or G
agnctntgtgcccttgaaggtgcgacactagtggatccaaagaattcggcacgagggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcggcccaccaggtggtccaggactccgaggaccaaagggccagcaaggtgaaccgggtccaaagggaccagatggccctcggggtgaaattggtctgccaggacctcagggtccaccttggacctcaaggaccaagtggtcntgtccattcaaa

SEQ ID NO: 8808 - DNA, 191 bp, Homo sapiens
  misc_feature 49: n = A,T,C or G
gctggagctcgcgcgcctgaggtcgcactgtggatccaagtttcaaatnataggtcttttattgcctcatttaaatatcacaagtaggtcttaagtgtatctggcatcttctttctgtagccaggtaactcttagatcttattcatcagcctgctgaacagttcctttttcagagacatagataccatcca

SEQ ID NO: 8809 - DNA, 386 bp, Homo sapiens
  misc_feature 29, 40: n = A,T,C or G
aacgaacaataagtctggagctccgcgcncctgcaggtcngacactagtggatccaaagaattcggcacgaggttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttaaaaaaaaaaaaaaaaaa

SEQ ID NO: 8810 - DNA, 400 bp, Homo sapiens
  misc_feature 23, 134: n = A,T,C or G
gacaataagctggagctcgcgcncctgcaggtcgacactagtggatccaaagaattcggcacgagattttaactacaactcttgtcctctcggtgatggtattgctttggatttgttgtgcaactgttgctacngctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatat

SEQ ID NO: 8811 - DNA, 205 bp, Homo sapiens
  misc_feature 23, 139, 143: n = A,T,C or G
gaacaataagctggagcctcgcncgcctgcaggtcgacactagtggatccaaagaattcggcacgagggggggagtggggaggggtagcattgggagatatacctaatactagatgacgagttagtgggtgcacgtgcnccancatggcacatgtatacatatgtaactaacctgcacaatgtgcccatgtacccctaaaactta

SEQ ID NO: 8812 - DNA, 201 bp, Homo sapiens
tccaggtcgacactagtggatccaaagaattcggcacgagctcgtgccgaattcggcacgagcagttaaaagaaaaaaagaaactagtcccagatttgaaaacttgtaataaaattgaaactcactggttttctatgtctttttgaactcttgtaatcgagttttgatcatattttctattaaagtggctaacacctggct

SEQ ID NO: 8813 - DNA, 204 bp, Homo sapiens
  misc_feature 7, 190: n = A,T,C or G
gaacaanttagctggagctcgcgcgcctgcaggtcgacactagtggatccaaagaattcggcacgagctgatattagttctgatttctttttaacaaatgttatcatgattaagaaaatttccagcactttaatggccaattaactgagaatgtaagaaaattgatgctgtacaaggcaaataaagctgnttattaaccttgaa

SEQ ID NO: 8814 - DNA, 161 bp, Homo sapiens
  misc_feature 9, 102, 139: n = A,T,C or G
tgcaggtcngacactagtggatccaaagaattcggcacgaggagaactagtctcgagagtacttctagagcggccgcgggcccatcgattttccacccgggnggggtaccaggtaagtgtacccaattcgccctatagngagtcgtattacaattcactgg

SEQ ID NO: 8815 - DNA, 400 bp, Homo sapiens
  misc_feature 148: n = A,T,C or G
gaacaataagctggagctcgcgcgccttgcaggtcgacactagtggatccaaagtaattcggcacgaggctgcatatagaaaacctgaaaaataccatcaaccaatttgatatagttgacattcaagaaactccaccaaataactgcnggtgatccgcccacttcaccatcccaagtgctgggattacattttttttcaagcacacatagaacattagccaagctagattatatctgggccataagataagtctcaatatatttctaaagattaaaatcattgcttaaggccagaaattcaagaccaacctgggcaacatattaaatagatagaccccatctccataaaaagtaaaaaacttagctgagcatggtagcaccgtgcctatagtcccagcta

SEQ ID NO: 8816 - DNA, 267 bp, Homo sapiens
  misc_feature 6, 8, 194: n = A,T,C or G
ctcccncnccttgacggtcgacactagtggatccaaagtaattcggcacgagaaacgcccctcttcgtctgatccgtcctaatcacagcagtcctacttctcctatctctcccagtcctagctgctggcatcactattctactaacagaccgcaacctcaacaccaccttcttcgaccccgccggagggggagnaccccattctataccaacacctattctgatttttcggtcaccctgaaggttatattcttatcctaccagggct

SEQ ID NO: 8817 - DNA, 350 bp, Homo sapiens
  misc_feature 12, 15, 165, 167, 220, 226, 232: n = A,T,C or G
agctggagctcngcngccttcggggtcgacacctagtggatccaaagaattcggcacgaggcactatgtgtacggccccctcccgcaaagttttgacaaagagtgggtggccaagcaagaccaagaggatgctggacatgaaggtgaaccccatccagggcttancntccaagtgggactacgaaaagaacgagtggaagaagtgagagatgctggcctncgcctnaccttncgcctggctctgtcaccgccatgcaactccatgcctatttactggaaacctgttatgccaaacagttgtaccactgctaataaatgaccagtttacctgaaaaaaaaaaaaaaaaaaa

SEQ ID NO: 8818 - DNA, 322 bp, Homo sapiens
  misc_feature 3, 7, 272: n = A,T,C or G
tgnggtncgacactagtggatccaaagaattcggcacgagcttctggaaagccttcaaagtcaaaaatagctctactctttacatgactgcacagtatatatgactgcacagtatatcatgcagtaaatgaatctacagcaatttatgcagccattttcttgtttataattatttacttcgctttcactttttcatcactgcaaaaagaatccccatcccttttaactgtcactgtcttagtcctcaacccccatctcccaaggcctaaggnatcttctttctgtctctatagatttgcctattctggatatttcatattaa

SEQ ID NO: 8819 - DNA, 341 bp, Homo sapiens
  misc_feature 6, 16, 63, 224, 259, 305, 319, 335: n = A,T,C or G
aaaaancgaaacttantctggagctcgccgcgccctgcaggtcgacactagtggatccaaagnaattcggcacgagtccgccagctgaagtccgattcccacgggccgaaggaggacggaggcttcagacactcggaagcctttgaggcactccagcaaaagagtcagggactggactccaggctccagcacgtggaggatggggtgctctccatgcaggtggnttctgcgcgccaagaccgagagccttggagtcccntcctgtccaagagccaggagcacgagcagcgccttgcccgccctgnaggggccccttggnaaagccctcgggtccntaaaaa

SEQ ID NO: 8820 - DNA, 154 bp, Homo sapiens
  misc_feature 16, 18, 52: n = A,T,C or G
atctggaagctccgcncnccttcgacgggttcgacactagtggatccaaagnaattcggcacgagcttctgccgctcctggtgctgcttgtgtgctcgtttggtgcggacctggtacctcttttgtgaagcggcaggttgaggagactccggcg

SEQ ID NO: 8821 - DNA, 280 bp, Homo sapiens
  misc_feature 12, 17, 129, 131, 134: n = A,T,C or G
agctggagctcngcccnccttcgaaggtccgacactagtggatccaaagtaattcggcacgaggcgtggacacgtcctgaagcaggcgtgtggggctctttcagggaccacagaggagggagcagtttnangtnccagccaccctgaaatccccaataatggtgcctcagtgggccccagagttccagtgggagagtaccggttccctcctgtctccctcttcttttccgcacctccatctttgtggataataaataaatatgcacaggttctgagactg

SEQ ID NO: 8822 - DNA, 400 bp, Homo sapiens
  misc_feature 22, 31, 242: n = A,T,C or G
gacaataagctggagctccgcncgcctcgcnggtcgacacctagtggatccaaagtaattcggcacgagatgaaatgtctttaaaggatgaattagcatggtcttaaaatacatttctgaggttactagctgtattttgaattgtgggcaaaatgccgagaaacccagttggcatttatacaaaatgttgacctcaggtctatagttcttaaatgtggctaattctgtaacatagtcttggnattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaat

SEQ ID NO: 8823 - DNA, 309 bp, Homo sapiens
  misc_feature 3, 8, 33: n = A,T,C or G
ganaatangctggagctccgccgccgccttgcnggtcgacactagtggatccaaagaattcggcacgaggtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaa

SEQ ID NO: 8824 - DNA, 400 bp, Homo sapiens
  misc_feature 398: n = A,T,C or G
gaacaataagctggagctccgcgcgcctgcaggtcgacactagtggatccaaagaattcggcacgaggtctaagttggtctggtgtcaaatgagactggggcctaataaaaaggagcgtctatacaggagcttaaatgggctgtaccttgtagcattctgaggacaggcctgaattctgagaagcaaaagtggtaaaagtattgtccagtcctttttaagttggtggctgagcttggtgaggtgtgtttttaaaagacctttagtccgttctacttttcttgaagacggaggaccgtaagggatataaaaggtttcactgaaacctactaagaacctgaaaaactgcttggctgatttgactaataaaggctggtctgttatcagactatatagaggngg

SEQ ID NO: 8825 - DNA, 400 bp, Homo sapiens
  misc_feature 24, 30, 31, 37, 313, 326, 342: n = A,T,C or G
gaacacataatgctgaagctcgcncccttnnaggtgngacactagtggatccaaagaattcggcacgagccatcgtcttatgcggatggcggggaaaggcctccattcgaacttttgtgcccaagaatgaacggcttctcgtgccgaattcggcacgagtggaataggtgtggtgctgaaaaaaatgtatattctgttgatttggggggagagttctgtagatgtctattaggtccgcttagtgcagagctgagttcaattcctgggtatccttgttaactttctgtctcgcaatctgtctaatgttgacagnggggtgttaaagnctgccattattattgngggggagtctaagtctctttgtaggtcactcaggacttgctttatgaatctgggcgct

SEQ ID NO: 8826 - DNA, 400 bp, Homo sapiens
  misc_feature 3, 379: n = A,T,C or G
gancaaaagctggagctcgcgcgcctgcaggtcgacactagtggatccaaagaattcggcacgaggtcattcttgacatctatgtgaaagatcttgagactgaaatcttgctatacaataagattattttcatttttcagtgatcaaccctcttgaatgagagtccagcctgttttctagcaatgaagtcttctctgtaatagatccagttacttatagtaaatctggaagagggagaaatctcaattgactgaagaaagttttctaggtctcttgctttcagtagggccaatagtgaggagttaagctctgcttgaaacgtctccataggacacaatttccctgtgaactttgtatcttctctgcataacaagggggngttcttggtttaagagttcgt

SEQ ID NO: 8827 - DNA, 120 bp, Homo sapiens
  misc_feature 22, 24, 107, 109: n = A,T,C or G
gaaaaaagctggagctcgcgcncntgaggtcgacactagtggatccaaagaattcggcacgagcttcggggacgtggccccgctacagctcaaggtccgcgtgagcnanagggagttgag

SEQ ID NO: 8828 - DNA, 400 bp, Homo sapiens
  misc_feature 21, 23, 214: n = A,T,C or G
gacaaaagctggagcttcgcncncctgcaggtcgacactagtggatccaaagaattcggcacgaggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggnggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtg

SEQ ID NO: 8829 - DNA, 304 bp, Homo sapiens
  misc_feature 132: n = A,T,C or G
gaaaaagctggagctcgcgcgcctgaggtcgaactagtggatccaaagaattcggcacgagctcgagttttttttatttattgtcttcctgtaagaccttcgggtcaaggcagaggcaggaaactaactggngtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 8830 - DNA, 276 bp, Homo sapiens
gacaaaaagctggagctcgcgcgcctgcaggtcgacactagtggatccaaagaattcggcacgagaaaatactgtagatggcatctgtatgattaaacatataaagtaaaacaggtctgagggctttgtagatgattaaagtctccaccttcatgaagcattgtgtgtctgttctactctatgcagaatggtttacaggacatttgactggagtgtatatgtgtgaggtagaatgaacagaataaattagaggctacttaattccctaccttggaa

SEQ ID NO: 8831 - DNA, 400 bp, Homo sapiens
  misc_feature 303: n = A,T,C or G
gaaaaaagctggagctcgcgcgcctgaggtcgacactagtggatcaaagaattcggcacgagcagaaatcagctctattgacgaattctgccgcaagttccgcctggactgcccgctggccatggagcggatcaaggaggaccggcccatcaccatcaaggacgacaagggcaaccctcaaccgctgcatcgcagacgtggtctcgctcttcatcacggtcatggacaagctgcgcctggagatccgcgccattggatgagatccagcccgacctgcgagagctgatggagaccatgcaccgnatgagccacctcccacccgacttttgagggccgccagaacggtcagccagtgggctgcagaccctgagcggcatggtcggccgtcagatgagcttgg

SEQ ID NO: 8832 - DNA, 384 bp, Homo sapiens
gaacaataagctggagctcgcgcgcctgcggtcgacactagtggatccaaagaattcggcacgagggtatatgttccaggatctcccagtgaatgcctgaaaccatggaattgaaccctgtatgtactatgttttttcctatacatacatgcctccgataaagttttaatttataaattaggcacagtgatagattaataactaatgatagaacaatgataacaatatactgtaagaaaagttacaggaatgtggtctctcaaaatattgtacattggcctggcacagtggctcacgcctgtgatcccaacactttgggacacagagatgggagaatcgcttgaggccagtagtttgagagcagccttgggcaacataacaaga

SEQ ID NO: 8833 - DNA, 400 bp, Homo sapiens
gaacaataagctggagcctcgcgcgcctgcaggtccgacactagtggatccaaagaattcggcacgagaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatatttgttgtctgtgttgtaattcataacttttgataccatttctgatgtgtaaa

SEQ ID NO: 8834 - DNA, 357 bp, Homo sapiens
  misc_feature 3, 6, 32, 239, 255, 257, 284, 307, 318, 346: n = A,T,C or G
ganacntaagctggagctcgcgcgcctgaggncgacactagtggatccaaagaattcggcacgagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttnatcgagacattaaatntnagaacatatttttaactaaggatggancagtacaacttggagattttggnattgctagagntcttaatagtactgtagagctggctcgnacttgcatagg

SEQ ID NO: 8835 - DNA, 400 bp, Homo sapiens
  misc_feature 309: n = A,T,C or G
gaacaaaagctggagctcgcgcgcctgcaggtcgacactagtggatccaaagaattcggcacgaggctggacgttcacttccatgtgctcctctgagaaccatctgttggtctgatggtgctagatctgaagctggtgagcctcttggggcggcctcaagggctaacaagatctcaaatgcccttctctccatcatttgtggtatcctggattattgtgaaaatgtatagggattcctggggaagagttaaggattaaaatataaaggtttaaatataaataactttatatatatatgttttttcttgnaaaccaatatgttatatagtaggaagtttaattccttaactttggtttttctccctagcctttttatagccaacaagagcaaaagcacact

SEQ ID NO: 8836 - DNA, 118 bp, Homo sapiens
  misc_feature 2, 6, 53, 55, 58, 64, 69, 87: n = A,T,C or G
cncttncaggtcagacactagtggatccaaagaattcggcacgagctcgtgcngngtngcaacntgggnggacacggatctgctggnctctgcttttaaacacacattgcagcttcaa

SEQ ID NO: 8837 - DNA, 100 bp, Homo sapiens
  misc_feature 69, 70, 75, 76, 84, 85, 90: n = A,T,C or G
gacaaaagctggagctcgcgcgcctgaggtcgacactagtggatccaaagaattcggcacgagcggggnnaagcnnaccacacnnagtanacttatcttc

SEQ ID NO: 8838 - DNA, 400 bp, Homo sapiens
gaacaaaaagctggagctccgcgcgcctcgaaggtcgacactagtggatccaaagaattcggcacgagctaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttc

SEQ ID NO: 8839 - DNA, 398 bp, Homo sapiens
  misc_feature 255: n = A,T,C or G
gacaaaaagctggagctcgcgcgcctgcaggtcgacactagtggatccaaagaattcggcacgaggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggngtggacgttggccctgtttgctttttataaaccaaactctatctgaaatcccaacaaaaaaaatttaactccatatgtgttcctcttgttctaatccttgtcaaccagtgcaagtgaccgacaaaaattccagttatttattt

SEQ ID NO: 8840 - DNA, 115 bp, Homo sapiens
gaaaaagctggagctcgcgcgcctgaggtcgaactagtggatccaagaattcggacgagctcgtgccgaattcggcacgagataaatccttgttttgtcttcacccatgtgaaat

SEQ ID NO: 8841 - DNA, 221 bp, Homo sapiens
  misc_feature 21, 23, 29, 199, 206, 208: n = A,T,C or G
gacaataagctggagctcgcncncctcgnggtccgacactagtggatccaaagaattcggcacgagctcagttctttgttggatttcttgtttgtgttcttaaaaaaataaaaaaaactgatttccacgggaaaaacaaaaaaaaaaaaaaaaaaaaaaaaaaaaaaaaaaaaaaaaaaaaaaaaaaaaaaaaaaaaanaaaaaananaaaaaaacaaata

SEQ ID NO: 8842 - DNA, 400 bp, Homo sapiens
  misc_feature 3, 5, 165, 275, 312, 362, 389: n = A,T,C or G
tgngncccttgaggtgcgacactagtggatccaaagaattcggcacgaggccaaagaagccttgccatctggcgctcccatggctcttgaacatctccccttcgtttttgagggggtcatgccgggggagccaccagcccctcactgggttcggaggagagtcanggaagggccaagcacgacaaagcagaaacatcggatttggggaacgcgtgtcaatcccttgtgccgcaggggctgggcgggagagactgttctgttccttgtgtaactgngttgctgaaagactacctcgttcttgtcttgatgtgncaccgggggcaacttgcctgggggcgggggatggggggcagggtggaaancggctcccccatttttataccaaaggngctacatctat

SEQ ID NO: 8843 - DNA, 400 bp, Homo sapiens
  misc_feature 26, 29: n = A,T,C or G
gaacaataatgctggagctccgcccnccntgcaggtcgacactagtggatccaaagtattcggcacgagggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaaaacctaattgtcggtgttaacaaaatggattccactgagc

SEQ ID NO: 8844 - DNA, 218 bp, Homo sapiens
  misc_feature 8, 26: n = A,T,C or G
aacaatangcctggagctccgcgccncttgcaggtcgacactagtggatccaaagtaattcggcacgagctggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttc

SEQ ID NO: 8845 - DNA, 268 bp, Homo sapiens
  misc_feature 22: n = A,T,C or G
gacaaaagctggagctcgcgcncctgcaggtcgacactagtggatccaaagaattcggcacgagagagccgccggcttctgggctccaccacgcttttcatctgtcccgctgcgtgttttcctcttgatcgggaactcctgcttctccttgcctcgaaatggaccccaactgctcctgctcgccttgttggctcctgtgcctgtgccggctcctgcaaatgcaaaagagtgcaaatgccccctcctgcaagaagagctgctgctcctg

SEQ ID NO: 8846 - DNA, 400 bp, Homo sapiens
  misc_feature 6, 23, 378: n = A,T,C or G
gaaaangctggagctcgcgcgcntgcggtcgacactagtggatccaaagaattcggcacgagaaaaaacgaaagaagccagtttcccaatcccttgagtttccaacaagatacagtccttacagaccttatcgatgtgttcaccagggatgctttgttgcctttacgatacagcaaaacttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttnatgaaatgactcctgaagaaat

SEQ ID NO: 8847 - DNA, 100 bp, Homo sapiens
  misc_feature 19, 26, 31, 32, 77, 88, 91, 94: n = A,T,C or G
gacaataatgctggagctngtgcgcntgagnncgacactagtggatccaaagaattcggcacgagctcgtgcagaantacgtcaggtntgnctntgctgg

SEQ ID NO: 8848 - DNA, 335 bp, Homo sapiens
  misc_feature 12, 30, 38, 46, 47, 48, 54, 70, 96, 117: n = A,T,C or G
tattacaattcnctggccgaatgtatgatncaaagatncggcacgnnncttgtntcagattttaatcttntgaaaacattatattccttggatganggctcttgcttctgagaactnatttgtgaatacaacacagcttaaaatcacagggataagaaatacgtattttaaaagtcaagatgtaatgttatcagagacactaactctatcttcacatcctgatttggtggctcagtattctagcaagggaggaacagtctcctttatcatggatcatattatattattattatttactaattttttgagacagagtctcgcctctatttgcccag

SEQ ID NO: 8849 - DNA, 313 bp, Homo sapiens
  misc_feature 20, 85, 146, 152, 183, 204, 221, 246, 249, 267, 282, 290,300: n = A,T,C or G
gaaaaagctggagctcggcnctcgaggtcgacactagtggatccaaagaattcggcacgaggtgttttctgccgccgaagagggncccggtcccctccaggctcagtgtggctttctcccctgaccccccgccctagaactttttncaggtncctttttcttggaacttcctgggccccgggncccccaaggcgggagaagggntttgcccggatttcttncctggggctggggcctcttagggangancccaaattttgacacccnccaggaaaggcatanttaaaacnctttgaaaanaacgcaaaaaaaa

SEQ ID NO: 8850 - DNA, 279 bp, Homo sapiens
  misc_feature 6, 216: n = A,T,C or G
gaaaangctggagctcgccgcttgcggtcgacactagtggatccaaagtaattcggcacgagggaaaatacagccaggtcctagccaatggtctggacaacaagctccgtgaagacctggagcgactgaagaagattcgggcccatagagggctgcgtcaccttctggggccttcgtgtcccgaggccagcacaccaagaccactggccgccgtgnccgcacccgtgggtgtgtccaagaagaaataagtctgtaggccttgtcttgttaataaatagt

SEQ ID NO: 8851 - DNA, 108 bp, Homo sapiens
  misc_feature 108: n = A,T,C or G
gaaaaagctggagctcgcgcgctcgcggtcgcactagtggatccaaagaattcggacgaggcggcctatcctgatccttggaggaggaggaagaggaggccactgtgn

SEQ ID NO: 8852 - DNA, 242 bp, Homo sapiens
gacaataagctggagctcgcgcgccttgcggtcgacactagtggatccaaagaattcggcacgagctccaaagctgctgataaaacccaagaaaccaacaaggaaacgaaaacagaggctaaagaagtaacaaatgcatctgcagcaggcaacaaggcaccagggaaagggaatatgatgagcaaccttttttggaaaagctgctatgaataaatttaaagtcaatttggactcagaacaaa

SEQ ID NO: 8853 - DNA, 367 bp, Homo sapiens
  misc_feature 107, 150, 167, 181, 225, 273, 274, 319, 333: n = A,T,C or G
gacaaaagctggagctcgcgcgcctgcggtcgacactagtggatccaaagaattcggcacgaggaaatcttcaggtccaccttcttactttattaaaagggaatcgnggggctggacagactttctaatgaacccaatggttatgatgangggtcttcctttattgntatttgggcttctncctaaagggggcaacacaagtgatcctgacatgagacgggaaanggagcagtcaatgaatatgctgaattccaaccatgagttgcctgatgnnttctgagttcatgacaagactcttctcttcaaaatcatctgggcnaatctagcagcggnaggagtaaaacagggcaaaagtggggcttggcaa

SEQ ID NO: 8854 - DNA, 182 bp, Homo sapiens
  misc_feature 87, 160, 172: n = A,T,C or G
aaaaagctggagctcgcgcgcctgcaggtcgacactagtggatccaaagaattcggcacgagaaccctgtcccaagtggccgacccnttctggatcacatcaaggaggtggcaggagccagagccgtggggttttggtgggggaacttttgaatgggtgnttccaaggggtncccttgaagg

SEQ ID NO: 8855 - DNA, 195 bp, Homo sapiens
  misc_feature 123, 168: n = A,T,C or G
agaaataagctggagctcgcgcgcctgcaggtcgacactagtggatccaaagaattcggcacgagctcgtgccgaattcggcacgagcagcctcccgctggcctggggcagcctccgtccgtncatctgtctggcctgaggaccaggggccggtggtgggcgggcggnacacagcgccttgctcagaaccgcctt

SEQ ID NO: 8856 - DNA, 400 bp, Homo sapiens
gaacaataagctggagctcgcgcgcctgcaggtcgacactagtggatccaaagaattcggcacgaggatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgaga

SEQ ID NO: 8857 - DNA, 400 bp, Homo sapiens
gaaaataagctggagctcgcgcgcctgcaggtcgacactagtggatccaaagaattcggcacgaggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaaggaagcttgctgtgtgggcctggaggccggcatcaaccccacagaccatctcatcacagcctaccgggctcacggctttactttcacccggggcctttccgtccgagaaattcttcgcagagcttacaggacgaaaaggaggttgtgctaaaagggaaaggaggatcgatgcacatgt

SEQ ID NO: 8858 - DNA, 400 bp, Homo sapiens
gacaataagctggagctcgcgcgcctgcaggtcgacactagtggatccaaagaattcggcacgaggtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactggggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggg

SEQ ID NO: 8859 - DNA, 400 bp, Homo sapiens
  misc_feature 6, 24: n = A,T,C or G
gacaanagctggagctcgcgcgcntgcggtcgacactagtggatccaaagaattcggcacgaggattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacaggaaaaatcttgtgctagaatactttttaaaaggtattttgaatactattaaaactgcttttt

SEQ ID NO: 8860 - DNA, 400 bp, Homo sapiens
gaacaataagctggagctcgcgcgcctgcaggtcgacactagtggatccaaagaattcggcacgaggaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgattccttcaggtt

SEQ ID NO: 8861 - DNA, 128 bp, Homo sapiens
  misc_feature 23, 30, 61, 91, 95, 103, 105: n = A,T,C or G
agtgagtcgtattacaattaacnggccganagtggatccaaagaattcggcacgaggagtnttcggggagaaatcacggctctcgaagctnatanaattcaangngaggaagcaagtgacaaggcacg

SEQ ID NO: 8862 - DNA, 400 bp, Homo sapiens
  misc_feature 25: n = A,T,C or G
gaacaataagctggagctccgcgcnctcgcagggtcgacactagtggatccaaagaattcggcacgagtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaaccataa

SEQ ID NO: 8863 - DNA, 400 bp, Homo sapiens
  misc_feature 25, 39, 186: n = A,T,C or G
gaacacataatgctggagctctgcngccccttgaaggtncgacactagtggatccaaagaattcggcacgagtaaatgcggtggatcgacaaaagaaccattgaaaaatttgagaaggaggctgctgagatgggaaagggctccttcaagtatgcctgggtcttggataaactgaaagctgagcgngaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagaccccgagagcatgccctt

SEQ ID NO: 8864 - DNA, 242 bp, Homo sapiens
  misc_feature 20, 22: n = A,T,C or G
gacaataagctggagctcgncnctcgcggtcgacactagtggatccaaagaattcggcacgaggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgtt

SEQ ID NO: 8865 - DNA, 400 bp, Homo sapiens
  misc_feature 30: n = A,T,C or G
gaacaataagctggagctccgcgcgcttgnaggtcgacactagtggatccaaagaattcggcacgagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaaagtttttgcctatccctttccttaaaatataagaaataaaaggagctct

SEQ ID NO: 8866 - DNA, 348 bp, Homo sapiens
  misc_feature 345, 347: n = A,T,C or G
cgacaaaagctggagctcgcgcgcctgcaggtcgacactagtggatccaaagaattcggcacgagattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaantng

SEQ ID NO: 8867 - DNA, 400 bp, Homo sapiens
  misc_feature 2, 17, 27, 33: n = A,T,C or G
gncctttagtgagtcgntacatttagntgggcnctagtggatccaaagaattcggcacgagccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaaga

SEQ ID NO: 8868 - DNA, 398 bp, Homo sapiens
  misc_feature 20, 25, 155, 217: n = A,T,C or G
gaaaaagctggagctcgcgnctcgnggtcgacactagtggatccaaagaattcggacgaggtcggtctgggtgttaagtgctccaaggaggtggccaccgccttccgtggggccatcatcctggccaagctctccatcgtccccgtgcgcagagnctactgggggaacaaggatcggcaagccccacactgtcccttgcaaggtgacaggcccgctncggttcttgtgcttggtaccgccctcatccctgcacccaggggcactggcattcgtctccgcacctgtgcctaagaagctgctcatgatggctggtatcgatgactgctacacctcagcccggggtggcacttgcaccccttggcaacttcgcaaggccacctttgatgccatttctaaga

SEQ ID NO: 8869 - DNA, 400 bp, Homo sapiens
  misc_feature 20, 25, 31, 100: n = A,T,C or G
gaacaataagctggagctcngcccncctcgnggtcgacactagtggatccaaagaattcggcacgagcctcaaggggccatcctgtcccaccatgcagtnccctagcttagagcctccctcaattccccctggccaccaccccccactctgtgcctgaccttgaggagtcttgtgtgcattgttgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttca

SEQ ID NO: 8870 - DNA, 113 bp, Homo sapiens
  misc_feature 29, 33: n = A,T,C or G
gacaataagctggagctccgcgcgcttgnggtngacactagtggatccaaagaattcggcacgagtggagctgggtcaggttgagtgtcaattgaaaaccacactggaagtgc

SEQ ID NO: 8871 - DNA, 400 bp, Homo sapiens
  misc_feature 21, 23, 29: n = A,T,C or G
gacaataagctggagctcgcncncttcgnggtcgacactagtggatccaaagaattcggcacgagccaagcagaagtcagataaggctatactgttagagaatgatctttccactgaaaacaagctaaaagtgttaaagcacgatcgcgaccactttaaaaaagaagagaaacttagcaaaatgaaattaggaagaaaaagaatggctctttaaagatgaaaaatcactgaagagaatcaaagacacaaacaaagacatcagcaggtctttcccgagaagagaaagaccgttcgaataaagcagaaaaggagagatcgctgaaggaaaagtctccgaaagaagaaaaactgagactgtacaaagaggagagaaagaagaaatcaaaagaccggccctcaa

SEQ ID NO: 8872 - DNA, 309 bp, Homo sapiens
  misc_feature 102, 181, 183, 235, 245, 257: n = A,T,C or G
gacaataagctggagctccgcgcgcttcgcggtcgacactagtggatccaaagaattcggcacgagctcgtgccgctcagaactgtttgtttcaattggccntttaagtttagtagtaaaagactggttaatgataacaatgcctcgtaaaaaccttcagaaggaaaggagaatgttttgngnaccacttttggttttctttttggcggggggaggttttaagttattagttttnaaaatcagtnctttttaatggnaacaacttgaccaaaaatttgtcacagaatttttgagacccattaaaaaagt

SEQ ID NO: 8873 - DNA, 129 bp, Homo sapiens
  misc_feature 19, 22, 62: n = A,T,C or G
acaataagctggagctccnccnctcgaaggtcgacactagtggatccaaagaattcggcacnagattatttgagtgttgttggaccatgtgtgatcacgactgctatctgaataaaataaggatttgtc

SEQ ID NO: 8874 - DNA, 100 bp, Homo sapiens
  misc_feature 4, 10, 54, 69, 84, 86, 87, 89: n = A,T,C or G
tgancatttngctgggcgctagtggatccaaagaattcggcacgaggagacctnatgagcacagaagancacttatgcttctananngnccgatgaagag

SEQ ID NO: 8875 - DNA, 207 bp, Homo sapiens
  misc_feature 110, 134, 141, 181, 188: n = A,T,C or G
gaacaattagctggagctcgcgcgcttgcaggtcgacactagtggatccaaagaattcggcacgagctggatccactgggaccgcccagcaagagggaaccgcagccgtnaatatggagcgggagaggccgagntttcaancccgagctaagatcgaggaagctccatccctcctgtcctnatcacanggggacatggttcggggga

SEQ ID NO: 8876 - DNA, 325 bp, Homo sapiens
  misc_feature 22, 86, 87, 137, 148, 169, 315: n = A,T,C or G
tggagctcagagcgccttcganggtcgacactagtggatccaaagaattcggcacgagccccctccccccgagcgccgttccggtnngcaccgggcttcggttccgagtttcaaggctcgtgctaagctagcgccgncgtccgtcttncccttcagtcgccatcatgantatctaccggggacctcatcagccacgatgagatgttctccgaaatctacaagatccgggagatcgcggacggttgtgcctggaggtggagggggaagatggcagtaggaaagaaggtgaacccgatctaccagaaaattttcctnaccgatggca

SEQ ID NO: 8877 - DNA, 400 bp, Homo sapiens
  misc_feature 6, 28, 273: n = A,T,C or G
gacaanagctggagctccgcgcgcctgnggtcgacactagtggatccaaagaattcggcacgagaggcagtcatggatcaggtaatgcagtttgttgagccaagtcggcagtttgtaaaggactccattcggctggttaaaagatgcactaaacctgatagaaaagaattccagaagattgccatggcaccagcaataggatttgctataatgggattcattggcttctttgtgaaattgatccatattcctattaataacatcattgttggnggctgaatacattttggaagagagtttttcatcttagagattggtgaacaagtgtgagggtgtgagaaactcacagaatacaaatttgcctgtatgttttgtgggtttttttttttcctttcaagat

SEQ ID NO: 8878 - DNA, 219 bp, Homo sapiens
  misc_feature 5, 7, 75: n = A,T,C or G
gacantnagctggagctcgcgcgctcgaggtcgacactagtggatccaaagaattcggcacgaggtactactgtnaacatagtgtaaatggttctcaaaagcttaccagtgtggacttggtgttacgccaccgctgtttacctcatacagtacgtgtcctgtttttaaaatatacaattattcttaaaaataaattaaaatctgtatacttacatttca

SEQ ID NO: 8879 - DNA, 400 bp, Homo sapiens
  misc_feature 19, 29, 66: n = A,T,C or G
gacaataagctggagctcngcgcgctcgnggtcgacactagtggatccaaagaatattcttaaagnattaactttgaattttctccatatttttatgtttttaaatattatgatgtaaaattatttggaggatccaatacatatcattaagaattatgtttgtcaggcaataacaaagaatgttaccccaacaaataacagcagtttaaaaacttggattgttattttctcataaaaatcttgagtttggcagtctaagggctcattatgctgtctctgttccaagacattctcaaagattgaaactcttgctacctttctgctcaaatatatgcctcaaagatggtctccattctcaagatcaactcgtgttccagtaggtgcttcaggtctggtcatc

SEQ ID NO: 8880 - DNA, 227 bp, Homo sapiens
  misc_feature 6, 95, 167: n = A,T,C or G
gaacantaagctggagctccgtgcgcctcgaaggtcgacactagtggatccaaagaattcggcacgaggttaaattgaacactgttttggatgcntgttgaaagacatgcttttatttttttgtaaaacaatataggagctgtgtctacctattaaaagtgaaacanttttggcatgtttgttaattctagtttcatttaataacctgtaaggcaccgtaagtttaa

SEQ ID NO: 8881 - DNA, 485 bp, Homo sapiens
  misc_feature 10, 19, 28, 44, 62, 69, 72, 73, 85, 87, 96, 97, 100, 101,104, 105, 112, 119, 127, 133, 134, 136, 138, 140, 144, 145,156, 157, 158, 159, 162, 172, 173, 174, 179, 182, 193, 194,202, 205, 213, 218, 225, 227, 229, 241, 256, 257, 277: n = A,T,C or G
  misc_feature 294, 359, 457: n = A,T,C or G
gtgagccgtnttacctttngctgggacnctagtggatccaaagnaattcggcacgagcgtgntcttganganntatcttggcctncncgttgattnntanngcnngcacggngaatgcnctcagagnacattnntngnanaganntttgcacatcnnnnaanagtgaagttnnnggcgnggntgctggatttnnctgggctnacnactttatnggaancaaaagntngnaaatatcaactnacagcctttaccagnntactacagggaaactttttnccctatttaaaacatgntcttaggcaacaattttatttataattatcagctaaattacatttagtataatactcaaatggantaatcagtagtttatacctttataaatacagtttagtaagccaaggaatcagggaaataatcctttaaaataatgtactaatagttaagatgcctcanggggttttttctgattaaatttgctctt

SEQ ID NO: 8882 - DNA, 400 bp, Homo sapiens
  misc_feature 2, 7, 32: n = A,T,C or G
cnctcgngggtcgacactagtggatccaaagnaattcggcacgagcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtcacactttgttttcacataatcggatatgatatgaagccagccataaagcccaggatgaccaagaatataatttgaaaatgaatttgtttactatccttaatggtaagcatcaccttaagcacatat

SEQ ID NO: 8883 - DNA, 133 bp, Homo sapiens
  misc_feature 11, 14, 32, 55, 62, 69, 76, 85, 93, 95, 116, 119: n = A,T,C or G
cccccttcganggntccgacactagtggtatncaaataattcggcacgagggcangctgccntacactnagcggantgccttggngcctaccngnaaaaggacgtgaaccagcagntanttctggcaggagct

SEQ ID NO: 8884 - DNA, 224 bp, Homo sapiens
  misc_feature 30, 97, 103: n = A,T,C or G
gacaataagctggagctccgcgcgcttcgnggtcgacactagtggatccaaagaattcggcacgagctctgaagcccctgtgcgggttctgcccctnctgcancggaaggagaagaaagatgagaagaaggaggagtctgaagagtcaagatgatgacatggggatttggccttttttgattaaaattccctgctcccctgcaaataaagcctttttacacatc

SEQ ID NO: 8885 - DNA, 297 bp, Homo sapiens
gaaataagctggagctcgcgcgcctgcaggtcgacactagtggatccaaagaattcggcacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagtt

SEQ ID NO: 8886 - DNA, 109 bp, Homo sapiens
  misc_feature 13, 33, 46, 54, 105: n = A,T,C or G
cccctcagggtcngacactagtggatccaaagnaattcggacaggnctggcatnaccctgccaaaggtgatggggtcgcctacacatgtgtatgtcactgtgagnggat

SEQ ID NO: 8887 - DNA, 100 bp, Homo sapiens
  misc_feature 10, 21, 29, 40, 42, 45, 53, 56, 68, 74, 80, 92, 97: n = A,T,C or G
ctgtcgtttngcccgctcgtnacagtcanaacgcatttcncnatntgttgtgngantttacgcattgncagacnagtcgnaatgggcgatcnttcgntca

SEQ ID NO: 8888 - DNA, 100 bp, Homo sapiens
  misc_feature 3, 14, 34, 39, 46, 49, 51, 54, 73, 82, 92, 93, 95: n = A,T,C or G
ttntgccgctcgtnacagtcaccaacgcatttcnccatntggtggngantntangattgccagccgagtgaangggcgatcnttcgctcacnngngaaag

SEQ ID NO: 8889 - DNA, 131 bp, Homo sapiens
  misc_feature 13, 15, 25, 42, 58, 62, 64, 68, 73, 84, 92, 94, 95, 110, 111: n = A,T,C or G
acaacgaatttcncnctgtgttggngaatataccatggagcnagtgaacgcgcgatcnttcnanaacntgaanacagcccgtcncatcactnannctcctaaacaaagtnngagaatatgtctatacgaga

SEQ ID NO: 8890 - DNA, 100 bp, Homo sapiens
  misc_feature 8, 32, 39, 40, 41, 42, 43, 47, 51, 58, 62, 69, 88, 89, 93,94: n = A,T,C or G
cgcccttntgcccgctggtcacaggaagaacncatttcnnnnnttgntgtnggctatnccancggcagncgagttgcaatgccgatcnntcanngaacac

SEQ ID NO: 8891 - DNA, 101 bp, Homo sapiens
  misc_feature 4, 18, 28, 39, 41, 45, 46, 53, 61, 62, 63, 67, 77, 79, 86: n = A,T,C or G
tatnacgatcggcagacnagtgcaatgngcgatcattcnanaacnngcatagngcccggtnnnactnaggtggtgcncnctacaanaaagaagggagaaaa

SEQ ID NO: 8892 - DNA, 100 bp, Homo sapiens
  misc_feature 2, 3, 20, 22, 24, 36, 38, 40, 41, 50, 66, 71, 84, 85, 97: n = A,T,C or G
gnnaccaacgcatttacacncntnctgttagtgagnantnntaccgcatngacagaccgagtgganatggncgcatcattttcnntaacgtgggtanagc

SEQ ID NO: 8893 - DNA, 100 bp, Homo sapiens
  misc_feature 8, 13, 44, 46, 52, 61, 62, 73, 79, 84, 85, 88, 98: n = A,T,C or G
tttcacgncgcangcaacgcctttacagtctattacgatgctcnanacagtnccggatttnncgcgtgtggtngaaaanttagnnttncagcctgtgnca

SEQ ID NO: 8894 - DNA, 100 bp, Homo sapiens
  misc_feature 2, 15, 29, 41, 43, 48, 52, 59, 61, 62, 64, 65, 66, 69, 70,71, 73, 74, 78, 79, 80, 85, 87, 89, 95: n = A,T,C or G
cncctttaccagtcnttacgatgacgcanagagagtaccangnatttntccntgtggtngnnannntannntnncagnnngtggnantngccatnttcga

SEQ ID NO: 8895 - DNA, 100 bp, Homo sapiens
  misc_feature 14, 16, 34, 53, 58, 73, 75, 88, 90, 93, 94: n = A,T,C or G
ttttgccgctggtnanaggacgacgcatttcacnatttgtgtggcgaatatangcatnggcagacgagtgaangngcgatcatttcgntnacnngcataa

SEQ ID NO: 8896 - DNA, 100 bp, Homo sapiens
  misc_feature 5, 7, 27, 41, 44, 55, 60, 69, 72, 73, 78, 79, 82, 92, 96: n = A,T,C or G
cggcncnagggacccctttacctgtcnttacgatgcgcaantantaccggatttngtccngatggtcgnaannttagnnttncagcctgtgncacngcca

SEQ ID NO: 8897 - DNA, 100 bp, Homo sapiens
  misc_feature 12, 26, 46, 49, 55, 60, 63, 69, 70, 73, 79, 92, 96: n = A,T,C or G
tcgggcgggganccctttacctgtcnttacgatgcgcaagtagatnccngatttngtccnganggtcgnnaanttaggnttccagcctgcgncacngcca

SEQ ID NO: 8898 - DNA, 100 bp, Homo sapiens
  misc_feature 4, 17, 29, 40, 42, 43, 45, 48, 52, 58, 60, 61, 66, 87, 95: n = A,T,C or G
gccngttttgcccgctngtcacaggcacnaacgcatttcncnntntgntgtncggctntnncgcancgccagaccgagttgcaatgnccgattcnatttc

SEQ ID NO: 8899 - DNA, 121 bp, Homo sapiens
  misc_feature 5, 7, 27, 41, 42, 43, 44, 51, 60, 83, 92, 96, 104, 109: n = A,T,C or G
gcccntnttgcccgctggtcacagganaacgcaatttcacnnnntggtagncggcttatncgcatcggcagacgagtgcaatngccgatcanttcncagaacgngacanctacacctcgtc

SEQ ID NO: 8900 - DNA, 108 bp, Homo sapiens
  misc_feature 6, 11, 31, 46, 47, 50, 53, 54, 58, 65, 66, 68, 76, 80, 85,88, 93, 96: n = A,T,C or G
ctatancgatngacagccgagttggaatggncgattcttttcgctnntcntgnntaancaccganngncacttcantgangctcnctncaacnccnagtagggaggaa

SEQ ID NO: 8901 - DNA, 100 bp, Homo sapiens
  misc_feature 11, 13, 16, 26, 29, 32, 36, 48, 53, 56, 58, 61, 66, 68, 75,84, 87, 91, 98: n = A,T,C or G
aaaattagggntncanacactgtcgntantgncatnttcgccaaaccngcganacncngtnatatnanaacgatncctgaaccnatngggngatgganat

SEQ ID NO: 8902 - DNA, 100 bp, Homo sapiens
  misc_feature 2, 22, 27, 34, 37, 48, 51, 53, 54, 57, 63, 78, 81, 82, 83,99: n = A,T,C or G
cngtctattacgatgacgcaantagtnccgtganttnagtcgctgctngtngnnaanttaggnttccagaagtgtcgnctnnncgccattttcgttcgnc

SEQ ID NO: 8903 - DNA, 100 bp, Homo sapiens
  misc_feature 17, 22, 28, 35, 38, 45, 48, 50, 53, 55, 56, 58, 64, 65, 68,72, 74, 76, 77, 78, 80, 81, 82, 96: n = A,T,C or G
gtctattacagatgccncaagntagatnccgtganttnagtcgcngcncngtngnnantgtagnnttncagncngnnncnnncgccattatttcgntcta

SEQ ID NO: 8904 - DNA, 104 bp, Homo sapiens
  misc_feature 2, 7, 27, 34, 57, 63, 64, 67, 73, 75, 76, 77, 78, 80, 90,96, 97, 98: n = A,T,C or G
cntgctnttacgatgcgcaaggtagtnccgtgantttagtccgtgatgtgtcgaaanattagnnttncagccngnnnnantgccattttngctctnnngagaaa

SEQ ID NO: 8905 - DNA, 100 bp, Homo sapiens
  misc_feature 8, 16, 28, 42, 48, 53, 56, 64, 69, 70, 72, 73, 79, 96: n = A,T,C or G
ttactggntcaggganccctttaccgcnttacgatgcgcaangtagtnccggnttngccggacngtcgnnannttaggnttccagccgtgcgcacngcca

SEQ ID NO: 8906 - DNA, 101 bp, Homo sapiens
  misc_feature 11, 16, 30, 36, 42, 55, 60, 63, 69, 73, 77, 83, 86, 87, 88: n = A,T,C or G
acccctttacntgctnttacgatgcgcaangtagtnccgganttagtcgcgtgtngtcgnaanattagntttncagncgtgtngcnnngccacttttcgct

SEQ ID NO: 8907 - DNA, 127 bp, Homo sapiens
  misc_feature 7, 29, 33, 35, 40, 49, 53, 55, 65, 67, 70, 73, 74, 113, 114: n = A,T,C or G
ttcccgnatcgattcaacgcagggctggngccntnttccngctggtcanaggnanacgcatttcncnctntgnngttcggctgtccgagtgtgcagcgagtgagtgcccgttnntcaagaacacgca

SEQ ID NO: 8908 - DNA, 100 bp, Homo sapiens
  misc_feature 6, 15, 35, 39, 40, 48, 61, 63, 68, 71, 72, 76, 77, 82, 84,86, 88, 91, 94, 95, 97: n = A,T,C or G
aggganccctttacngtctattacgatgcgcaagntagnnccagtgantttagtccgtgancngtcgnaanntagnnttccngncntncgncanngncat

SEQ ID NO: 8909 - DNA, 103 bp, Homo sapiens
  misc_feature 9, 14, 18, 20, 23, 24, 32, 33, 38, 41, 50, 52, 53, 55, 56,57, 61, 64, 65, 78, 80, 82, 91, 93, 94: n = A,T,C or G
tcctgtggngaaanattngngtnncagccggnngcacngcnttttcgctncnngnnnaagncgnncatacttagcagngntncttaactcngnncgcgattat

SEQ ID NO: 8910 - DNA, 100 bp, Homo sapiens
  misc_feature 27, 33, 43, 47, 52, 61, 87, 93, 95: n = A,T,C or G
ttcacggccccaggaaacgcctttacntgtctnttacgatgcncaanaagtnccggatttntccgtgtggtcgaaaaattagggttncagccngnggcac

SEQ ID NO: 8911 - DNA, 100 bp, Homo sapiens
  misc_feature 9, 11, 31, 41, 55, 57, 62, 72, 73, 76, 78, 89, 97, 99: n = A,T,C or G
ttccggcgnangcaacgcctttacctgtctnttacgatgcncaagacagtaccgngnatttntccgtgtgtnngananattagggttgncagccggngnc

SEQ ID NO: 8912 - DNA, 100 bp, Homo sapiens
  misc_feature 23, 27, 37, 43, 59, 61, 62, 64, 76, 84, 89: n = A,T,C or G
ccgatcgcatcaacgcgttttgngccnttttcccgcnggtcanaggaaaacgcatttcncnntntggtgtcggctntcacgagnggcancgagtgaatgg

SEQ ID NO: 8913 - DNA, 100 bp, Homo sapiens
  misc_feature 4, 29, 37, 40, 52, 57, 60, 67, 76, 81, 83, 84: n = A,T,C or G
accngtctattacgatgacgcaagtagtnccagtganttnagtcgctgctcngtcgnaanattaggnttccagccntgtcncnntcgccatttttcgtta

SEQ ID NO: 8914 - DNA, 102 bp, Homo sapiens
  misc_feature 27, 28, 30, 35, 39, 48, 75, 77, 80, 87, 94: n = A,T,C or G
ttcacgcataggcatccagacggccgnncntaggngccntatttgccngctggtgcacaggacgaacgcatttcncnatntggtgtncggactnatcacgca

SEQ ID NO: 8915 - DNA, 100 bp, Homo sapiens
  misc_feature 22, 24, 28, 32, 34, 37, 64, 66, 69, 81, 87, 88, 93: n = A,T,C or G
ttcacgatcgcatcaacgccgntntggngccntnttnccgctggtcacaggacaacgcatttcncnctntggtgtcggctntccganngccancgagtga

SEQ ID NO: 8916 - DNA, 100 bp, Homo sapiens
  misc_feature 9, 11, 33, 48, 53, 81, 87, 88, 91: n = A,T,C or G
tttcacggngncaggaacgcctttacctgtctnttacgatgcgcaagntagtnccgtgatttgtccgtgctgtgtcgaaanattagnnttncagccggtc

SEQ ID NO: 8917 - DNA, 100 bp, Homo sapiens
  misc_feature 5, 11, 15, 22, 27, 30, 34, 35, 37, 43, 46, 52, 54, 56, 59,70, 72, 74, 87, 88, 96, 97, 99: n = A,T,C or G
caagnacagtnccgngatttgnccgtntgntggnnanttaggnttncagccngngnacngcgattttcgntncntgggcaagccgtnnatattagnngng

SEQ ID NO: 8918 - DNA, 100 bp, Homo sapiens
  misc_feature 13, 27, 33, 52, 53, 59, 61, 68, 71, 77, 79, 80, 81: n = A,T,C or G
cctttaccgtctnttacgatgcgcaangtagtnccgtgatttgtcgcgtgcnngtcgananattaggnttncagccngnnncactgccattttcgctcac

SEQ ID NO: 8919 - DNA, 100 bp, Homo sapiens
  misc_feature 11, 20, 27, 36, 38, 40, 43, 46, 52, 59, 64, 68, 81, 90, 95,96, 99: n = A,T,C or G
gccgttttccngctggtcanaggaaangcatttcanantntgntgncgggtntacgagnggcancgantgaatggccgatnttccaaacncgcanncant

SEQ ID NO: 8920 - DNA, 204 bp, Homo sapiens
  misc_feature 22, 32, 62, 64, 65, 67, 80, 89, 108, 112, 132, 145, 161, 183: n = A,T,C or G
caccgatcgcatcaacgcggcntggtgccctnttcccgctggtcacaggaaaacgcatttcncnntntggtgttcggctntcacgcagnggcgcgagtgaatggccgnttcnttattgaacacgcacacacnctgttgcccctgntgataccccataacanaatgggaaaaggctgtcttccngatcgcccatcgagagcgccc

SEQ ID NO: 8921 - DNA, 100 bp, Homo sapiens
  misc_feature 19, 26, 42, 46, 48, 58, 60, 61, 63, 68, 75, 83: n = A,T,C or G
cgatcgcatcaacgcggcntgtgccnttttcccgctggtcanaggnantcgcatttcncnntntggtntcggctntcacgagnggcagcgagtgaatgcc

SEQ ID NO: 8922 - DNA, 105 bp, Homo sapiens
  misc_feature 15, 24, 34, 56, 67, 68, 70, 83: n = A,T,C or G
cacgatcgcatccancggcgggcntggtgccctnttgcccgctggtcacaggaaancgcatttcacnntntggtgttcggctntcaccagcggcagcgagtgaat

SEQ ID NO: 8923 - DNA, 117 bp, Homo sapiens
  misc_feature 4, 6, 36, 38, 39, 41, 54, 60, 61, 77, 84, 89, 91, 94, 95,96, 98: n = A,T,C or G
gccntnttgccgctggtcacaggacaacgcatttcncnntntggtgttcggctntccgannggcagcgagtgaatgngcgatcnttctntnacnnncncacgccggcgcacctgtga

SEQ ID NO: 8924 - DNA, 100 bp, Homo sapiens
  misc_feature 9, 23, 29, 42, 51, 54, 60, 61, 70, 74, 91, 93, 94, 96, 98: n = A,T,C or G
acctgtctnttacgatgcgcaangtagtnccggatttgtccntgtggtcgnaanattagnnttccagccngtgncactgccattttcgctncnngngnaa

SEQ ID NO: 8925 - DNA, 100 bp, Homo sapiens
  misc_feature 4, 22, 31, 37, 38, 43, 46, 57, 61, 62, 64, 65, 66, 74, 75,80, 83, 89, 99: n = A,T,C or G
tttnacacgtgtgttggagaanataggattncagacnngtgantgngcgattttcgntacnngnnnaagccggnngcatntgngacacnccattaaacng

SEQ ID NO: 8926 - DNA, 100 bp, Homo sapiens
  misc_feature 9, 11, 12, 14, 21, 27, 35, 39, 41, 51, 56, 61, 65, 67, 68,69, 76: n = A,T,C or G
cgcatttcncnntntggtgtncggctntcacgatnggancnagtgaatggncgatnttctntaanannncacgccngtcgcacctgtgataccccataaa

SEQ ID NO: 8927 - DNA, 100 bp, Homo sapiens
  misc_feature 2, 4, 7, 10, 15, 16, 18, 19, 21, 24, 27, 30, 38, 39, 43,48, 49, 53, 54, 56, 69, 71, 72, 73, 74, 76, 77, 78, 86,87, 90, 95, 96: n = A,T,C or G
antnccncgnttttnncnntntgntgnganaaattagnnttgncagcnngtgnnangggccattttcgntnnnngnnnaagccgtnnatnttagnngacg

SEQ ID NO: 8928 - DNA, 103 bp, Homo sapiens
  misc_feature 28, 31, 39, 42, 79, 80, 82, 90: n = A,T,C or G
tttcacgcataggcatccagacggcggngcntggcgccntanttgcccgactggtgcacaggaagaacgcattttcacnntntggtagtncggctgtcacgca

SEQ ID NO: 8929 - DNA, 170 bp, Homo sapiens
  misc_feature 2, 8, 34, 35, 36, 38, 61, 88, 89, 109, 116, 135, 150, 161,166: n = A,T,C or G
tnttgccngctggtcacaggaaaacgcatttcannntntggtagttcggctgtcacgcagngtgcagcgagttgcaatgcccggttcnntattgaacgacgcattcacntgttgcnccctggtgataccccatancacagtgggaaatgntgctgctctcncctgntcgc

SEQ ID NO: 8930 - DNA, 108 bp, Homo sapiens
  misc_feature 8, 14, 30, 32, 33, 35, 47, 76, 79, 80, 81: n = A,T,C or G
ttcccgcnggtcanaggaaaacgcatttcncnntntggtgtcggctntccgacggcagcgagtgaatggccgattnttnnnaacaccacacaccctgcgccctgtgat

SEQ ID NO: 8931 - DNA, 100 bp, Homo sapiens
  misc_feature 2, 3, 29, 37, 50, 60, 72, 74, 77, 80, 85, 92, 99: n = A,T,C or G
gnntttttcacgatagcaatcaacgccgnttagctgncgttttgccgctngtcacaagtncaacgcatttcncnatntgntgtgngaatttncgattgnc

SEQ ID NO: 8932 - DNA, 100 bp, Homo sapiens
  misc_feature 5, 11, 29, 32, 35, 39, 41, 43, 49, 53, 55, 56, 60, 61, 72,74, 75, 83, 84, 87, 93: n = A,T,C or G
ccggncgcagnaacgcctttacctgtctnttncgntgcncnanaaagtnccgngnntttnncgcatgtggtngnnaaattagnnttncagccngtggcac

SEQ ID NO: 8933 - DNA, 133 bp, Homo sapiens
  misc_feature 2, 10, 45, 46, 48, 61, 76, 99, 118, 121, 122: n = A,T,C or G
cntggcgccnttttgcccgctggtcacaggaaaacgcatttcacnntntggtgttcggctntcacgcagcgtgcancgagtgcaatggccgattcattngaaacgacgcacacacccngtnngccctgtgata

SEQ ID NO: 8934 - DNA, 100 bp, Homo sapiens
  misc_feature 2, 10, 11, 17, 24, 26, 27, 30, 34, 35, 36, 40, 46, 51, 52,53, 62, 67, 71, 72, 73, 75, 76, 85, 86, 88, 95, 99: n = A,T,C or G
cncgcatttnncgcgtntgtgtgngnnaanttannnttgncagccngtggnnntgggccatnttcgntaannngnncaagccgtnnanattagcngggnt

SEQ ID NO: 8935 - DNA, 100 bp, Homo sapiens
  misc_feature 10, 12, 13, 23, 37, 44, 61, 66, 68, 71, 74, 76, 80, 94: n = A,T,C or G
acgcatttcncnntttggtgtgngaatatacgcattnccagccnagtggaacgcgcgatcnttcgntnacntgnanaagnccgatcacactcanagagct

SEQ ID NO: 8936 - DNA, 100 bp, Homo sapiens
  misc_feature 3, 5, 7, 21, 38, 40, 59, 73, 82, 83, 89, 91: n = A,T,C or G
canantntggtagtcgggctntcaccagcggcaacgantnaatgcgccgatcagtaatngaacagccattcanccgttgccnngtctgnancccgcacaa

SEQ ID NO: 8937 - DNA, 102 bp, Homo sapiens
  misc_feature 5, 12, 28, 32, 38, 44, 57, 68, 76, 82, 92: n = A,T,C or G
tgggntggcccngcttaacttttgcccncganctcggngttcgnacaggggcgaagnaaaccgccaanttttttcnaacccnacttgttttnggttttagtt

SEQ ID NO: 8938 - DNA, 100 bp, Homo sapiens
  misc_feature 4, 17, 19, 20, 22, 25, 29, 41, 72, 75, 76, 78, 79, 89, 95: n = A,T,C or G
cagnacaacgcatttcncnntntgntggngaatatacgatngccagacgagtgaatgggcgatcattcgatnacnngnntaagcacganaaactnagctg

SEQ ID NO: 8939 - DNA, 112 bp, Homo sapiens
  misc_feature 7, 15, 30, 31, 42, 46, 51, 53, 60, 66, 75, 76, 78, 79, 81,85, 108: n = A,T,C or G
tcatcgnacgcctanccacagcctttttannagtccgtttangcangcctnangaacagncaccancgcatttanncnntnctgngtgagagaaattataggcattgncaga

SEQ ID NO: 8940 - DNA, 101 bp, Homo sapiens
  misc_feature 4, 9, 29, 30, 34, 43, 56, 68, 71, 95: n = A,T,C or G
gccnttacntgtctattacgatgcgcaannagtnccatgattngtccgtgctggtngaaaaattaggnttncagcctgcgtcactgccattttcntcaaat

SEQ ID NO: 8941 - DNA, 100 bp, Homo sapiens
  misc_feature 2, 38, 39, 40, 41, 56, 63, 74, 82: n = A,T,C or G
cngtgcccgactggttcacaggcaagaacgcatttcannnngtggtgtcgggcttntcaccancggcagcgagntgcaatgnccgatcagtccagaacac

SEQ ID NO: 8942 - DNA, 118 bp, Homo sapiens
  misc_feature 10, 13, 14, 16, 18, 20, 28, 43, 59, 80, 82, 84, 89, 94, 104,116: n = A,T,C or G
cgcaatttanacnntntngntagtgagnaatatagcgcattgncagacgagtggaatgngcgcattcatttcgataacgngngnagagnccggntaatattcgntggagcttcctnaa

SEQ ID NO: 8943 - DNA, 100 bp, Homo sapiens
  misc_feature 7, 11, 34, 35, 51, 59, 60, 65, 72, 79, 86: n = A,T,C or G
gtcttantagnccgattcttagcctcgactcagnncacaggcacgaaccgnaatttttnnccccntgtttgngtagtgnagacatnataacgcatctgcg

SEQ ID NO: 8944 - DNA, 100 bp, Homo sapiens
  misc_feature 3, 21, 27, 28, 38, 47, 50, 53, 61, 73, 78, 83, 85, 97: n = A,T,C or G
agnacgcctttacagctttangatgcnngagagagtancggatttgnccntgntggtgganaaattagggttncagcntgtgnantgccattttcgntaa

SEQ ID NO: 8945 - DNA, 100 bp, Homo sapiens
  misc_feature 21, 25, 29, 33, 39, 40, 42, 57, 66, 67, 68, 70, 73, 85, 94,95, 96: n = A,T,C or G
agcctatccagacggcgggcntggncgcnctanttgccnncncggtcacaggaaaangcatttcannntntgntagttcggcgtntcacgcagnnngcag

SEQ ID NO: 8946 - DNA, 106 bp, Homo sapiens
  misc_feature 5, 13, 28, 37, 48, 50, 53, 58, 61, 72, 83, 92, 98, 105: n = A,T,C or G
atttngttgcacnttttgcccgctggtnacaggaaangaatttcacantntgntagtnggngtatcacgcancggcagacaantgcaatgcncgatcnttccatna

SEQ ID NO: 8947 - DNA, 100 bp, Homo sapiens
  misc_feature 37, 39, 52, 95: n = A,T,C or G
gttttgcccgctggtcacaggaaaacgcatttcacantntggtgttcggctntcacgcagcgtgcagacgactgcaatggccgattcatttccanaacgg

SEQ ID NO: 8948 - DNA, 117 bp, Homo sapiens
  misc_feature 12, 34, 41, 44, 49, 70, 72, 78, 81, 95, 104, 108: n = A,T,C or G
tggtgtcggctntccgagcggcagtcgagttgantgcccgnttngtaangatcacacattcactccgttncncgccgnganaccccgcaaaacanacggggaanttgncctcttcct

SEQ ID NO: 8949 - DNA, 100 bp, Homo sapiens
  misc_feature 6, 7, 28, 33, 48, 58, 59, 70, 92, 93, 95: n = A,T,C or G
tttgcnngcccgtatctatgccggactngagtnacaggaagatcgcantttccacacnngttgggtagtncgggcttgttcaccagcgtgcnncnaactg

SEQ ID NO: 8950 - DNA, 110 bp, Homo sapiens
  misc_feature 6, 7, 8, 9, 13, 21, 23, 25, 31, 48, 49, 53, 56, 57, 74, 93,95: n = A,T,C or G
tttccnnnntggngtcggctntncnacgganccagtgaatgccgattnntccnacnnccattcacccgttgccnctctgatgcccctcaaaananaggagaatatgttat

SEQ ID NO: 8951 - DNA, 100 bp, Homo sapiens
  misc_feature 2, 14, 37, 39, 40, 53, 60, 69, 87, 88, 92, 93, 97, 99: n = A,T,C or G
tnttgcccgctggncacaggcacgatcgcatttcacnanntggtgttcggctntccgcancgtgcagcnagtgcaatggccgattcnntccnnaacngnc

SEQ ID NO: 8952 - DNA, 100 bp, Homo sapiens
  misc_feature 8, 21, 34, 35, 38, 51, 66, 81, 84, 85, 87, 89, 95: n = A,T,C or G
ttttgccngctggtcacaggnaaacgcatttcannctntggtagtcggctntcacgcagcgtgcancgagtgaatgcccgnttnntnangacgancattc

SEQ ID NO: 8953 - DNA, 100 bp, Homo sapiens
  misc_feature 4, 25, 27, 62, 65, 66, 71, 72, 74, 75, 76, 94, 98: n = A,T,C or G
actngctcagggaaccctttacctncnttacgatgcgcaaagtagataccgtgattagcgcnganngtcgnnannntaggtttccagcctgcgncacncg

SEQ ID NO: 8954 - DNA, 100 bp, Homo sapiens
  misc_feature 9, 18, 28, 33, 34, 44, 51, 55, 60, 61, 64, 70, 73, 75, 80,85, 87, 88, 96: n = A,T,C or G
cctttaccngtctattangatgcgcaangtagnnccatgaattnagtcgcngctngtcgnnaangtaggnttncngaccntgtcncnntcgccatnttcg

SEQ ID NO: 8955 - DNA, 100 bp, Homo sapiens
  misc_feature 3, 22, 31, 43, 45, 48, 64, 66, 69, 77, 82, 83, 85, 86, 94: n = A,T,C or G
tcncgatcggcatcgacgccgnttagagccnttttgcccgctngnganaggacaacgcatttcncnctntggtgtgngactnntnncgcattgncagcaa

SEQ ID NO: 8956 - DNA, 100 bp, Homo sapiens
  misc_feature 14, 19, 51, 56, 64, 66, 67, 77, 97: n = A,T,C or G
caacgcaggttagntgctnttttgccgctggtcacaggacaacgcatttcnccatntggtgtgngnntatccgattncagccagtgaatgggcgatnttc

SEQ ID NO: 8957 - DNA, 100 bp, Homo sapiens
  misc_feature 6, 11, 46, 47, 49, 62, 69, 74: n = A,T,C or G
cttgcncgccnttttgcccgctggtcacaggacaacgcatttcacnntntggtgttcggctntcacgcngcganagacgagtgcaatggccgatcatttc

SEQ ID NO: 8958 - DNA, 100 bp, Homo sapiens
  misc_feature 13, 24, 30, 46, 50, 51, 64, 65, 67, 79, 87, 91, 95: n = A,T,C or G
ttttccgatcgcntcaacgcggcntgtgcnttttcccgctggtcanaggnnaacgcatttcacnntntggtgtcggctntcacgagnggcncgantgaat

SEQ ID NO: 8959 - DNA, 100 bp, Homo sapiens
  misc_feature 12, 27, 38, 39, 41, 47, 55, 64, 65, 66, 67, 69, 73, 75, 83,92, 97, 99: n = A,T,C or G
gatgggatacancggcgtttttgttgnacgttttgccnncnggttanaggaaaangcaatttcnnnntnttgntnttgggctntcagcagtntgagncna

SEQ ID NO: 8960 - DNA, 100 bp, Homo sapiens
  misc_feature 11, 23, 27, 29, 31, 33, 36, 46, 52, 56, 64, 65, 68, 70, 78,79, 81, 82, 83, 88, 92, 98: n = A,T,C or G
ttttcacggangcagcaacgccnttancngncnttncgacgctcgngacagnaccncgcatttnnccntntgtgtggnnannntaggnttgncagccngt

SEQ ID NO: 8961 - DNA, 100 bp, Homo sapiens
  misc_feature 8, 9, 10, 12, 33, 62, 65, 80, 86, 88, 91, 95, 96, 99: n = A,T,C or G
aatttcannntntggtagtcggctgtcagcagngtgcagacgaactgcaatggccggttcangtnatgaacgacgcatcnccagcncngtngccnngtng

SEQ ID NO: 8962 - DNA, 130 bp, Homo sapiens
  misc_feature 4, 10, 29, 49, 50, 54, 57, 76, 95, 96, 104, 107, 125: n = A,T,C or G
tggncgcccntatttgcccgctcggtgcncaggaagaacgcaatttcannctcntgntagttcggctgtcaccagnggcagacgagttgcaatgnncgattcanttnatgaacgacgcatctccncccgt

SEQ ID NO: 8963 - DNA, 100 bp, Homo sapiens
  misc_feature 4, 8, 36, 56, 60, 70, 71, 72, 73, 74, 96: n = A,T,C or G
cgcnaggnatccagacggcggggctggtcgccctanttgcccgctcggtcacaggnagancgcatttcannnnntggtagttcggctgtcagcagngtgc

SEQ ID NO: 8964 - DNA, 100 bp, Homo sapiens
  misc_feature 2, 8, 31, 43, 45, 47, 55, 56, 57, 67, 73, 75, 97: n = A,T,C or G
gnatcacnggcgttttggtgccctatttgcngctggtcgaggnanangcatttcnnnctgtggtgtncggctntncgagtggcagcgagtgagtggncgg

SEQ ID NO: 8965 - DNA, 117 bp, Homo sapiens
  misc_feature 2, 16, 32, 33, 34, 35, 37, 58, 59, 71, 81, 82, 96, 100, 109: n = A,T,C or G
tnttcccgctggtcanaggaaatcgcatttcnnnntntggtgtcggctgtcacgcagnngcagcgagtgantgcccggttnntaatgaacgaccantcantcgttgccnctgtgata

SEQ ID NO: 8966 - DNA, 100 bp, Homo sapiens
  misc_feature 10, 22, 29, 31, 45, 61, 62, 63, 64, 66, 86: n = A,T,C or G
ctgatcgcantcaacgcaggcntgtgccntnttcccgctggtcanaggaaatcgcatttcnnnntntggtgtcggctgtcacgagnggcagcgagtgaat

SEQ ID NO: 8967 - DNA, 100 bp, Homo sapiens
  misc_feature 13, 28, 32, 46, 47, 49, 61, 67, 75, 82, 88, 93, 94, 97: n = A,T,C or G
cgcggcttgtgcnttttcccgctggtanaggngatcgcatttcacnntntggtgtcggctntccganggagcgantgaatgncgatcnttccnnacncgc

SEQ ID NO: 8968 - DNA, 100 bp, Homo sapiens
  misc_feature 13, 27, 32, 43, 53, 56, 65, 68, 70, 73, 77, 80, 85, 88, 90,97: n = A,T,C or G
ttttcccgatcgnatcaacgcgttagntgccnttttgccgctngtcacaagtncancgcatttcnccntntgntgtncgnctatncgntngacagcnagt

SEQ ID NO: 8969 - DNA, 105 bp, Homo sapiens
  misc_feature 15, 22, 31, 45, 61, 63, 64, 66, 79, 88, 94: n = A,T,C or G
cacgatcgcatcagncgcggcntgtgccctnttcccgctggtcanaggaaaacgcatttcncnntntggtgttcggctntcacgcagngtgcancgagtgaatgg

SEQ ID NO: 8970 - DNA, 100 bp, Homo sapiens
  misc_feature 11, 15, 29, 39, 43, 49, 53, 71, 73, 77, 83, 96, 97: n = A,T,C or G
ctggcccaggnaacncctttacctgtctnttacgatgcncaanggagtnccgngatttgtccgtgctggtngnaaanttaggnttccagcctgtgnnact

SEQ ID NO: 8971 - DNA, 107 bp, Homo sapiens
  misc_feature 13, 31, 33, 43, 49, 62, 73, 77, 85, 93, 95, 98: n = A,T,C or G
caccgcataggcnatccagacgggcggggcntnggtcgccccntatctnttgcccgactcgngtgcacagggnaaanccgcaatntttcaccncntcntttggttag

SEQ ID NO: 8972 - DNA, 100 bp, Homo sapiens
  misc_feature 23, 29, 31, 33, 48, 54, 64, 65, 66, 67, 69, 91: n = A,T,C or G
ctgatcgcattcaacgcagggcntggtgncntnttgcccgctggtcanaggaantcgcatttcnnnntntggtgttcggctgtcacgcagnggcagcgag

SEQ ID NO: 8973 - DNA, 100 bp, Homo sapiens
  misc_feature 21, 22, 28, 32, 65, 67, 68, 70, 77, 83, 92: n = A,T,C or G
cacgatagcatcagacggcgnncttggngccnttttgcccgctggtcacaggacaacgcatttcncnntntggtgtncggctntcacgcatnggcgcgag

SEQ ID NO: 8974 - DNA, 100 bp, Homo sapiens
  misc_feature 3, 20, 29, 37, 43, 47, 49, 59, 61, 62, 64, 77, 85: n = A,T,C or G
ccnatcgattcaacgcggcntgtgccctnttcccgcnggtcanaggnantcgcatttcncnntntggtgttcggctntcacgagnggcagcgagtgaatg

SEQ ID NO: 8975 - DNA, 125 bp, Homo sapiens
  misc_feature 1, 9, 31, 32, 34, 38, 42, 80, 81, 83, 95, 97, 104, 112: n = A,T,C or G
nttttttcncgcataggcatccagacggcgnncntggngccntatttgcccgctggtgcacaggaaaacgcaatttcacnntntggtagttcggntntcacgcngcgtgcancgagttgcaatgg

SEQ ID NO: 8976 - DNA, 111 bp, Homo sapiens
  misc_feature 5, 16, 32, 34, 35, 37, 40, 50, 57, 62, 73, 80, 86, 93, 95,100, 104: n = A,T,C or G
ttttnccgctggtcanaggaaatcgcatttcncnntntgntgttcggctntccgagnggcancgagtgaatgnccgattnttattnaacaccncncgccntgtngccctgt

SEQ ID NO: 8977 - DNA, 108 bp, Homo sapiens
  misc_feature 23, 31, 39, 65, 66, 67, 69, 82, 91: n = A,T,C or G
cacgatagcatcaacggcgggcntggtgccnttttgccngctggtcacaggaaaacgcatttcannntntggtagtcggctntcacgcagngtgcagcgagtgcaatg

SEQ ID NO: 8978 - DNA, 100 bp, Homo sapiens
  misc_feature 23, 24, 31, 33, 35, 43, 54, 57, 75, 83, 95, 98: n = A,T,C or G
cggctaaaggcctaattccccannaggggcngngntctttggngtcggccccgnttntttttgccccggactcgnggtttcgnccagggggaagnaancg

SEQ ID NO: 8979 - DNA, 100 bp, Homo sapiens
  misc_feature 6, 7, 10, 12, 16, 20, 22, 29, 32, 38, 40, 42, 46, 57, 59,60, 61, 62, 64, 70, 73, 74, 75, 85, 87, 89, 99: n = A,T,C or G
gatttnnccntntgtnggananattaggnttncagccngngncacngccgttttcgntnnnngngtaagncgnnnatacttagcngngntccttaatcng

SEQ ID NO: 8980 - DNA, 100 bp, Homo sapiens
  misc_feature 19, 21, 37, 41, 51, 52, 54, 60, 62, 63, 72, 78, 79, 82, 95,96, 97: n = A,T,C or G
ccagaaagaaaagaaaagngnagttttttcaccgagnagcnagcgtttagnngncgttangnngctggaaanaggagnnganttcacaatttgannnaga

SEQ ID NO: 8981 - DNA, 100 bp, Homo sapiens
  misc_feature 13, 18, 31, 34, 38, 50, 65, 69, 72, 77, 93, 99: n = A,T,C or G
aacggttttacgntgtcnttattgaccgctnagngagnacaacgaatttnacaatttgtgtgganaaantangattncagacgagtggaatgngcgatnt

SEQ ID NO: 8982 - DNA, 100 bp, Homo sapiens
  misc_feature 12, 13, 41, 49, 58, 64, 68, 72, 74, 76, 87: n = A,T,C or G
agcatcacacgnnttttagtgcccttttgcccgctggtganaggagaangatttcacnctttgntagncggntntnagcatgccagncagtgaatgccga

SEQ ID NO: 8983 - DNA, 100 bp, Homo sapiens
  misc_feature 4, 5, 10, 18, 25, 27, 31, 36, 37, 56, 58, 60, 61, 62, 64,66, 74, 75, 76, 77, 81, 87: n = A,T,C or G
tttnnccatntgttgtgngaattangnttgncagcnngtgaatgggcgattttcgntnannngngnaagccggnnnnattngtgacnctccttaaacagt

SEQ ID NO: 8984 - DNA, 100 bp, Homo sapiens
  misc_feature 15, 22, 32, 38, 54, 56, 57, 59, 66, 70, 72, 78, 79: n = A,T,C or G
cgcatcgacgcggcntgtgccnttttcccgcnggtcanaggacaacgcatttcncnntntggtgtncggntntccgannggcgcgagtgaatgggcgatc

SEQ ID NO: 8985 - DNA, 153 bp, Homo sapiens
  misc_feature 4, 8, 29, 43, 44, 46, 57, 59, 84, 98, 115, 117, 118: n = A,T,C or G
tggngccnttttgcccgctggtcacaggnaaacgcatttcacnntntggtgttcggntntcacgcacggcagcgagtgcaatgnccgattcattcttnaacgacgcacacacccngnngccctgtgaaacccataaacagtgggaaatggtgc

SEQ ID NO: 8986 - DNA, 100 bp, Homo sapiens
  misc_feature 4, 5, 10, 17, 18, 21, 27, 30, 36, 40, 44, 55, 58, 59, 62,64, 72, 73, 79, 81, 82, 84, 86, 88, 96: n = A,T,C or G
tttnnccatntgttggnnaanttaggnttncagccngtgnatgngccattttcgntanntgngnaagccgtnnatattngnngngntncttaatcngtgt

SEQ ID NO: 8987 - DNA, 256 bp, Homo sapiens
  misc_feature 27: n = A,T,C or G
gaacaataagctggagcctcgcgcgcntgaggtcgacactagtggatccaaagaattcggcacgagtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggc

SEQ ID NO: 8988 - DNA, 400 bp, Homo sapiens
  misc_feature 16, 26, 30, 34, 386: n = A,T,C or G
cgaaccataatgctgnagcctcgccncccntgcnggttcgacactagtggatccaaagaattcggcacgagctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggnttaccccataatct

SEQ ID NO: 8989 - DNA, 400 bp, Homo sapiens
gaacaataagctggagctccgcgcgcttgcaggtcgacactagtggatccaaagaattcggcacgagatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcaagttggtggttttgtgaactggtcaaaaattcacaggtcttaaatgttttgggggaaatttatattggacactgctctttgtctagcaaataaaagatgttaatatattcctgttactggcatgtgcaccgactatgttattagaagccactttatcattttcctgctttaaata

SEQ ID NO: 8990 - DNA, 317 bp, Homo sapiens
  misc_feature 146, 161, 215, 239, 305: n = A,T,C or G
tgcaggtcgacactagtggatccaaagaattcggcacgagctcgtgccgaattcggcacgaggaggaacccaagtagctttgtggcttcgtgtccaaccctcttgcccttcgcctgtgtgcctggagccagtcccaccacgctcgngtttcctcctgtagngctcacaggtcccagcaccgatggcattccctttgccctgagtctgcagcgggnccctttttgtgcttccttcccctnaggtagcctctctccccctggcccactcccggggggagggggtacccctttcccagggtttttatncctgggggcctc

SEQ ID NO: 8991 - DNA, 285 bp, Homo sapiens
  misc_feature 21, 23, 280: n = A,T,C or G
gacaataagctggagctcgcncncttgaggtcgacactagtggatccaaagaattcggcacgagtgacagctggtgcgcctgccccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgacttcaaccctcgcttcaacgcccacggggacccaaanaccat

SEQ ID NO: 8992 - DNA, 153 bp, Homo sapiens
  misc_feature 6, 101, 121: n = A,T,C or G
tttagntgggacactagtggatccaaagaattcggcacgagctgtcagggagggccagggaggcagagggggagggagtctcaggaggaggctgccctganggtctggggagggggtaccntcatgaggaccagggtggagcctgagaagagg

SEQ ID NO: 8993 - DNA, 100 bp, Homo sapiens
  misc_feature 3, 26: n = A,T,C or G
ganaataagctggagcctcgcgcgcntgcaggtcgacactagtggatccaaagaattcggcacgagacacagtgaagcaaattaaaaaaaaaaaaaaaaa

SEQ ID NO: 8994 - DNA, 400 bp, Homo sapiens
  misc_feature 3, 124, 129, 140, 215, 224, 282, 353, 377: n = A,T,C or G
ganaataagctggagctccgcgcgcttcgaggtcgacactagtggatccaaagaattcggcacgagccccaatgcagctaggatagtgttgcggctataattttgtgtttttttttttaattgnctagncttaaatttgnacatcttgtataaaatatgaatgtttcccaaataaactatgaatgtttcctgtataatatatgaatgtttctganaagaaactntaaatagttgaaaggctaacctgctcaaaggataccaaataatggtttaactggccancctgaaaattagcatagaaaacaatcctttgttatattttagggatccacaaggattgagaaaatattatntaggttagataataacattcttgnctactttatcctggctgggtaca

SEQ ID NO: 8995 - DNA, 386 bp, Homo sapiens
  misc_feature 24: n = A,T,C or G
gaaaaagctggagctcgcccgccntgaggtcgacactagtggatccaaagaattcggcacgagctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgcccttgtcctccagataccactgagcctcttgcccatgattcagagctttcaaggataggctttattctgcaagcaatacaaataataaatctattctgctgagag

SEQ ID NO: 8996 - DNA, 385 bp, Homo sapiens
  misc_feature 3, 7, 188: n = A,T,C or G
gcncctngaaggtcgacactagtggatccaaagaattcggcacgaggaactatgctgccttcacaaagaaccagaaggaccctggtgtccttgaccgcatgatgaagaaactggacaccaacagtgatggtcagctagatttctcagaatttcttaatctgattggtggcctagctatggcttgcctngactccttcctcaaggctgtcccttcccagaagcggacctgaggaccccttggccctgcccttcaaacccaccccctttccttccagccttttctgtcatcatctccacagccacccatcccctgagcacactaaccacctcatgcaggccccacctgccaatagtaataaagcaatgtcactttttttaaaacatg

SEQ ID NO: 8997 - DNA, 315 bp, Homo sapiens
  misc_feature 3, 5, 60, 64: n = A,T,C or G
tgngncccttgaggtgcgacactagtggatccaaagaattcggcacgaggggagctctgntctnagcttgcacactgctgagagcacccactgtcctgaccagagtctcagtggtcctgacccccaatgtgggcagggcctggcaaggagggtggggtctgctgtgggttcagaggactccacctcctggctggtttacctgctgctgcccattttctctgggactgctggccagaggactttagcctacccctgaagagcctgtccatgtcattttcctactgcatagataccctaagcccagggccccttgag

SEQ ID NO: 8998 - DNA, 216 bp, Homo sapiens
  misc_feature 4, 19, 78, 79, 150, 202: n = A,T,C or G
cganaaaagctggagctcngcgcgccttgaggtccgacactagtggatccaaagaattcggcacgagcggcacgagtnnggaccccagcccctcccctactttttggtcagctacgtctctagaataagatggtatctgaagtccttccnaaaaaaaaaaaaaaaaaaaaaaaaaaaaaaaaaaaaaaaaaaaaaaaaaaanaaaaaaaaaaaaaa

SEQ ID NO: 8999 - DNA, 335 bp, Homo sapiens
  misc_feature 25, 322, 327, 328: n = A,T,C or G
aaaataagctggagcttcgcgcgcntgaaggtcgacactagtggatccaaagaattcggcacgagtccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcattaaaagtcaaaaaaaaaaaaaaaaanttggnnagttctt

SEQ ID NO: 9000 - DNA, 311 bp, Homo sapiens
  misc_feature 141, 273: n = A,T,C or G
gacaataagctggagctcgcgcgcttgcaggtcgacactagtggatccaaagaattcggcacgagcagcagtaccaggatgccaccgagaagaggaggaggatttcggtgaggaggccgaagaggaggcctaaggcaggancccccatcacctcaggcttctcagttcccttagccgtcttactcaactgccccttttcctctccctcagaatttgggtttgctgcctctatcttgttttttgttttttcttctggggggggtctagaacagngcctggcacattaggaaggcgctcaataaatactggtt

SEQ ID NO: 9001 - DNA, 400 bp, Homo sapiens
  misc_feature 280: n = A,T,C or G
gaaaataagctggagctcgcgcgcttgagggtcgacactagtggatccaaagaattcggcacgagagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccaccctgcaagatggacacgagccacaagctgcactgtgaacctgggcactccgcgccgatgccacccggcntgtgggtctctgaagggacccccccccaatcggactgccaaattctccggtttgccccgggatattttagaaaattatttgtttgaataatgaaaataaaacacacctcgggcaaaaaaa

SEQ ID NO: 9002 - DNA, 400 bp, Homo sapiens
  misc_feature 2: n = A,T,C or G
angaacaataagctggagctcgcgcgccctgcaggtcgacactagtggatccaaagaattcggcacgagttgaaacatctgcgtctcagcgttgaattcgaagcaaatgatttacaggggggatctgtaggcagtgtccgacttaaatacaagttccaaagacaatgatgagaagattgtgcagaatgctatcatccaaacaataggattttttggaagtaacctaccagattatcagaggtcagaaatcatgatgttcattatgggggaaagtacctgtctttggaacatctacccatactttggatatcagtcaactaggggatttgggaaccaggagaattcagataatgttgctgagatctttgcttatggggacctctggatataaagcgaagac

SEQ ID NO: 9003 - DNA, 100 bp, Homo sapiens
  misc_feature 17, 22, 88, 91, 98: n = A,T,C or G
aataagctggagctccnccgcnccttcgcaggtcgacacctagtggatccaaagtaattcggcacgagctcgtgggcgtatggcgaancantccctcnct

SEQ ID NO: 9004 - DNA, 284 bp, Homo sapiens
acaataagctggagcttcgcgcgcctgaaggtcgacactagtggatccaaagaattcggcacgaggaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaa

SEQ ID NO: 9005 - DNA, 400 bp, Homo sapiens
  misc_feature 4, 24, 28, 185, 266: n = A,T,C or G
gacnaaatgctggagccccgcgcnctgnggtgccgacactagtggatccaaagaattcggcacgaggtaagattgacaagtatgtaaacaaataatttcagtattttggaataagtataatatagaaataagaggtaggtgtggtatgggtgggtcgaaggtggcagtggttaataaactctggngggcccaaagaaggcttcacagagtaggcaatgcttgagctgctaggctatctcaaagattgtgatatatctttgaacagngttaaccagggaaaatgatcaaaatctatgttctaggaagctcaccctgatgtcatgtgaagatgcatttgagaggtgagagacaagtcaaagggagactttaaaagacaaggcaagagatattgaagatgaag

SEQ ID NO: 9006 - DNA, 260 bp, Homo sapiens
  misc_feature 7, 28, 35, 41, 62, 76, 222: n = A,T,C or G
gaacacntaagtctggagcctcgccgcnccctcgnaggtcngacacctagtggatccaaagnaattcggcacgagnagcaaagtttttatgtgctgtccaaaatggtcttcatgtggtctgacaatttatttttgccatcatttttttaattaaagaaaaaatttccagaagaggaaaaaaaaactacaaaaaacaaaacattgaaggttgatattttatgnggaagaacatttgaattgaattcagaatttttctgaag

SEQ ID NO: 9007 - DNA, 400 bp, Homo sapiens
  misc_feature 5, 10, 58: n = A,T,C or G
gcgcncttgnggtcgacactagtggatccaaagtaattcggcacgaggccggtttgtnctgcagcaatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggacgtgtgatcaccattatgcagaatccacgccagtacaagatcccagactggttcttgaacagacagaaggatgtaaaggatggaaaatacagccaggtcctagccaatggtctggacaacaagctccgtgaagacctgga

SEQ ID NO: 9008 - DNA, 400 bp, Homo sapiens
  misc_feature 225, 293, 368: n = A,T,C or G
cgaacaataagctggagctcgcgcgccttgcaggtcgacactagtggatccaaagaattcggcacgagcttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagnggatcaccaaaccagtccacaagcacagggagatgcgtgggctgacatctgcaggccgaaagagccgnggccttggaaagggccacaagttccaccacactattggtggctctcgccgggcagcttggagaaggcgcaatacntctccagctccaccgttaccgctaatataagt

SEQ ID NO: 9009 - DNA, 400 bp, Homo sapiens
  misc_feature 18, 35, 125, 188, 190, 218, 267, 288, 306, 318, 344, 370,374: n = A,T,C or G
gacaatttgctggagctntgtgaccttgaaggtgngacactagtggatccaaagaattcggcacgagctgagcaaggagtgtgccaaaatctatggctcctaccagtgctactgccgccagggtnacccagctggctgaggatgggcacacctgcacagacatcgacgagtgtgctcaaaggcgccgnantcctctgacctttccgctgtctaaacgngcaagggagctacagtgtgcatgccctgagcaggcttcaccatgacggncaacggaggtcctgaagacgnggatgagtgtgccttggnacccacaactgntccgaggctgagacctgcacaacatncaggtagcttccggtgcctggccttngagngtccctccaactttgtccaagctcca

SEQ ID NO: 9010 - DNA, 400 bp, Homo sapiens
  misc_feature 23: n = A,T,C or G
gacaataagctggagctcgcgcncctgcaggtcgacactagtggatccaaagaattcggcacgaggtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccacttccaattgctggcccgcttcactcctggaaccttcactaaccaagatccaggcagccttccgggagccacggcttcttgtgggtta

SEQ ID NO: 9011 - DNA, 400 bp, Homo sapiens
  misc_feature 2: n = A,T,C or G
gnaaaagctggagctcgcgcgcctgcaggtcgacactagtggatccaaagaattcggcacgagcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgacttgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagcccttcagtccgttgcagaggagcga

SEQ ID NO: 9012 - DNA, 181 bp, Homo sapiens
  misc_feature 134, 169: n = A,T,C or G
aggacaaaagctggagctcgcgccgccttgaggtcgacactagtggatccaaagaattcggcacgagctcgtgccggaaactcctgcgggtctttggcctgaaagttgggaatggttgggggagagaagggcancagcttattgggggtcttttcacccattggcaganacagtgagagct

SEQ ID NO: 9013 - DNA, 100 bp, Homo sapiens
  misc_feature 7, 20, 28, 85, 86, 91, 96: n = A,T,C or G
catttantgaggctgtgtgnccctgagntgggacgtctagtggatccaaagaattcggcacgaggtttttttttttttttttttnnggggnaaaantttt

SEQ ID NO: 9014 - DNA, 177 bp, Homo sapiens
acaataagctggagctcgcgcgcctgcggtcgacactagtggatccaaagattcggcacgagcttgggtgatgggtgacaaaaatttcacaaatcaccactaaagaacttattcacgtaaccaaacaccagctgttccccaatatcctatggaaataaaaaattttttttaaaaaaa

SEQ ID NO: 9015 - DNA, 400 bp, Homo sapiens
  misc_feature 24, 33, 84, 88, 209: n = A,T,C or G
gacaataatgctggagctggtgcncctgaggtncgacactagtggatccaaagaattcggcacgaggctgccagtgcagccacntggnttggaacaccttggggtccctccaccccacagaaccttcaacccagtgggtctgggatatggctgcccaggagacagaccacttgccacgcttgtggtaaaaacccaagtccctgtcattngaacctggatccagcacttggtgaacttgagctgggcagggaagggagaacttgaaacagattcaggccagcccagccaggccaacagcacctccccgctgggaagagaagagggcccagcccagagccaccttggatctatcccctgcggcctccacaccttgaacttgcctaacttaactggcaggggg

SEQ ID NO: 9016 - DNA, 400 bp, Homo sapiens
  misc_feature 2, 11: n = A,T,C or G
angttgggacntctagtggatccaaagaattcggcacgagggctgaccagcctcgctcagcaccttctctcagacccaaggactatgaagttgatgctactctgaagtctctcaacaaccagattgagacccttcttactcctgaaggctctagaaagaacccagctcgcacatgccgtgactttgagactcagccacccagagtggagcagtggttactacctggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccag

SEQ ID NO: 9017 - DNA, 400 bp, Homo sapiens
gacaataagctggagctcgcgcgccctgaaggtccgacactagtggatccaaagaattcggcacgagcaaaatcaacgtataaaaaccagtagcatttctatactccaacagtgaactatctgaaaaataatttaagaatgtaatcccatttacaattgctagaaataaaataaaatgcctaagagtaaatttaaccaaagaagtgatagatctctacaataaaaattataaaatattgatgcaagaaattaggagaagacacaataaaatggaaaaatattccacatttatggattggaagactcaatattgttaaaatgctcatgctacccaaagaaatctacagagccaatgcaatctctgtcaaaataccaatgacattcttcacaaaagtagaaa

SEQ ID NO: 9018 - DNA, 398 bp, Homo sapiens
  misc_feature 19, 25, 32: n = A,T,C or G
aaccataatgctggagctntgtgcncctgagntgcgacactagtggatccaaagaattcggcacgagttgactttcaccaatgggtttatttaaaaggaagcaaattaaacaaaactatggtgataacagcagatgtctagttataattcatttctctaatgctgattaatatattcatgaacaaatcaaatgtattgccaaaagaagaatgctaccattaacaccccagcggctactggtttcagttgtgcttctcaatcaggcaaaatgttctttcttaagctcctatttattttacttcctgacagtctcaaaaataattcatcttgggtgttgtttcctcataaacacttcctggtgcttgattgctttgcctatgtgacatttgacttcaaac

SEQ ID NO: 9019 - DNA, 400 bp, Homo sapiens
gaacaataagctggagctcgcgcgcctgcaggtcgacactagtggatccaaagaattcggcacgagctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatccggaagcacatcatgggccagaatgttgcaggattacatgcgctacttaatggg

SEQ ID NO: 9020 - DNA, 356 bp, Homo sapiens
  misc_feature 29, 299, 311, 338: n = A,T,C or G
gacaaaagctggagctcgcgcgccctgcnggtcgacactagtggatccaaagaattcggcacgagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcnccccatgctgtngattgctaaatgtaacagtctgatcgngacgctgaataaatgtct

SEQ ID NO: 9021 - DNA, 400 bp, Homo sapiens
  misc_feature 171, 175, 226, 232, 304, 391: n = A,T,C or G
gaacaaaaagctggagctccgcgccgcctgcaggtccgacactagtggatccaaagaattcggcacgaggcattctctaaagacttgccaagaggtactgttattatttatacagcagataatgtaattttcatgagaatcaggaattatttagtactatttttattatgnctgntggaaaagagtaagttccagaaatgtgaaaaagcgaaactgaattctgggngagggnacagctgatcttattttttttctaaaatatgacaaataggaaattattgggtgatgggttttcttaatatgnagcaataaaaataggagattatttgggggggaaaaaaatatttttgtcaggacagcaggttgttagttaccatggtttggagactgnttttgactc

SEQ ID NO: 9022 - DNA, 257 bp, Homo sapiens
gacaaaagctggagctcgcgcgcctgcggtcgacactagtggatccaaagaattcggcacgagggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaata

SEQ ID NO: 9023 - DNA, 400 bp, Homo sapiens
  misc_feature 3: n = A,T,C or G
gancaataagctggagctcgccgcgcctgcaggtcgacactagtggatccaaagaattcggcacgagcctgtatggtgatatcatatgtaacatttactcctgtttctgctgattgtttttttaatgttttggtttgtttttgacatcagctgtaatcattcctgtgctgtgttttttattacccttggtaggtattagacttgcactttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaaggttccggtctgaa

SEQ ID NO: 9024 - DNA, 400 bp, Homo sapiens
gacaataagctggagctcgcgcgcctgcaggtcgacactagtggatccaaagaattcggcacgagctaccttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctg

SEQ ID NO: 9025 - DNA, 400 bp, Homo sapiens
  misc_feature 69: n = A,T,C or G
gaacaataatgctggagctcgcgcgcctgcaggtcgacactagtggatccaaagaattcggcacgaggngcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagttttgctggcaaagggcctgaggttctctcgaggaggcattgatcagcttttggacgtct

SEQ ID NO: 9026 - DNA, 103 bp, Homo sapiens
acaaaagctggagctcgcgcgcctgcaggtcgacactagtggatccaaagaattcggcacgagagagagagagagagagagagagagagagagagagagagag

SEQ ID NO: 9027 - DNA, 400 bp, Homo sapiens
  misc_feature 24, 395: n = A,T,C or G
gacaaaagctggagctcgcgcgcntgcaggtccgacactagtggatccaaagaattcggcacgagcttggacgctgcagaatggctcccgcaaagaagggtggcgagaagaaaaagggccgttctgccatcaacgaaggggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgccagaaaacgtaatgagggatgaagattcaccaaataagctatatactttnggtta

SEQ ID NO: 9028 - DNA, 400 bp, Homo sapiens
  misc_feature 4, 5, 341, 347, 383: n = A,T,C or G
attnntgggacgctagtggatccaaagaattcggcacgagctctggttgctatcctactccatgggatgaagacgtctgacactattatccgggagggcaccctgatgggcacagccattggcacctgcttcggctactggctgggagtctcatccttcatttacttccttgcctacctgtgcaaccgcccagatcaccatgctgcagatgttggcactgctggcctatggcctcttttgggcattgattgtcctgttcatcacctataatatccaccttccacgcccctcttctacctcttctggctgttggggggtggactgtccacactgcgcatggnagcagngttgggggtctcggaccgtgggccccacacagcggntgctccttttggggcac

SEQ ID NO: 9029 - DNA, 398 bp, Homo sapiens
acaaaagctggagctcgcgcgcctgcaggtcgcactagtggatccaaagaattcggcacgaggttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaa

SEQ ID NO: 9030 - DNA, 262 bp, Homo sapiens
  misc_feature 161, 191, 237, 260: n = A,T,C or G
agaaaaaaagctggagctcgcgcgcctgcaggtcgacactagtggatccaaagaattcggcacgagctcgtgccgaattcggcacgagctaaagctgcactcctatgccacctccatccgtaaggttgtcctgggcatccatggacaatgagaaatatgcncactccggacatcgggggccaagggcacancatttgaagccatccaggacgtcatccgccacattccgcggtaatnaacggccgggccgggggaggccnta

SEQ ID NO: 9031 - DNA, 400 bp, Homo sapiens
gaaaaaagctggagctcgcgcgcctgcaggtcgacactagtggatccaaagaattcggcacgaggcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatat

SEQ ID NO: 9032 - DNA, 400 bp, Homo sapiens
  misc_feature 326, 334, 371: n = A,T,C or G
gaacaaaaagctggagctcgcgcgcctgcaggtcgacactagtggatccaaagaattcggcacgagggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctgggattctctggcgctttttggcatgactcanaagagggngctgggtcacttttccgtatccctgatccttcccagnggacagatgaaagaattaaggtatccctt

SEQ ID NO: 9033 - DNA, 395 bp, Homo sapiens
  misc_feature 4, 5: n = A,T,C or G
cttnntgggacgtctagtggatccaaagaattcggcacgagttgcaagcaagtttatcggagtatcgccatgaagttcgtcccctgcctcctgctggtgaccttgtcctgcctggggactttgggtcaggccccgaggcaaaagcaaggaaacactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggcttttgctgctgaccccaaaccttactggaatcaagccctgcaggagctgaggcgccttcaccatgcgtgccagggggc

SEQ ID NO: 9034 - DNA, 400 bp, Homo sapiens
  misc_feature 2, 12, 32, 62: n = A,T,C or G
cncctcacggtngacactagtggatccaaagnaattcggcacgaggaactatgaggctgtgnttttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaat

SEQ ID NO: 9035 - DNA, 400 bp, Homo sapiens
  misc_feature 19, 24, 201, 396: n = A,T,C or G
gacaataagctggagctcngcgcnctcgcggtcgacactagtggatccaaagaattcggcacgagatgtgattaagactgagggagccactctaagagttctatatacccctggccacactgatgatcacatggctctactcttagaagaggaaaatgctatcttttctggagattgcatcctaggggaaggaacaacggnatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagnaatg

SEQ ID NO: 9036 - DNA, 400 bp, Homo sapiens
  misc_feature 21, 26, 109: n = A,T,C or G
gaaaaagctggagctcgcgcnctcgnggtcgcactagtggatccaaagaattcggcacgaggtttggtttggagagtccatggatggtggttttcagtttagctacggnaatcctgaacttcctgaagatgtccttgatgtgcagctggattccttcgacttctctccagccgagcttcccagaacatcacatatcactgcaaaaatagcattgatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggcttgtgaga

SEQ ID NO: 9037 - DNA, 225 bp, Homo sapiens
  misc_feature 24, 113: n = A,T,C or G
gacaaaaagctggagctccgcgcnctcgcggtcgacactagtggatccaaagaattcggcacgaggataaagttgcctctcaatccttgccagttattaatttggaatttccngactggagatgtttctaccaacttccaatcttatccctaggccaggttataatagtaaaaagcaaatggtttttatttttattttttttcaagacctccagctaaaaaaaaa

SEQ ID NO: 9038 - DNA, 400 bp, Homo sapiens
gaacaataagctggagctcgcgcgcctgcaggtcgacactagtggatccaaagaattcggcacgaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaa

SEQ ID NO: 9039 - DNA, 399 bp, Homo sapiens
  misc_feature 385: n = A,T,C or G
gaaaaagctggagctcgcgcgcctgaggtcgcactagtggatcaaagaattcggacgagcttacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggnccttgcccctggaa

SEQ ID NO: 9040 - DNA, 400 bp, Homo sapiens
  misc_feature 21, 23, 28, 33, 69: n = A,T,C or G
gaacaataatgctggagcctngngcgcntgagntcgacactagtggatccaaagaattcggcacgaggnggggtcccagtagcaatagatacaagtcattttcggtggctctatgggtgtgaagccactggcagtttccctggcttgttgtgtaggttaggctgttaggaggcttcctgttcacatgttgctaggactttcctctcacactgtggcagtggtgccagggcagagcattagtagtgggcaggaacacagggaaggctggggccatgcagtgattttttaaatgacagtcctttcagtctacagaaggaagagtgttggagtaagatcagtctcctgggtggttgttagactatgaaaagtactaaaaaaccagagaagacagtggtgttgc

SEQ ID NO: 9041 - DNA, 283 bp, Homo sapiens
  misc_feature 23: n = A,T,C or G
gacaataagctggagctcgcgcncttgaggtcgacactagtggatccaaagaattcggcacgagacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagcccgcaccttgtcatgtaccatcaataaagtaccctgtgctcaa

SEQ ID NO: 9042 - DNA, 400 bp, Homo sapiens
  misc_feature 3, 15: n = A,T,C or G
ttnaagggtgggacncttagtggatccaaagaattcggcacgagaaaagcagcctggaatatcaggctgtaaaacacagacaaactcgggcacagaacgaggcggaggagtctcctgggtaatcaccaagcttcacactcttgcaaagggcccctggtaaaaaacagtgggccttaataagcacattcctttccctttaggcacactaaaatagggaagctagaagtggagctgacagaggtggggggcaaggaggtgcctgcagctgctagaagatgtctgggaacagacatggaaactctccctcccagataagcaaaacaaagcggcacagactaagtcttcctacctgatcaaggaatgggagagagcctatagaaaactctgctctgtacatctg

SEQ ID NO: 9043 - DNA, 400 bp, Homo sapiens
  misc_feature 23, 190, 212, 214, 361: n = A,T,C or G
gacaataagctggagctcgcgcncttgaggtcgacactagtggatccaaagaattcggcacgagcgaaagtaggcggtacgaaccctaatggaggcagttttgaggaggtcctcagctccacggcccatgccagtgcccagagcttggcaggaggctcccggcggaccaaggaggaggagctgcagtgcnaagtccagccagcgtgcagctnantccagaaaccggccactacccagcccatctctgcctgtgcttatccagataagaagaccaaaatcccgctgggaaaaacccaggccttgacattgtattcaaatggcccctccagaaagtttaatgatttccatttgattttgggtngatgatggaccacttgaccatcacatttcagtattcata

SEQ ID NO: 9044 - DNA, 110 bp, Homo sapiens
  misc_feature 6, 9, 110: n = A,T,C or G
accttnagntgggacactagtggatccaaagaattcggcacgagatgtctcacagaaagttctccgctcccagacatgggtccctcggcttcctgcctcggaagcgcagn

SEQ ID NO: 9045 - DNA, 274 bp, Homo sapiens
  misc_feature 23, 28, 96: n = A,T,C or G
gacaataagctggagctcgcgcnctcgnggtcgacactagtggatccaaagaattcggcacgagcaagacccctggacctggggcccagtcggccnctaagagcccttgccccgctcgggtatgaagatcgggcggattgaggatgtcacccccatcccctctgacagcactcgaggaaggggggtcgccgtggtcgccgtctgtgaacaagattcctcaaaatattttctgttaataaattgccttcatgtaaaaaaaaaaaaaaaattcggg

SEQ ID NO: 9046 - DNA, 400 bp, Homo sapiens
  misc_feature 3, 5, 57, 372: n = A,T,C or G
ctngnggtcgacactagtggatccaaagaattcggcacgagtgatggcctgtggctngatgtgatatttattcgagaaaggagcagtgcccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggataccgtggntctagatgaatctttcaatattggattg

SEQ ID NO: 9047 - DNA, 400 bp, Homo sapiens
  misc_feature 23, 28: n = A,T,C or G
gacaataagctggagctcgcgcnctcgnggtcgcactagtggatccaaagcaacacgtgcgttcaggggagcccctcagctggtgccccatttcacaggagaagcggagaagactctttgtcttaaagtcatcaccaagccgagacccatgtgctggggtccccggatcaccacagaatccaggattatttcctattgaaaacaaacacatacggcaatccacaattgtgttagacttgttttaagcagagttgtcacacttaaagataatgaaaagttgttgaaatttgtgtttcacaatgagttatggttacacaacattctgcaatcttgtaagaaagaatttctttgtgatagccccaaaatgaaaagaatttaggatgtggctcccatgttacta

SEQ ID NO: 9048 - DNA, 400 bp, Homo sapiens
gacaaaagctggagctcgcgccttgcggtcgacactagtggatccaaagaattcggcacgagccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatg

SEQ ID NO: 9049 - DNA, 398 bp, Homo sapiens
  misc_feature 21, 226, 377, 395: n = A,T,C or G
acaaaagctggagctcgcgcncttgcggtcgacactagtggatccaaagaattcggcacgaggaggcagatgggattgcttgacccagaagttggagactggagagaactatgattgcaccactgcactgagccctggatgatggggcaagaccctaaatatcctaaataaataggcctggactgtggctcacatctgtaatcccagcacttcgggaggccaaggnaggtgaattaactgaggtcaggagttctagagcagtctggccaaaatggttagaccccgtccctaccaaaaatacaaagattagccaggtgtggcaacccgcacctgtaatcccagctactcgagagtacttctagagcggccggggcccntcgattttccacccgggnggg

SEQ ID NO: 9050 - DNA, 124 bp, Homo sapiens
  misc_feature 3, 10, 14, 37, 40, 42, 50, 61, 62, 78, 84, 105, 114: n = A,T,C or G
ccnggccggngccnccccttttcgcaagggggttccnggnanccaccttnaggttgggggnntaacccccccaaaaanaaaaantttccgggggcccaaccgganagccctttnccgtttgggc

SEQ ID NO: 9051 - DNA, 399 bp, Homo sapiens
  misc_feature 299: n = A,T,C or G
gaacaataagctggagctcgcgcgcctgcaggtcgacactagtggatccaaagaattcggcacgagctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggacacattctggttctctgtgttttgnggactctgctctcactgttcacccagcactagcagtaccagatggttctgtggagtcctggggaatggagagagcacagtctgactccctgccaagtagc

SEQ ID NO: 9052 - DNA, 400 bp, Homo sapiens
  misc_feature 25, 395: n = A,T,C or G
gaacaaaagctggagctcgcgcgcntgcaggtcgacactagtggatccaaagaattcggcacgagcggcacgagccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgnatgtg

SEQ ID NO: 9053 - DNA, 398 bp, Homo sapiens
  misc_feature 21, 26, 183, 295, 324: n = A,T,C or G
aacaataatgctggagctcgngcgcntgaggtcgacactagtggatccaaagaattcggcacgagatccagcatgagccccacgaccaacgtgctcctgtctcctctcagtgtggccacggccctctcggccctctcgctgggagcggagcagcgaacagaatccatcattcaccgggctctntactatgacttgatcagcagcccagacatccatggtacctataaggagctccttgacacggtcacctgccccccagaagaacctcaagagtgcctcccggatcgtctttganaagaagctgcgcataaaatccagctttgnggcacctctggaaaagtcatatgggaccaggcccagagtccttgacgggcaacccctcgcttggacctgcaaga

SEQ ID NO: 9054 - DNA, 399 bp, Homo sapiens
  misc_feature 113: n = A,T,C or G
gacaaaagctggagctcgcgcgcctgcaggtcgacactagtggatccaaagaattcggcacgagagcttctgctgttgctgctgtttgtgttttcacatttactgcaagagcngcgaggtacgtacatagaaggttcctagatcttgaaggggtctcccatttggggcctcatgctgtcagtccctagtaggagggaccgctttctgcagggcaaggggaaagtcctaatccttcctgggcaggccttagttgtccttaagccactccagggacaaagactgactcaaataactggctgctggtcggtgctagctgttaatacatactttgtgagggcttgtgcaaaatgaaaatgctgggccccttattcagagcgcaagaaaaaatccctttaaagg

SEQ ID NO: 9055 - DNA, 400 bp, Homo sapiens
  misc_feature 6, 11: n = A,T,C or G
catttnctggncgctagtggatccaaagaattcggcacgaggcaaactttatacctgataggtaccaaaaccattgcacccagatcagctacagacaagaatagagctttcaatggaaattttaaataaatgggatcaggatcttgaagcttttcattgaaaaattgtaacaggagatgaaacatggctttaccagcgcaatcctgaagacaaaacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcaga

SEQ ID NO: 9056 - DNA, 399 bp, Homo sapiens
  misc_feature 387: n = A,T,C or G
gaacaataagctggagctcgcgcgcctgcaggtcgacactagtggatccaaagaattcggcacgaggagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggnaaatctgtacct

SEQ ID NO: 9057 - DNA, 398 bp, Homo sapiens
  misc_feature 22: n = A,T,C or G
acaaaagctggagctccgcgcnctcgcggtcgacactagtggatccaaagaattcggccgagaaacaatgttttagaaatgtttttcttggtgtaatttaatgccgatttttacctcaattttgttaaagaacttgataatttgatccctccatctatttaatatttaatattttcaggattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgt

SEQ ID NO: 9058 - DNA, 400 bp, Homo sapiens
  misc_feature 294, 349, 378, 391: n = A,T,C or G
gagaggaacaataagctggagcctcgcgcgcctgcaggtcgacactagtggatccaaagaattcggcacgagggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagnggcaagcagatgaatgatgagaagacagcagctgattacaagattttaggtgggntcagtccttcacctggtgttgcctctganaggaggaggtggncttaggcag

SEQ ID NO: 9059 - DNA, 180 bp, Homo sapiens
  misc_feature 2, 12, 28, 147, 155, 160: n = A,T,C or G
tnaggtgggacnctagtggatccaaagnaattcggcacgagaaaaaggtgctgcaagtcccacatgtccctgccagccactcgaggatatgccctcacagccctcatgaagctcagcactcgcctctgtggggacaacaaccgcatncgccaggnggtgnccatctacgggagctgcttg

SEQ ID NO: 9060 - DNA, 347 bp, Homo sapiens
  misc_feature 23, 273, 296, 304, 310: n = A,T,C or G
accgacaataagctggagctccncgcgccttcgcggtcgacactagtggatccaaagaattcggcacgagcaccctgcgccgggcaatatgccgtgaccggacttggtttacgaatacagtgtacgaggttaagatatgataaagtgtaaaaatatatgttatagccacggtggttagtttaacatgttttgtatatatgatttttataaatctattaaaatgtgccttaaattacaaaaaaaaagagtacttctagagcggccggggccccntcgattttccacccgggtggggnaccagggnaagtgnacccaattcgccctatagggagtcgtatacaatcctg

SEQ ID NO: 9061 - DNA, 186 bp, Homo sapiens
taagctggagctcgcgcgcctgaggtcgacactagtggatccaaagaattcggcacgagctggacagacggatagacatacggaagcgaggcctggaccaagagaggcccaggctactggaggagtagaaggatgggccccgtggggtccccactgccccggtacgagggggcccaagaccctggc

SEQ ID NO: 9062 - DNA, 314 bp, Homo sapiens
  misc_feature 9, 14, 35, 284: n = A,T,C or G
aaaaggcanattantctggggctcgcgcgccctgnaggtcgacactagtggatccaaagtaattcggcacgagaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgnccaacaataaacaggaattttattttgctg

SEQ ID NO: 9063 - DNA, 400 bp, Homo sapiens
  misc_feature 11: n = A,T,C or G
cggaacaatangctggagctcgcgcgcttgagggtgcgacactagtggatccaaagaattcggcacgaggcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggac

SEQ ID NO: 9064 - DNA, 234 bp, Homo sapiens
  misc_feature 7, 100, 188, 203: n = A,T,C or G
gaacaanaagctggagctcgcgcgcctgcaggtcgacactagtggatccaaagaattcggcacgagcggcacgagaagatttagaaaaaagtttacaacntaatctagtttacagaaaaatcttgtgctagaatactttttaaaaggtattttgaataccattaaaactgcttttttttttccagcangtatccaaccaactnggttctgcttcaataaatctttggaaaaact

SEQ ID NO: 9065 - DNA, 400 bp, Homo sapiens
gaaaaaagctggagctcgcgcgcctgcaggtcgacactagtggatccaaagaattcggcacgagggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctagg

SEQ ID NO: 9066 - DNA, 282 bp, Homo sapiens
  misc_feature 60, 163: n = A,T,C or G
aaagggaacaataagtctggagctcgcgcgcctgcaggtcgacactagtggatccaaagnaattcggcacgagcggcacgagagtcgtcggggtttcctgcttcaacagtgcttggacggaacccggcgctcgttccccaccccggccggccgccgccgcctntccttagtcgccgccatgacgaccgcgtccacctcgcaggtgcgccagaactaccaccaggactcagaggccgccatcaaccgccagatcaacctggagctctacgcctcctacgttta

SEQ ID NO: 9067 - DNA, 292 bp, Homo sapiens
  misc_feature 27: n = A,T,C or G
aaaaaagctggagctcgcgcgccctgnaggtcgacactagtggatccaaagaattcggcacgagcttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 9068 - DNA, 398 bp, Homo sapiens
  misc_feature 234: n = A,T,C or G
aaaaagctggagctcgcgcgcctgcaggtcgacactagtggatcaaagaattcggcacgagggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccnctttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccatt

SEQ ID NO: 9069 - DNA, 400 bp, Homo sapiens
  misc_feature 332, 343, 354, 378, 397: n = A,T,C or G
gaacaataagctggagctcgcgcgcctgcaggtcgacactagtggatccaaagaattcggcacgagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagagganccccacgagcnggggagagcanctgccccccttttcctgctaaaanaaggcagaatatgacaggnctt

SEQ ID NO: 9070 - DNA, 161 bp, Homo sapiens
  misc_feature 102: n = A,T,C or G
tctggggctcgcgcgcttgcaggtcgacactagtggatccaaaaaattcggcacgaggagtacttctagagcggccggggcccatcgattttccacccgggnggggtaccagggtaagtgtacccaattcgccctatagtgagtcgtattacaattcactg

SEQ ID NO: 9071 - DNA, 400 bp, Homo sapiens
  misc_feature 3: n = A,T,C or G
gancaataagctggagcctcgcgcgcctgagggtcgacactagtggatccaaagaattcggcacgagtgtgaagtactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattg

SEQ ID NO: 9072 - DNA, 290 bp, Homo sapiens
gaaaaaagctggagctcgcgcgcctgcaggtcgacactagtggatccaaagaattcggcacgagcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccacttgttacaggcagaaa

SEQ ID NO: 9073 - DNA, 395 bp, Homo sapiens
gcgacaaaagctggagctcgcgcgcctgcaggtcgacactagtggatccaaagaattcggcacgagtgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaat

SEQ ID NO: 9074 - DNA, 400 bp, Homo sapiens
  misc_feature 10, 17, 31, 33, 36, 40: n = A,T,C or G
accataatgntggaggnctgtgtgaccttgngntgngacnctagtggatccaaagaattcggcacgagaagctttcatcttcagtttacattctccagttcttagaatcattccgtggcatgtccttttctgtattgcataaaaacacagcctagtatacatgagtataccatgcgctctaaaagtctaagtggattcagtgctttaagaagttaactaaagaaaatcccagtcagtgatgcaagatgtcatcctgcccttgtctgcagttgatcaatcagtaaagttatgcaagatgagtaagttctggagacctgctgtatgacattgtgcctattgttaatgatatcgcattatatacttaaagttttctaagagggtaaatctgatgttaaatgtt

SEQ ID NO: 9075 - DNA, 400 bp, Homo sapiens
gaacaataagctggagcctcgcgcgcctgcaggtcgacactagtggatccaaagaattcggcacgagatttgtttaccaagccttgaagatgacaggcaatatgctgatatgctcaatgcatcatacaaattgttttatttaaaactgaactattaaattaagtatcatagcaactcactttacagacaaggaaactgaagctcaaaggttaagtaagggccaggcatggtggctcactcctgtaatcccagcagtttgggaggctgaggtgggaggaggattgcttaagcccgcgagtttgagaccagcctaggcaatatagggagaccccatctctacaaaaaattatctgggcctggtgatgtgtgcctgtagtcccagctacttgagaggctgagg

SEQ ID NO: 9076 - DNA, 384 bp, Homo sapiens
  misc_feature 3: n = A,T,C or G
ganaaaagctggagctcgcgcgcctgcaggtcgacactagtggatccaaagaattcggcacgagagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaaaaaaatcgagagtacttctagagcggccgcgggcccatcgattttccacccgggtggggtaccagggtaagtgtacccaattcgccctatagtgagtcgtattacaattcactg

SEQ ID NO: 9077 - DNA, 100 bp, Homo sapiens
  misc_feature 67, 89: n = A,T,C or G
gaaaataagctggagctcgcgcgcctgcaggtcgacactagtggatcaaagaattcggcacgaggtntcgagagtacttctagagcggncgcgggcccat

SEQ ID NO: 9078 - DNA, 400 bp, Homo sapiens
  misc_feature 319: n = A,T,C or G
gacaataagctggagctcgcgcgccctgcaggtcgacactagtggatccaaagaattcggcacgagaaatgaactaaagagctgaagtcaaaggaatgattccagaagaatctaaacaaatgaactaaggagctgaagtcaaaggaataattccagaagaatctgtgctatgatgagtcaaggatattgaagtggatcaggcatttgctcttgagattggactatgtgaccttcccagtaagaattcatgatgttcatcactttctgagtattcttacctcttaccaaccaatcagtctggtaaaataaccagattggntgttttctctcttctttttcctctgtttcttctttattaatttcctccctccattcctttttttcatgagtttgttgctca

SEQ ID NO: 9079 - DNA, 117 bp, Homo sapiens
  misc_feature 4, 102: n = A,T,C or G
gaanaagctggagctcgcgcgcctgaggtcgacactagtggatcaaagaattcggcacgaggctgagacaagggctaaagctgggagactgaaaaaatgcanaccgccggggcatta

SEQ ID NO: 9080 - DNA, 398 bp, Homo sapiens
gaaaataagctggagctcgcgcgcctgcaggtcgacactagtggatccaaagaattcggcacgagctaatccagacatgacctccctgtgcatggttggctgtgttgcttgccataaacacgagctcaggcctcagagcatctgtctgcttccaagaacactgtttctaaatatagaagacgaaggggctggggcggtggctcaagcctgtaatcccagcactttggaaggccaaggtggacagattgcttgagcccgggagtttgagaccagcctgggcaacatagtgaaaccctgcctctacaaaaaagtacaaataattagctgggcgtggtggtgcacacctgtagcctcagctattcaggaggctgagcccaggaggtcgagtctgcagtaag

SEQ ID NO: 9081 - DNA, 400 bp, Homo sapiens
  misc_feature 121, 382: n = A,T,C or G
gaacaataagctggagctcgcgcgcctgcaggtcgacactagtggatccaaagaattcggcacgagcaggggcggagccctcatggagaacctctgctagagcagtgcagaagtaaaatgnggggttggagcccccacacagactactcactactcgcctagtgcagccgtgagaaaagggccaccctcctatagaccccagaatggtagattcaccgacagcttgcaccatgtgcctgggaaaagtagcagacacaacaccagcctgtgaaagcagccaggagaggagctgtaccctgcaaaagtcacaggggcagacatgggttccctgcaagaccactggaaccaacctcttgcataagtgtgacctggatgtgagacncgggagccaaaagagatc

SEQ ID NO: 9082 - DNA, 400 bp, Homo sapiens
gacaataagctggagctcgcgcgcctgaggtcgacactagtggatccaaagaattcggcacgagcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatg

SEQ ID NO: 9083 - DNA, 400 bp, Homo sapiens
  misc_feature 378: n = A,T,C or G
gaaaaatgctggagctcgcgcgcctgaggtcgacactagtggatccaaagaattcggcacgaggctacccacaccctctgccccctctgtctgggcgtccccttgctctctcgccctcctgacccctttgcgtggctgcccctccttctgatctgtccccacagatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacgggctgagctgggcagctggnaagtggcctctggggtcctcac

SEQ ID NO: 9084 - DNA, 141 bp, Homo sapiens
  misc_feature 7, 9: n = A,T,C or G
cctcgangntgggacactagtggatccaaagtaattcggcacgagtttccctaggctttcttgtctcagcaactttcccatcttgtctctcttggatgatgtttgcccgtcagaattcaccaaataaacttgctctctgga

SEQ ID NO: 9085 - DNA, 303 bp, Homo sapiens
gaaaaagctggagctcgccgcctgaggtcgcactagtggatccaagaattcggacgagtatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgtatgtgccaaagctttactactgtggaaagacaactgttttaataaaagatttacattccac

SEQ ID NO: 9086 - DNA, 175 bp, Homo sapiens
gacaataagctggagctcgcgcgcctgcaggtcgacactagtggatccaaagaattcggcacgagggaggctgaggtaggagaatcgcttgaatccgggagctggaggttgcagtgagccaagatcgcaccattgcactccagcctgggcaacaagagcgaaactccatctcaaa

SEQ ID NO: 9087 - DNA, 400 bp, Homo sapiens
  misc_feature 14, 33, 36, 266, 302, 371, 391: n = A,T,C or G
gaaccatttgctgnaggcctgcgtgcccctgantgngacactagtggatccaaagaattcggcacgagccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggnggtgttggagccgctgccattgctgggattggaggngaaaaagctggcggttttgccccgtattatggagatgaaccaatggatttcaaaatcaacaccgatganattatgactttcactcaagnctgttaatg

SEQ ID NO: 9088 - DNA, 353 bp, Homo sapiens
  misc_feature 318: n = A,T,C or G
gaacaataagctggagctcgcgcgcctgcaggtcgacactagtggatccaaagaattcggcacgagcaaaaggttaaggctaggttgaagtctagaatgaaagaaatctgaatccatgtcattcataaccccttgatctgtagtgtcatgggtgctgccgcaggcaggggagtgagcttgggggtgccttgcagccttccactcctgccccgcctcaccccacatgctccctgtttctcatgctttctctaacttcctcaccccttaaccaaaaaggggtgttttcttttgtgcatatagccattcttaaatatcagngatgtaaacctcactttattaaaaaattatccagc

SEQ ID NO: 9089 - DNA, 400 bp, Homo sapiens
  misc_feature 3, 242: n = A,T,C or G
ganaataagctggagctcgcgcgcctgcaggtcgacactagtggatccaaagaattcggcacgagggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctacncagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaagggg

SEQ ID NO: 9090 - DNA, 381 bp, Homo sapiens
  misc_feature 2, 182, 231, 234, 241, 291: n = A,T,C or G
gngacactagtggatccaaagcgctgtcagattccgagtccgaaaggtccctgagtagattggaagcagtgacagcacgctcctttgaagaggaaggagagcatttgggcagtagaaaacacagaatgtccgaagaaaaagactgtggtgggctggggatgctctctccaatggcatcaagnaaacacagaacaagtttgcccttctcctatgttttccagaaatgacttnagnatctggngcctcctcagaaaatgtattggaatgggactatccaagatcacgatgccngttatatttaatgagcctcttgagcttcctacagcgcctaactgaatacatggagcatacttacctcatccacaagggcagggtcacctc

SEQ ID NO: 9091 - DNA, 400 bp, Homo sapiens
gaacaataatgctggagcctcgcgcgcctgcaggtcgacactagtggatccaaagaattcggcacgagcacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggccggtggctcacgcctgtaatcccagcactttgggaggccgaggcaggcggatcacaaggtcaacgagatcgagaccatcctggccaacatggtgaaaccctgtctgtaccaaaaatacaaaaattaattgggca

SEQ ID NO: 9092 - DNA, 400 bp, Homo sapiens
  misc_feature 2, 7, 54, 84, 86, 230: n = A,T,C or G
cncttgnggtgggcgctagtggatccaaagttttttttttaaaaatatttatgnggagtttttaatccatattagaattcagtngntgtaacttgaccataaatttaaacagaaaccatcttctgagacatacattctaataaatgtatcaacagtactgatagtcaacgaagggtcaatttaaacttattagtaacatttcatttttctatccaacagaaatctatagnggtttgccccattacatatctgaaacattgtcttatgaaaacaaaatgaaacaaaattaaataaaattgaagataaaaatactctggaagcacaggatatctgacaagaatcttcagcacaaagcacatgtttgaaaacgtgaaacgatgactctttggaggacaatagc

SEQ ID NO: 9093 - DNA, 400 bp, Homo sapiens
  misc_feature 8, 24, 35, 84: n = A,T,C or G
gacaatangctggagctccgcgcnctcgcaggtcnacactagtggatccaaagaattcggcacgaggaatacaccgactacggnggactaatcttcaactcctacatacttcccccattattcctagaaccaggcgacctgcgactccttgacgttgacaatcgagtagtactcccgattgaagcccccattcgtataataattacatcacaagacgtcttgcacctcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatcttt

SEQ ID NO: 9094 - DNA, 400 bp, Homo sapiens
gaacaatatgctggagctcgcgcgccctgaggtcgacactagtggatccaaagaattcggcacgagcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgtgcaaggatcatgatttccattccgtgttacaatgacaatatttaatgagcataaccttctcagtctcctgctctcaaatttaggacagagccgctaaggacaaaacaatccctcccgtgcttt

SEQ ID NO: 9095 - DNA, 374 bp, Homo sapiens
  misc_feature 9, 301, 343, 359: n = A,T,C or G
gaacaatangctggagctcgcgcgcctgcaggtcgacactagtggatccaaagaattcggcacgagctcgtgccgaattcggcacgagtatgcttacacctacctttatcaccattcgttcatgaatcatgcctagctccatccttgccctgggacctactaggccttccatccaactgggaaatggggagaagcaaagctggcctcatgctcttcagggtcaggttcctatctggagttgaccaggcctaccccagttgccattcctgaaaaatctcagctgccaggctgcctttagggnccctgtagacccaggagagttgagagggtgggggacacaganagaatagagaggatgngggacctgccagagg

SEQ ID NO: 9096 - DNA, 400 bp, Homo sapiens
  misc_feature 23, 26, 32, 33: n = A,T,C or G
gaacacataatgctggagctcgngcnccctgnnggtcgacactagtggatccaaagaattcggcacgagggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtgggtttgtatgctactttttggggggcagggctcattttcagcag

SEQ ID NO: 9097 - DNA, 400 bp, Homo sapiens
  misc_feature 319, 335, 336, 361: n = A,T,C or G
gaaaataagctggagctcgcgcgcctgcaggtcgacactagtggatccaaagaattcggcacgaggccgcgcggtgaggttgtctagtccacgctcggagccatgccgtccaagggcccgctgcagtctgtgcaggtcttcggacgcaagaagacagcgacagctgtggcgcacttgcaaacgcggcaatggtctcatcaaggtgaacgggcggcccctggagatgattgagcccgcgcacccctacagtacaagctgctggagccaggttctgctttctcggcaaggagcgattttgctggtgtagacatcccgtgtnccgtgtaaagggtggnnggccacgtggcccaaaattatgctnttccgtcagtccattctccaaagcccttggggggcctat

SEQ ID NO: 9098 - DNA, 400 bp, Homo sapiens
  misc_feature 8: n = A,T,C or G
gaacaatnagctggagctcgcgcgcctgcaggtcgacactagtggatccaaagaattcggcacgaggcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttc

SEQ ID NO: 9099 - DNA, 213 bp, Homo sapiens
  misc_feature 181: n = A,T,C or G
gaaaaagctggagctcgcgcgcctgcaggtcgcactagtggatccaaagaattcggcacgagattgatcagaaagctgtggactcacaaattttaccaaaaatcaaagctattcctcagctccagggctacctgcgatctgtgtttgctctgacgaatggaatttatcctcacaaattggngttctaaatgtcttaagaacctaattaaatag

SEQ ID NO: 9100 - DNA, 399 bp, Homo sapiens
  misc_feature 8: n = A,T,C or G
cctgcagngcgacactagtggatccaaagaattcggcacgaggttttctcaagcatcttcaaagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgacagcccaaagccagcattatgtgtaactctggcaggactaatccccttcgttgctccaccactggtcatgctgatgacaaaaacttatattcccatattagc

SEQ ID NO: 9101 - DNA, 400 bp, Homo sapiens
gacaataagctggagctcgcgcgccctgcaggtcgacactagtggatccaaagaattcggcacgagatgaaaaggaaagatcagtttcctagccttgtgtcaggagcccatgtgaggccagttcttggcttctccttggctggaaataggagggtacaaatagggtcacctactctcaaattctgcggtccaaattgtggttggagatgagatgttctatttctgcatctctcctggaccatcttagagcagtgcaaagtttactggatcttccagtgcattattggcctttggtgtgatgacgagagagcaggaaggaggtctccagctccttttctgagttcagatgttccctagcccaagaagactaatcatgcacctggtttcctgctctgaaaaa

SEQ ID NO: 9102 - DNA, 291 bp, Homo sapiens
  misc_feature 220, 226, 270, 272, 277: n = A,T,C or G
gaaaataagctggagctcgcgcgcctgcaggtcgacactagtggatccaaagaattcggcacgagccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgggtccnggggangacaacgctttttccttttgacattgaagggagctcagcgggtngncaggncaagacccgccctg

SEQ ID NO: 9103 - DNA, 344 bp, Homo sapiens
  misc_feature 9: n = A,T,C or G
gaacaatangtctggagctccgcgccgccttcgcagggtcgacacctagtggatccaaagaattcggcacgagcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataatcgtaatactctggcattcataaattttattgatgagattatttattttaaaggtttgaggtaacatctctggttgtaccaaagaagaaataaatatggtttctt

SEQ ID NO: 9104 - DNA, 400 bp, Homo sapiens
  misc_feature 19, 21, 355, 358, 374: n = A,T,C or G
gacaataatgctggagctngngcccttgaggtcgacactagtggatccaaagaattcggcacgaggctatatcaggttgcagcggagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggccccgggccgagaagaaggctgctggcaaaggggacgtcccaacgaagagaccacctgtccttcgagcaggagttaacaccgtcaccaccttgggggagaacaaagaaagctcagctggnggngaattgcacacgacgnggatcccatcgagctggttgtcttct

SEQ ID NO: 9105 - DNA, 400 bp, Homo sapiens
gaacaataagctggagctcgcgcgcctgcaggtcgacactagtggatccaaagaattcggcacgaggagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccg

SEQ ID NO: 9106 - DNA, 322 bp, Homo sapiens
  misc_feature 8, 10, 226, 240, 248, 293: n = A,T,C or G
cctgcagngngacactagtggatccaaagaattcggcacgagctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgttngagtcagtccccanaggagagnggaaccctcctccatcttttttgcaacatctcatttcttcctttngctgttgcttcccccctcacacacttggg

SEQ ID NO: 9107 - DNA, 220 bp, Homo sapiens
gacaataagctggagctcgcgcgcctgcaggtcgacactagtggatccaaagaattcggcacgagtagcaaaaatgaaaaagtagaaatgtagtaaaaataagttgaggaaatctagattttacagcaataggacaaagaaattagaaaataggagagagagagatgatataatgtgagaactggtcaccaaggtccaataattgaataatagaagtatc

SEQ ID NO: 9108 - DNA, 400 bp, Homo sapiens
  misc_feature 139: n = A,T,C or G
gaaaaagctggagctcgcgcgcctgcaggtcgacactagtggatccaaagaattcggcacgagcgaagagaccacctgtccttcgagcaggagttaacaccgtcaccaccttggtggagaacaagaaagctcagctggnggtgattgcacacgacgtggatcccatcgagctggttgtcttcttgcctgcccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcacttggggtggcaatgtc

SEQ ID NO: 9109 - DNA, 400 bp, Homo sapiens
gaacaataagctggagctcgcgcgcctgcaggtcgacactagtggatccaaagaattcggcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaat

SEQ ID NO: 9110 - DNA, 233 bp, Homo sapiens
  misc_feature 108, 163, 167, 208: n = A,T,C or G
gaacaataagctggagctcgcgcgcttgcaggtccgacactagtggatccaaagaattcggcacgagtaatggtctatggaattaaaaaatatggtccctttgttgcngactttgctgataaactcaatgagcaaaaacttgcccaactagaagaggcgaagnaggnttccatccaacacatccagaatgcaattgatacggagaagncacaacaggcactggttcagaagcg

SEQ ID NO: 9111 - DNA, 200 bp, Homo sapiens
gaaaataagctggagctcgcgcgcctgcaggtcgacactagtggatccaaagaattcggcacgagggactttcatctgtgcatatcacggccccccagggcagttcctgctggaccagactctctggcagaggaggtggagttcttccatgcaggagcacggcatggcgggagcggggctgcagagtatccgaggtgctg

SEQ ID NO: 9112 - DNA, 242 bp, Homo sapiens
  misc_feature 26: n = A,T,C or G
acaaaagctggagctcgcgcgcctgnaggtcgacactagtggatccaaagaattcggcacgagctcgtgccgaattcggcacgagagcatggaagatgtgtgctctggctcggataagagatgggacatcattcagtcactagttggatggcacaaggctcttcacagacgcatctgtagcagagtggaccttgtactaacttatgatagaatgtatcagaataaatgtttttaacagtgta

SEQ ID NO: 9113 - DNA, 348 bp, Homo sapiens
  misc_feature 26, 245: n = A,T,C or G
acaaaagctggagctcgcgcgcctgnaggtcgacactagtggatccaaagaattcggcacgagcagacttcctcaaatagttctcctaaaaccatttacagaataatctatcttttcagtattaagttaaaataccaccttttccttatactaaattctcgtttgcatgactctggttctaaacttccattgcctttatctgtctggcccagggatagtccacaatattttatttactatctggntgaaagagtctatactttattaatttttattacttattcttctaaacaaattttagagtcgttttgtcaagtgtcaaaaataaatctgccagaatttgtactg

SEQ ID NO: 9114 - DNA, 400 bp, Homo sapiens
  misc_feature 7, 14, 211, 220: n = A,T,C or G
atttagntgggacnctagtggatccaaagaattcggcacgaggacgtcccctatgttgctggtggctctggctgtctttttcggcgcctgttacattctctatctgcgcaccttggagtccaagcttgtgctctttggccgagaggtgagcccagcgaatcagtatgctctggctggaggatctccttccccttcttctggctggctggtncgggctcgncggtcttctgggtgctgggagcaccctggtggtcatcggctcccacgctgccttccaccagattgaggctgtggacggggaggagctgcagatggaaccccgtgtgaggtgtcttctgggacctgccggcctcccgggcaagcttgccccacccctgcccatgccttgtcctgcacgggt

SEQ ID NO: 9115 - DNA, 397 bp, Homo sapiens
  misc_feature 3, 46, 110, 114, 136, 190, 220: n = A,T,C or G
tgngacactagtggatccaaagaattcggcacgagctcgtgccganttcggcacgagccaaaaataatatcattataaaaataagtgtttcaatggcaacagattaaaantacncttataaaatagtgacataganggaaaaattaaggcactggagcaaagtgaaatataaaagaaaatgaataaaaantgttttgaaagaaaataatgagtttgaggngaaaaagattatttatgggaggcggttccaagatggctgaataggaaacagctccagtctacagctcccagggtgagcgatgcagaagacgggtgattactacatttccaacttgaggtactgggttcatcccacagggtgctttttggacactgggggcaggacaggggggggcag

SEQ ID NO: 9116 - DNA, 400 bp, Homo sapiens
  misc_feature 11, 23, 28, 33: n = A,T,C or G
gaacaataagnctggagcctccncgccncctgnaggtcgacactagtggatccaaagaattcggcacgagggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatc

SEQ ID NO: 9117 - DNA, 400 bp, Homo sapiens
  misc_feature 3: n = A,T,C or G
ganaataagctggagctcgcgcgcctgcaggtcgacactagtggatccaaagaattcggcacgagaaaacaaatacaattttttaaataagcaaaagatttgaacacttctcaaaagaagatatatgaatggcaagtaagtaccataataaaagatgcttaacatgtttagtcattagaaaaatgcaaagtaaaagtacagtggagtactacagtacagttaatccagtggctacaattaaaaccgataatagcaagggttgatgagattaaggagctattacaaatcttgtacattgtggctgggaatgcaaaatggtacaaccactctggaaatcagttttgcagtttttataacattaaacatacacttaccacatccagaaatcccacttgcaggt

SEQ ID NO: 9118 - DNA, 398 bp, Homo sapiens
  misc_feature 21: n = A,T,C or G
aacaataatgctggagctcgngcgcctgaggtcgacactagtggatccaaagaattcggcacgagcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagc

SEQ ID NO: 9119 - DNA, 328 bp, Homo sapiens
  misc_feature 21: n = A,T,C or G
gaacaataagctggagctcgngcgcctgaggtcgacactagtggatccaaagaattcggcacgaggaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaac

SEQ ID NO: 9120 - DNA, 400 bp, Homo sapiens
gacaataagctggagctcgcgcgcctgcaggtcgacactagtggatccaaagaattcggcacgagaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctt

SEQ ID NO: 9121 - DNA, 400 bp, Homo sapiens
  misc_feature 159: n = A,T,C or G
gaaaataagctggagctcgcgcgcctgcaggtcgacactagtggatccaaagaattcggcacgagagatcctgcaccctgaggaatgcatgtatgctgtgggccagggggccttgggcgtggaagtgcgagccaaggaccaggacatcttggatctggngggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggcccctgaggatgacccacagtt

SEQ ID NO: 9122 - DNA, 398 bp, Homo sapiens
  misc_feature 21, 26: n = A,T,C or G
gaacaataagctggagctcgngcgcntgcaggtcgacactagtggatccaaagaattcggcacgaggtcttctggattccacaccaaacccactcagacatacccacacagtcccgagtcctgcagatccgacacctggcccccaacacctcctggagctgtcctgtcctttccgtccccaccgctgtacttcagccccgctgcttctctgcttctcccctgaactgctgctcctctctgtttgcttccagtcttgcttctctatgtaccttctccagggtgatcatcttcaaatgcaaatctagccatctccttatctaacaatctaaaacctcccacaagcttctggaatcaagcttaaacttaccagcttagcccaagaagcccttctcgatgag

SEQ ID NO: 9123 - DNA, 180 bp, Homo sapiens
  misc_feature 21, 85, 87, 138: n = A,T,C or G
gacaataagctggagctcgcncgcttgcggtcgacactagtggatccaaagaattcggcacgagctcgtgccgatttcggcgcgngncttattcctcaagtcagtgctgtacggggaacctcggtgctgcctcctgcnccctgcggggccaaaagttggggagccacgggatgaccctgg

SEQ ID NO: 9124 - DNA, 386 bp, Homo sapiens
  misc_feature 25: n = A,T,C or G
gacaataagctggagctcgcgcgcntgcaggtcgacactagtggatccaaagaattcggcacgaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtctt

SEQ ID NO: 9125 - DNA, 398 bp, Homo sapiens
  misc_feature 223, 247: n = A,T,C or G
acaataagctggagctcgcgcgcttgaggtcgacactagtggatccaaagaattcggcacgagccgccatcatgggtcgatgcatgctcccgggaagggcctgtcccagtcggctttaccctatcgacgcagcgtccccacttggttgaagttgacatctgacgacgtgaaggagcagatttacaaactggccaagaagggccttactccttcacagatcggngtaatcctgagagattcacatggngttgcacaagtacgttttgggacaggcaataaaattttaagaattcttaagtctaagggacttgctcctgatcttcctgaagatctctaccatttaattaagaaagcagttgctgttcgaaagcatcttgagaggaacagaaaggataagg

SEQ ID NO: 9126 - DNA, 397 bp, Homo sapiens
  misc_feature 2, 31, 35, 207, 360: n = A,T,C or G
gncctatagtgagtcgatacaattagctggncgcnagtggatccaaagaattcggcacgagcgcagtgcttacgcctgtaatcccagcactttgggaggccgaggaaggcggatcacgaggtcaggagttcgagaccagcctgaccaacatggcgaaaccccgtctctactaaaaatacaaaaattagctgggcgttatggcgggcncctgtaatcccagctacttgggaggctgaggcagaagaatcgcttaaacccaggaggcggaggttgcaagtgagctgagatcatgccattgcactccagtctgggcgacaggagcaagactctgtctcaaaaaaaaaaatcattctttttagncttagcacctacttaaggatccactttttagggctca

SEQ ID NO: 9127 - DNA, 400 bp, Homo sapiens
gaaaataagctggagctcgcgcgcctgcaggtcgacactagtggatccaaagaattcggcacgagttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgta

SEQ ID NO: 9128 - DNA, 280 bp, Homo sapiens
gacaaaagctggagctcgcgcgcctgcaggtcgacactagtggatccaaagaattcggcacgaggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 9129 - DNA, 400 bp, Homo sapiens
  misc_feature 5, 7: n = A,T,C or G
cctgngngcgacactagtggatccaaagaattcggcacgagcctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagaca

SEQ ID NO: 9130 - DNA, 130 bp, Homo sapiens
  misc_feature 11, 12, 29, 33: n = A,T,C or G
gaaccataatnntgaagcctgagtgaccnattnaaggtgggacactagtggatccaaagaattcggcacgagggtacccccagctgctctaccgcctggggcgtttcctgctagaagagggcagcttcca

SEQ ID NO: 9131 - DNA, 400 bp, Homo sapiens
gacaaaagctggagctcgcgcgcctgcaggtcgacactagtggatccaaagaattcggcacgagcttggcacttgcccaaagccacacagaaatagcagaggcagtacttgaatctgggtaatctggcactggactgatcctcctcacctttcagagatattcagagacaaactggagtctgggtgagcctctagcccttggcctgacacctgcaagggtctcatgtttcctcagcaatacactcaattcactgtgtatattgtttttataagaggcatggttcttgccatctgtactaaagtccacaatttatttattgtcttcatggcaattgtgtttaatcctgtagattttggggggctgacacaaggaagaatgtgaaaagtccacaaataggtg

SEQ ID NO: 9132 - DNA, 100 bp, Homo sapiens
  misc_feature 3, 21, 85, 87, 89, 91, 93: n = A,T,C or G
canttcgacactagtggatcnaaagaattcggcacgaggagagagagagagagagagagagagagagagagagagagagagaganananananatatata

SEQ ID NO: 9133 - DNA, 400 bp, Homo sapiens
  misc_feature 3, 25, 76, 88, 141, 170, 210, 212, 213, 259, 395: n = A,T,C or G
ganaataagctggagctcgcgcgcntgcaggtcgacactagtggatccaaagaattcggcacgagctcgtgccganttcggcacgagnggttgtccaagatagaatcttagttcaactttaaatttgcccacagaaccctntaaatccccttgtaaatttaactgttagnccaaagaggaacagctctttggacactaggaaaaaacctngnngagagagtaaaaaatttaacacccatagtaggcctaaaagccgccnccaattaagaaagcgttcaagctcaacacccactacctaaaaaatcccaaacatataactgacctcctcacacccaattggaccaatctatcaccctatagaagaactaatgttaggtataagtaacatgaaaacnttctc

SEQ ID NO: 9134 - DNA, 400 bp, Homo sapiens
gacaataagctggagctcgcgcgcctgcaggtcgacactagtggatccaaagaattcggcacgaggccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggagttagcctcctgtggtaaaggaattgaagaaaatataacaccttacaccctttttcatcttgacattaaaagttctgg

SEQ ID NO: 9135 - DNA, 398 bp, Homo sapiens
  misc_feature 25, 27, 384, 395: n = A,T,C or G
gaacaataatgctggagctcgtgcncntgaggttcgacactagtggatccaaagaattcggcacgagccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgnaagaacaagtnccg

SEQ ID NO: 9136 - DNA, 189 bp, Homo sapiens
  misc_feature 19, 171: n = A,T,C or G
gaaaaagctggagctcgcncgcctgaggtcgacactagtggatccaaagaattcggcacgagctggccttgtctgtggagacggattacaccttcccacttgctgaaaaggtcaaggccttcttggctgatccatctgcctttgtggctgctgcccctgtggctgctgccnccacagctgctcctgttg

SEQ ID NO: 9137 - DNA, 121 bp, Homo sapiens
  misc_feature 3, 4, 67, 72, 74: n = A,T,C or G
atnngtgggacgctagtggatccaaagaattcggcacgagcggcacgaggcccaccctcaggagcanttgcngngccttcaggaatcaacttggttgccccacccagctctcagctaaatg

SEQ ID NO: 9138 - DNA, 400 bp, Homo sapiens
gaaaataagctggagctcgcgcgcctgcaggtcgacactagtggatccaaagaattcggcacgagtcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaat

SEQ ID NO: 9139 - DNA, 251 bp, Homo sapiens
gaaaaagctggagctcgcgcgcctgcaggtcgacactagtggatccaaagaattcggcacgagcggcacgagagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaaaaaaaaaaaaaaaaaaaa

SEQ ID NO: 9140 - DNA, 400 bp, Homo sapiens
  misc_feature 24, 30, 234: n = A,T,C or G
caataatgctggagctcgcgcgcntgcagntcgacactagtggatccaaagaattcggcacgagtgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcantgtccttggcaggctgatttctaggtaggaaatgtggtagcctcacttttaatgaacaaatggcctttattaaaaactgagtgactctatatagctgatcagttttttcacctggaagcatttgtttctactttgatatgactgttttttcggacagtttatttgc

SEQ ID NO: 9141 - DNA, 400 bp, Homo sapiens
  misc_feature 354, 355: n = A,T,C or G
gaaaaagctggagctcgcgcgcctgaggtcgacactagtggatccaaagaattcggcacgagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcgnnttctgtgcttggtacgcctcatccctgcacccaggggcactggca

SEQ ID NO: 9142 - DNA, 400 bp, Homo sapiens
  misc_feature 148: n = A,T,C or G
taagctggagctcgcgcgcctgcaggtcgacactagtggatccaaagaattcggcacgagagaaaccgtctgaactatcctgcccgccatcatcctagtcctcatcgccctcccatccctacgcatcctttacataacagacgaggtnaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgca

SEQ ID NO: 9143 - DNA, 236 bp, Homo sapiens
aaaaagctggagctcgcgccgccctgcaggtccgacactagtggatccaaagtaattcggcacgagggaaaatcaaggcccgcaaaggcaaataaatccttgttttgtcttcacccatgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9144 - DNA, 400 bp, Homo sapiens
  misc_feature 6, 32: n = A,T,C or G
aggganaataagtctggagctcgcgcgcctgnaggtcgacactagtggatccaaagaattcggcacgaggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggat

SEQ ID NO: 9145 - DNA, 100 bp, Homo sapiens
gaaaaagctggagctcgcgcgcctgcaggtcgacactagtggatccaagaattcggcacgaggggacatgggcacctcgggaggcccgggccctgcccag

SEQ ID NO: 9146 - DNA, 400 bp, Homo sapiens
gacaaaagctggagctcgcgcgcctgcaggtcgacactagtggatccaaagattcggcacgagctgatcccatcctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgctgaat

SEQ ID NO: 9147 - DNA, 248 bp, Homo sapiens
  misc_feature 90, 245: n = A,T,C or G
aacaataagctggagctcgcgcgcctgcaggtccgacactagtggatccaaagaattcggcacgaggtatacctacctgtaagtcttttnacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgnctc

SEQ ID NO: 9148 - DNA, 368 bp, Homo sapiens
  misc_feature 17, 72: n = A,T,C or G
aataagctggagctcgngcgcctgcaggtcgacactagtggatccaaagaatcggcacgagctcgtgccganttcggcacgagccaaaatgagacagttaactaaaagggaagaaaacatgatactcgggaaacaaggacaccagtacaagagaggcaaaaggaattacaagtgccatagatctgcagtaggtaggcctgaggaataaattagttcagatttggagcaagaagattgagaattccagaaaggatgtctccaagggagaaaccaggattcagagattacctgatatattcaattacgttgggtagagttttactgatttcatgcagagtttgagaattagtgatagttacataaaaaaa

SEQ ID NO: 9149 - DNA, 238 bp, Homo sapiens
  misc_feature 20, 225: n = A,T,C or G
aataagctggagctcgcgcnccctgcaggtccgacactagtggatccaaagtaattcggcacgagcatgtgtgctaaatgtgttcgtgacaggatcaagcgtgctttccttatcgaggagcagaaaatcgttgtgaaagtgttgaaggcacaagcacagagtcacgaaagctaaataaaaaaatgaaacttttttgagtaataaaaatgaaaagacgctgtaaanaaaaaaaaaaaaa

SEQ ID NO: 9150 - DNA, 400 bp, Homo sapiens
  misc_feature 5, 11, 196: n = A,T,C or G
aaaanctgggnctcgcgcgcctgcaggtccgacactagtggatccaaagaattcggcacgagctgaggttcagagaggtgacgtcacctcgcccacatcttactgctgttagcagcggagtcaagacttgtcctcagctgggctgactccagagcccaggctcccatccaccaggaaaaagactcaaccagcttanaagaggaaatccctggacatcgacggtgtcatgaatgaaacacaagcagagcaatcacaaaacaccccactgccacttactggatggctacttccatattttatcagatctaagatacagtaaattggaagttagaccgtcacttcatgtaccatgaagaaaaagaatgttgcacggcctgattttagagacgttcaaatactg

SEQ ID NO: 9151 - DNA, 400 bp, Homo sapiens
gacaaaagctggagctcgcgcgcctgcaggtcgacactagtggatccaaagaattcggcacgagcaggccctgccctcctaactccaaggctgatccagtcaaatccttccttaggatatttacagccaacatttggtgagaaatgttctctctcctccaattgagagctaaaagaatgtgaccccaaagttatctgtggtcacatgtcttatcataagagcaagtcagtccattagtaaatccttactaagtacatattttgtacccggaattgccctaggtgctagaagataaacaaagataaacaaacagaaacaaaacaggcattttccctgcccttaaaggaacttctgtggatgctctagggcatcagtctgtgtcctgccagcttctggttct

SEQ ID NO: 9152 - DNA, 400 bp, Homo sapiens
  misc_feature 245, 297: n = A,T,C or G
gacaaaagctggagctcgcgcgcctgcaggtcgacactagtggatccaaagaattcggcacgagtagtctcgagttttttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgngggactggcaatactggctctgttggctgtgacatctattccatctgtgagngactctttgacatggagagaatttcactatattcaggtacatggtaggatcaacttcctgaccttgtgacagatcctgccagtaacatgagaggaaatgagaa

SEQ ID NO: 9153 - DNA, 194 bp, Homo sapiens
  misc_feature 22, 166: n = A,T,C or G
acaataagctggagctcgcgcncctgcaggtcgacactagtggatccaaagaattcggcacgaggaagcagtattctggaaagtttttctaagactagtgaagaactgaaggagtcctgcatctttttttttttatctgcttctgttaaaaaagccaacattcctntgcttcataggggttctgcatttgaggg

SEQ ID NO: 9154 - DNA, 400 bp, Homo sapiens
gaaaataagctggagctcgcgcgcctgcaggtcgacactagtggatccaaagaattcggcacgagcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgc

SEQ ID NO: 9155 - DNA, 400 bp, Homo sapiens
aataagctggagctcgcgcgcctgcaggtcgacactagtggatccaaagaattcggcacgaggtacttctgatagtaagagttgtcaactctagtagtccttttcaattaaaagccatagggaaacaaatctgaatctccagaaagacattcattttgtttgggaaaagttctccaggtgattccagtagggcttctttcccttccccaccagtggagttttaagtgggtgaggcatattgagaggtataacataactgaaagacaagccaggttatatggtatttgcacagaattaagcagttgtgattaccttaaaagatagatggagctgctgaaagcaggggagctccttttcgcagggaaaagacacaatgagatttcaagtttagaaagttcac

SEQ ID NO: 9156 - DNA, 400 bp, Homo sapiens
aaaagctggagctcgcgcgcttgcggtcgacactagtggatccaaagaattcggcacgaggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaa

SEQ ID NO: 9157 - DNA, 385 bp, Homo sapiens
  misc_feature 24, 322, 345, 379: n = A,T,C or G
gaaaaaagctggagctcgcgcgcntgaggtcgacactagtggatccaaagaattcggcacgagggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctggtcccgtggaccgacacctgcgccccnttctgcaagcaggattttctggngccaacactcattcatcattcccgatcaactagnatgaat

SEQ ID NO: 9158 - DNA, 211 bp, Homo sapiens
gaacaataagctggagcctcgcgcgccctgagggtccgacactagtggatccaaagaattcggcacgagctcgagttattttgtgtgcatgcctcatttccctgacttaaacctcactgagagcgcaaaatgcagctttatactttttactttcaattgcctagcacaatagtgagtacatttgaattgaatatataataaatattgcaaa

SEQ ID NO: 9159 - DNA, 281 bp, Homo sapiens
  misc_feature 3: n = A,T,C or G
ganaataagctggagctcgcgcgcctgcaggtcgacactagtggatccaaagaattcggcacgagcaataaccaaaattgaacacacagttttaaagctttttatatttagtagcagttgaatatatatggcatgttttacatagattaattttactatttttctttatttaaaaaagagaaccaaattgaaagccgacagatactgcagatgactgggatttttgtttctgtcttacctttttgtgttttttttctgaataaaatattcagaggaaatgc

SEQ ID NO: 9160 - DNA, 400 bp, Homo sapiens
gacaaaagctggagctcgcgcgcctgcaggtcgacactagtggatccaaagaattcggcacgagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaaaaaaaaaa

SEQ ID NO: 9161 - DNA, 340 bp, Homo sapiens
  misc_feature 10, 13: n = A,T,C or G
gtgcgcctgngtncgacactagtggatccaaagaattcggcacgagaaaattgtaagcgttgttaggtttttgtgtaagattcttgctgtagcgtggatagctgtgattggtgagtcaaccgtctgtggctaccagttacattgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaa

SEQ ID NO: 9162 - DNA, 400 bp, Homo sapiens
  misc_feature 2, 3, 76, 353: n = A,T,C or G
gnncgacactagtggatccaaagaattcggcacgagttgaagagaaaatggcctaccaggaatacccaaatagccngaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgtngaagaacctcctcagccaacggcagttcccttagagctagccaagga

SEQ ID NO: 9163 - DNA, 400 bp, Homo sapiens
gaacaatattgctggagctcgcgcgcctgcaggtcgacactagtggatccaaagaattcggcacgaggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatca

SEQ ID NO: 9164 - DNA, 400 bp, Homo sapiens
gacaaaagctggagctcgcgcgcctgcggtcgacactagtggatccaaagaattcggcacgagcagaaatataagcaaacttgaaacacttaaatacactgtagtatattaaactagttaggaactagttgtatatcttttctaaaaaggatccattttcaatttcatagggaaaactgacacctaagattgtagaatcgtgtgtgaaacaagagtaaattgaacttgagtagaggccatgaggattcttctaagagctcagctggatagtcctcacttgaggtgtctcatgattgccctgacttgagttgctgtcatctgagggctggcaaactcacaggtcacatgcctcggctggaagaactcacatctctggagttctctccatattttctttcca

SEQ ID NO: 9165 - DNA, 400 bp, Homo sapiens
  misc_feature 15, 32, 33: n = A,T,C or G
gaacaataatgctgnagctcgtgcgcctgagnncgacactagtggatccaaagaattcggcacgaggttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcg

SEQ ID NO: 9166 - DNA, 190 bp, Homo sapiens
  misc_feature 3, 28, 31, 32, 97, 189: n = A,T,C or G
tanagtgagtcgtattacaattactggncgnnagtggatccaaagaattcggcacgagccggcgttggggacccaggagcgacttagccgtggtggngatgccaagtccccagttcttcaggaaaagggcctgcaggcctcccgggctccagccactccctagggatgaggacctggaggaggaggaana

SEQ ID NO: 9167 - DNA, 400 bp, Homo sapiens
gaacaaaagctggagctcgcgcgcctgcaggtccgacactagtggatccaaagaattcggcacgagtctctgtggtgggacatttgcaaagcggatagatggatcaagggaaggtgcctcagatgtctacccagtcaggtcctgctaggatagatggtacaagttctcatggtacctacgccaaaaattgagtcattaatctgaggcattttatgatacacagtctgacaatcactattctaggcactgcagcagatacagatagaaataagacagcccttgtattaaggacatgcatttttagaattattttgacattgcttggcatattgtctccagattttgctactatgcagaatccttcaatagatccctgactgagtatttctttccatatgtc

SEQ ID NO: 9168 - DNA, 260 bp, Homo sapiens
  misc_feature 24, 178: n = A,T,C or G
gacaaaagctggagctcgcgcgcntgcaggtcgacactagtggatccaaagaattcggcacgagatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacattcca

SEQ ID NO: 9169 - DNA, 340 bp, Homo sapiens
  misc_feature 16, 225, 244, 276, 308, 313, 320: n = A,T,C or G
aaaagctggagctcgngcgcctgcaggtcgacactagtggatccaaagaattcggcacgagcctcagcgtatatgctgcgcctgcccccacccgccggagcctacatccagaatgaacacagctaccaggtgggcacgcgccttactctggaagcggcgagccgaggcagcccttgatgcccttgacaaggcccagcgccagcttgcaggcctgcaagcggcggnagcagcggctgcggttganactgaccaagctgcaacaagggagcgggcacnggaagaagcgggcacaggcagatcccccccanaattntaaggancatgtgcaggaatttgccat

SEQ ID NO: 9170 - DNA, 237 bp, Homo sapiens
  misc_feature 3, 47, 71, 203, 222, 236, 237: n = A,T,C or G
tgnaggtcgacactagtggatccaaagaattcggcacgagctaccgnctctggtactaccttgcggttgcnaccactgcaacctgaggaggatgacgatgaggatgaagaagatgatgatgacttatctcagggctatgatagctcagaaagggacttctcactcattgatgatcctatgatgccagctaactcagactccantgaagatgctgatgactgnagccccagcatggnn

SEQ ID NO: 9171 - DNA, 333 bp, Homo sapiens
gacaaaagctggagctcgcgcgcctgcaggtcgacactagtggatccaaagaattcggcacgaggctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaa

SEQ ID NO: 9172 - DNA, 400 bp, Homo sapiens
  misc_feature 377, 379, 384: n = A,T,C or G
gaacaataagctggagctcgcgcgcctgaggtcgacactagtggatccaaagaattcggcacgagttttatttttagaaaaacagagcaaagtttattgaaatttcaagctacatttggaaaatcaaaatccaaatcctggaaccatacatcaggataaggtgtcaaaaagtggaaagtgttcactctcacaaaacccgctacagacaagctttctgggcacacctcccaggctccattggatcaaagccatccccttgttcatccctcctcgtgccgaattcggcacgagctgccctgaggcactcttccagccttccttcctgggcatggagtcctgtggcatccacgaaactaccttcaactccatcatgaagngngacgnggacatcccgcaaaga

SEQ ID NO: 9173 - DNA, 373 bp, Homo sapiens
gaacaaaagctggagctcgcgcgcctgcaggtcgacactagtggatccaaagaattcggcacgaggttgggctcgccctggagttggaggcttaatccagctgaaagaaacctttgggaatggatatcagaagatttggccttaatatatttccattgtgaccagcagcaggcttttttccccccagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttat

SEQ ID NO: 9174 - DNA, 400 bp, Homo sapiens
gacaaaagctggagctcgcgcgcctgcaggtcgacactagtggatccaaagaattcggcacgagctgtttcttagtctttgtttgttttgcaaagagctaagtgctccacatttacagtccacgtgtgtttatttagggtccactatgtgtctgctgatactgactgtggggtccacaactgaaactataagaccaggttcttgctcttaagttctcagctatctgggtagacgaaaccattttgaagcaacacatgaagacagatctgtatgacctacagattgcaagtcctctagaaggtgcatgaggaaactgctcattttaagccaaagttgtttggaaaggctgcaaaaagcatgtagcaacagagctgtttttggagcatgggaagaattggga

SEQ ID NO: 9175 - DNA, 119 bp, Homo sapiens
gacaaaagctggagctcgcgcgcctgaggtcgcactagtggatccaaagcgaaattcacatccactaatgtttacatttttaaagctttaatgtctgtttttaaggaatagttctttaa

SEQ ID NO: 9176 - DNA, 215 bp, Homo sapiens
gaaaaagctggagctcgcgcgcctgcaggtcgacactagtggatccaagaattcggcacgagcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaa

SEQ ID NO: 9177 - DNA, 385 bp, Homo sapiens
  misc_feature 17: n = A,T,C or G
aataagctggagctcgngcgcctgcaggtccgacactagtggatccaaagaattcggcacgagcggcacgagtagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctg

SEQ ID NO: 9178 - DNA, 400 bp, Homo sapiens
  misc_feature 8: n = A,T,C or G
gacaatangctggagctcgcgcgcctgcaggtcgacactagtggatccaaagaattcggcacgagggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaa

SEQ ID NO: 9179 - DNA, 400 bp, Homo sapiens
  misc_feature 197, 251, 289, 380: n = A,T,C or G
gaaaataagctggagctcgcgcgcctgcaggtcgacactagtggatccaaagaattcggcacgagctcgtgccgcaaaaacggctccttttttgcgcctcctagtgaaacttaaccagctagaccatttgagtaccagcatttagttacaaacgtcaaaggcttccggggctgcttaccttccttttttgttaatgngcttttatttattaaaaaaaattacaatgaagatgcctgttttgtctctactgngtactctgatcgtatctttccaaagtgcagactcttgngaagttttcttaaattgttcactttaaagaaaatgacgtaccaacaatgatttggcttttatattactgtaagatgttataatggtaatgnggatgtagggcttttacttt

SEQ ID NO: 9180 - DNA, 400 bp, Homo sapiens
  misc_feature 280, 334, 372, 394: n = A,T,C or G
gaacaataagctggagctcgcgcgcctgcaggtcgacactagtggatccaaagaattcggcacgagtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggngtaaatgttgagccttttttggcctggcttgtttgcaaaggccctggccaacgncaacattgggagcctcatctgcaatgtaggggcccggnggaccctgctccagcagctggngctgca

SEQ ID NO: 9181 - DNA, 229 bp, Homo sapiens
  misc_feature 2, 4, 53, 73, 148, 149, 151: n = A,T,C or G
gngngacactagtggatccaaagaattcggcacgagctcgtgccgaattcggncgagcccttctgaaaaggcnctcttttataaaacaaaataggcttgaaaaaatatttaagaggaaaataaccaaaaatggaccttcccaaaagcnngnctgaatatttcttttacatggacatttacaacccttcacttggtttcaagagattacctcacaccaaaattcttttaa

SEQ ID NO: 9182 - DNA, 400 bp, Homo sapiens
gaaaaaagctggagctcgcgcgcctgcaggtcgacactagtggatccaaagaattcggcacgagcttttctatccttcgggtccgcgcatttgccatccatacatgttactggatacagttagctggaacatatgaaatgccctttcctagcacacacaatggatctacgtatgtacaggcctaaaaacagaatacacatcctacatgacatgtacacatgtgcacacagaaacaacagccttcacgccgtctgcatatgcgggccatgcccaggtcccaggcacacaggccaggcgacagtccacttcatcactcaattgcctgctctcttttcctcactccttcctcaagcagctgtccgtgggggagagcctctgctcctagctatcgcagtgtctc

SEQ ID NO: 9183 - DNA, 321 bp, Homo sapiens
gacaaaagctggagctcgcgcgcctgcggtcgacactagtggatccaaagaattcggcacgaggcaaaatatgcataagaaaagtcccacaaagttgtgattttgctactttttcaattccaaattctttccctaggaagtttgatgctgagcctggcctgtctgtggtggggaaggaggcctgggccacagccactggacctgtctctgggatctggacctgatgcccagcgagtagcccgcaggttgcgtcccccactggaacacccctgggaacctgggtgggagcggcaggtacagggggccagtgcagagtcaggg

SEQ ID NO: 9184 - DNA, 400 bp, Homo sapiens
aaaagctggagctcgcgcgcctgcaggtcgacactagtggatccaaagaattcggcacgagctcgtgccgaattcggcacgaggtttgccagagaggagactgcattaatactgcagggtcctatgattgtacttgtccggatggatttcagctagatgacaataaaacatgtcaagatattaatgaatgtgaacatccagggctctgtggtccacaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttca

SEQ ID NO: 9185 - DNA, 400 bp, Homo sapiens
  misc_feature 16, 25, 30, 33, 251, 258, 274, 308, 317, 323, 365, 367: n = A,T,C or G
ctatagtgagtctgtnttacaattnctggncgntagtggcatccaaagaattcggcacgagccggcgttggggacccaggagcgacttagccgtggtggtgatgccaagtccccagttcttcaggaaaagggcctgcaaggcctcccgggctccagccacttcctagggatgaggacctggaggaggaggaagaggaggaggaggatgaggacgaggatgatttgctgacggctgggtgtcaggggctggngacgttngaagatgtggctgtgnacttctccctggaggagtggaaaaggctggaagnagaaccagngggccntctaccaggaaagtccatgcaggaaaactatgggattctcgngnccttgggataccccaattcccaaaccccgatct

SEQ ID NO: 9186 - DNA, 400 bp, Homo sapiens
  misc_feature 20, 23, 31: n = A,T,C or G
gacaaaatgctggagctcgngcncctgaggncgacactagtggatccaaagaattcggcacgagccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcacca

SEQ ID NO: 9187 - DNA, 204 bp, Homo sapiens
  misc_feature 78, 94, 135, 171: n = A,T,C or G
gacaataagctggagctccgcgcgcttcgcggtcgacactagtggatccaaagaattcggcacgagctcgtgccgcanatttgaagtggtaggngatgttcttgcagtggtaggtgatgttctgagaggcatagntggccagcagccccttgaaggcaaggttggggagcnttttccttggaggcccctccttctacatatatt

SEQ ID NO: 9188 - DNA, 400 bp, Homo sapiens
gacaataagctggagctcgcgcgcctgcaggtcgacactagtggatccaaagaattcggcacgaggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaacca

SEQ ID NO: 9189 - DNA, 315 bp, Homo sapiens
gacaataagctggagctcgcgccgcctgcaggtcgacactagtggatccaaagaattcggcacgaggaaaaatgggctcaataatgagcatagtgtatgcccatggaaaagagaaagcattctcattaagcatttgtggtgatgatgatgatgatgatgatgatgatgacatcatcaaaagctccaaagggtaaattgctgcatttgccaaaggcagaactggatgagatgcatgcttcataaaataaatcaagggtagacaggatggcttcatcgactcttccttcagaggataagcagcattttggaataaac

SEQ ID NO: 9190 - DNA, 400 bp, Homo sapiens
gaacaaaaagctggagctcgcgcgcctgcaggtcgacactagtggatccaaagaattcggcacgagcggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccatt

SEQ ID NO: 9191 - DNA, 400 bp, Homo sapiens
gaacaataagctggagctcgcgcgcctgcaggtcgacactagtggatccaaagaattcggcacgagaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgttttat

SEQ ID NO: 9192 - DNA, 400 bp, Homo sapiens
  misc_feature 5, 8, 313, 398: n = A,T,C or G
cctgngtncgacactagtggatccaaagaattcggcacgagcggcacgagctctgttggggctctcagctctgaaggttgtgagacccctgatttcccacttcacacctctgtacttctgtgtgtgtgtctttaattcctctagcgccgctgggttagggtctccccgaccgaggctcgaatccaggtcgaagggtcgccggagcgatggttggagaatgtggaaggagctggaggacacccgagtattcttaaagcaatccccatggtgagtaagaaggggagctcggaagcatcagggtaacaatgggatnggtttggggtctggttccttccaccttggaaccttttcaagctaatgaggagggaggagagtataacgaagtaacagaaggaggnta

SEQ ID NO: 9193 - DNA, 400 bp, Homo sapiens
  misc_feature 8, 11: n = A,T,C or G
gcgcctgnggncgacactagtggatccaaagaattcggcacgagtgatatttaaaatgcgtaattaagaaaacccattgttgttgtgtttttcttgtataccaataattaagccactactgttggcactgtttggttttctgttttaacactgaaggagtgaaagtatttcctatatttatgaatttactactaaaatcttggcaaaaaaagaaaaaaattgtctaacatgtgtgggtgaaaactgttaatcaagtgtttctactcccccccgaaaatcccctgaaagttggacaccaactgtataccctaggttgcttaaagggatttcactattatataaagtcaataaaaatggaagtagttgtatatatgcaacatttgtgtacagaggggaaata

SEQ ID NO: 9194 - DNA, 368 bp, Homo sapiens
  misc_feature 23: n = A,T,C or G
acaaaagctggagctcgcgcgcntgcaggtcgacactagtggatccaaagaattcggcacgagtgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatattttggtttcaaaaggcagatttatcttctcccaacattctgttatttctgatacttttgaaaaactaataaaaactaata

SEQ ID NO: 9195 - DNA, 398 bp, Homo sapiens
acaataagctggagctcgcgcgcctgaggtcgacactagtggatccaaagaattcggcacgagtctatttcagtttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatg

SEQ ID NO: 9196 - DNA, 148 bp, Homo sapiens
  misc_feature 3, 29, 79, 100, 116, 142: n = A,T,C or G
cantaaaagtgaattttcttacatttcantgccccactagtggatccaaagaattcgacacaattgcgctatcaaggtnaaaaggagaaccccatgcggnaacttcgcatccgcanaactctgtctcaacatctggggtggngagagt

SEQ ID NO: 9197 - DNA, 398 bp, Homo sapiens
  misc_feature 6, 7, 93: n = A,T,C or G
accttnngctgcgacactagtggatccaaagaattcggcacgagggcggatcaaggtgaaaaggagaaccccatgcgggaacttcgcatccgnaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatga

SEQ ID NO: 9198 - DNA, 400 bp, Homo sapiens
gacaataagctggagctcgcgcgcctgcaggtcgacactagtggatccaaagaattcggcacgagaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagag

SEQ ID NO: 9199 - DNA, 400 bp, Homo sapiens
gacaaaagctggagctcgcgcgcctgcaggtcgacactagtggatccaaagaattcggcacgagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccatt

SEQ ID NO: 9200 - DNA, 400 bp, Homo sapiens
  misc_feature 2, 3: n = A,T,C or G
gnncgacactagtggatccaaagaattcggcacgaggtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaaccctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaat

SEQ ID NO: 9201 - DNA, 400 bp, Homo sapiens
gacaaaagctggagctcgcgcgcctgcaggtcgacactagtggatccaaagaattcggcacgagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtattta

SEQ ID NO: 9202 - DNA, 400 bp, Homo sapiens
  misc_feature 18, 23, 35: n = A,T,C or G
gaacaataatgctggagnctcgngcgcctgcaggncgacactagtggatccaaagaattcggcacgaggcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgca

SEQ ID NO: 9203 - DNA, 397 bp, Homo sapiens
  misc_feature 1, 221, 390: n = A,T,C or G
ncctatagtgagtcgattacattactgggacgctagtggatccaaagaattcggcacgagtcaagtgattcttctgcctcggcctttagagtagccaggattacaggtgcacgccaccatgcccagttaatttttgtagttttagtagagacagggtttcaccatgttggccaggctggtctcaaactcctgacttcaagtgatcctccttcctccacctnccaaagtgctgggattacaggtgtgagccaccgtgcctggccttatttacattctttactaggtattagtatagagcaatttttattatcttaacagctagcaccagaatttcttttgctcgagagtacttctagagcggccgggggcccatcgattttccacccgggngggggta

SEQ ID NO: 9204 - DNA, 400 bp, Homo sapiens
aataagctggagctcgcgcgcctgcaggtcgacactagtggatccaaagaattcggcacgagcggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggac

SEQ ID NO: 9205 - DNA, 399 bp, Homo sapiens
  misc_feature 20, 26, 27, 35: n = A,T,C or G
ccctatagtgagtctgtgtnaccttnngtgggacnctagtggatccaaagaattcggcacgagtctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctg

SEQ ID NO: 9206 - DNA, 361 bp, Homo sapiens
gacaataagctggagctcgcgcgcctgcaggtcgacactagtggatccaaagaattcggcacgaggaactcctgaccttgtgatctgcccgcctcggccttccaagaagtgcagggattacaggtgtgagccaccgcacctggccccattttgtgttggataagcaataattttaaagtttaccccatttggttttattgttgtttttatttaacaagacgtctacacatatatctattaaatatttatttactgatcattctttctgttgtcggggagagtaacagatcttcagttcaaggaggttggcgttcagacatcaggaagaaattgcaaaataaagtgttttggatcctcaaaa

SEQ ID NO: 9207 - DNA, 196 bp, Homo sapiens
  misc_feature 89: n = A,T,C or G
acaataagctggagctcgcgcgcctgcaggtcgacactagtggatccaaagaattcggcacgagttcacctggctgtcaacttcttggngtcattgctcaagaaaaactggcagaatgtccgggccttatatatcaagagcaccatgggcaagccccagcgcctatattaaggcacatttgaataaattctattac

SEQ ID NO: 9208 - DNA, 400 bp, Homo sapiens
  misc_feature 266, 378, 394: n = A,T,C or G
gacaaaagctggagctcgcgcgcctgcaggtcgacactagtggatccaaagaattcggcacgagctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggntgaaccagcccggcacacccacgcgcaccgccgtgtgacagtggccgggctccctgcgtcccgctggtgacctgcccaccgtccctgtccatgccccgcccttccagctgangacaggctggcgcctncaccca

SEQ ID NO: 9209 - DNA, 398 bp, Homo sapiens
aacaataagctggagctcgcgcgcctgcaggtcgacactagtggatccaaagaattcggcacgagctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatg

SEQ ID NO: 9210 - DNA, 398 bp, Homo sapiens
  misc_feature 23, 350: n = A,T,C or G
acaaaagctggagctcgcgcgcntgcaggtcgacactagtggatccaaagaattcggcacgagcttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgnaagtttttcttcaacatcaatgttcattgtaatgttactgatcatgca

SEQ ID NO: 9211 - DNA, 190 bp, Homo sapiens
gaaaaagctggagctcgcgcgcctgcaggtcgacactagtggatccaaagaattcggcacgagcccacacctgggcctccccctgccactcccctcccttgctcccctctgtccccagggatcaaacagaagcagccgtgggcaaaatacaatttcatttaacaaaaaaaaaaaaaaaaaaaaaaaaaaa

SEQ ID NO: 9212 - DNA, 335 bp, Homo sapiens
ataagctggagctcgcgcgcctgcaggtcgacactagtggatccaaagaattcggcacgagctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaag

SEQ ID NO: 9213 - DNA, 400 bp, Homo sapiens
  misc_feature 3: n = A,T,C or G
ganaaaagctggagctcgcgcgcctgcaggtcgacactagtggatccaaagaattcggcacgaggccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaa

SEQ ID NO: 9214 - DNA, 400 bp, Homo sapiens
gacaataagctggagctcgcgcgcctgcaggtcgacactagtggatccaaagaattcggcacgagggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagg

SEQ ID NO: 9215 - DNA, 399 bp, Homo sapiens
gaacaaaagctggagctcgcgcgcctgcaggtcgacactagtggatccaaagaattcggcacgagccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaaga

SEQ ID NO: 9216 - DNA, 400 bp, Homo sapiens
  misc_feature 2: n = A,T,C or G
gnaaaagctggagctcgcgcgcctgcaggtcgacactagtggatccaaagaattcggcacgaggccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaaca

SEQ ID NO: 9217 - DNA, 400 bp, Homo sapiens
  misc_feature 3: n = A,T,C or G
ganaaaagctggagctcgcgcgcctgcaggtcgacactagtggatccaaagaattcggcacgagctcgtgccgaattcggcacgaggctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcacttta

SEQ ID NO: 9218 - DNA, 400 bp, Homo sapiens
  misc_feature 2: n = A,T,C or G
gnaaaagctggagctcgcgcgcctgcaggtcgacactagtggatccaaagaattcggcacgagcaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattaggggaggttcccctgaaggatgctaaggaatacgctgaatccataggtgccatcgtggttgagacaagtgcaaaaaatgctattaatatcga

SEQ ID NO: 9219 - DNA, 400 bp, Homo sapiens
  misc_feature 3, 17: n = A,T,C or G
aanaagctggagctcgngcgcctgcaggtcgacactagtggatccaaagaattcggcacgagtaaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttg

SEQ ID NO: 9220 - DNA, 396 bp, Homo sapiens
  misc_feature 2: n = A,T,C or G
anaagctggagctcgcgcgcctgcaggtcgacactagtggatccaaagaattcggcacgagccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatt

SEQ ID NO: 9221 - DNA, 171 bp, Homo sapiens
  misc_feature 10, 27, 34, 155: n = A,T,C or G
gaccataatngtgaagctgagtgagcnattgagntgggacactagtggatccaaagaattcggcacgagcggtggtcacctgtactcccagctgcactgttacacgtcttccttcgtcttcacctaccccgaggctgactccttccccagctgtnaagctgccaccgaagg

SEQ ID NO: 9222 - DNA, 104 bp, Homo sapiens
  misc_feature 40, 50, 58, 60, 86: n = A,T,C or G
aataggagtccgaattacaattaactggccgcaatgtagntccaaagatncggccganangtcttgtacacattatttcagagggngaaattacttttgttttg

SEQ ID NO: 9223 - DNA, 399 bp, Homo sapiens
  misc_feature 3: n = A,T,C or G
ccntgaaggtgcggacactagtggatccaaagaattcggcacgagccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagggga

SEQ ID NO: 9224 - DNA, 398 bp, Homo sapiens
  misc_feature 165, 207, 218, 259, 295, 307, 345, 398: n = A,T,C or G
gacaataagctggagctcgcgcgcctgcaggtcgacactagtggatccaaagaattcggcacgaggcctggtcgagacgggagccctggggccaatggcattccgggtacacctggggatcccaggtcgggatggattcaaaggagaaaagggggaatgtctganggaaagctttgaggagtcctggacaccccaactacaagcagngttcatggagntcattgaattatggcatagatcttgggaaaaattgcggagngtacatttacaaagatgcggttcaaataagtgctcntaagagttttgnttcagtggctcactttcggctaaaatgcagaaaatccntgcctggccagcggttggtatttcacaattcaatggagctgaatggttcaggn

SEQ ID NO: 9225 - DNA, 179 bp, Homo sapiens
  misc_feature 140: n = A,T,C or G
acaataagctggagctcgcgcgcctgaggtcgacactagtggatccaaagaattcggcacgagttcctccccttgctacagccctctgccctggtttgggctatgtcaagatccaaaaacatcctgaacctctgtctgtnaaaaaaaaaaaaaaaaaaaaaaaaaaaaaaaaaaaaaaa

SEQ ID NO: 9226 - DNA, 396 bp, Homo sapiens
  misc_feature 199, 201, 291, 295, 298, 326, 336, 368, 369: n = A,T,C or G
gacaataagctggagctccgcgcgcttgaggtcgacactagtggatccaaagaattcggcacgagataccttctccccacagcctctgctgatgcacagagctgcctacacctagacacgtcctggcagggggcctcgggcactccactaccaacccagctccacccagcagtgtcctggggagaaggaaggctgagcntntccccagccttcatgccttccccaccctccagctcctcttggagaagctgttgctgagaccccccccccaggtaaatcagaaccccaacnggtnggncatcagggatggccaccctcccaggatnatccttcctntgttcctttttccctgccacggggaaaaaatnntaagatccttgccccaccctttgtttc

SEQ ID NO: 9227 - DNA, 400 bp, Homo sapiens
  misc_feature 7, 14, 44, 173, 352, 397: n = A,T,C or G
atttagntgggacnctagtggatccaaagaattcggcacgagcntctccgaacgcaacatgaaggtgctccttgcccgccgcctcatcgcggggtccgtcttcttcctgctgctgccgggaccttctgcggccgatgagaagaagaaggggcccaaagtcaccgtcaaggggnattttgacctacgaattggagatgaagatgtaggccgggtgatctttggtctcttcggaaagactgttccaaaaacagtggataattttgtggccttagctacaggagagaaaggatttggctacaaaaaacagcaaattccatcgtgtaatcaaggacttcatgatccagggcggagncttcaccagggggagatggcacaggaggaaagagcatctaccggngag

SEQ ID NO: 9228 - DNA, 100 bp, Homo sapiens
  misc_feature 32, 68, 78: n = A,T,C or G
gaacaataagctggagctcgcgcgcctgaggncgacactagtggatccaaagaattcggcacgagggnggccggctgngagacccacatgtacaccgatg

SEQ ID NO: 9229 - DNA, 398 bp, Homo sapiens
  misc_feature 10, 29, 44: n = A,T,C or G
aaccataatncgtgaaggcctgtgtgacnattgaaggtgggacnctagtggatccaaagaattcggcacgaggttttattaagacaaaaactgacaatgtagtatgaagtttacatttaaacaaagtttacacagaaatctaacacatgcctaaaagaattttacaacgtagctctagatgcaagtctagacaatatcaagaactgatggttctcatgactcaagacagagcattttgggtatgttaccttattaggatttcttaaaaaattgttttgtgtgtgtatgtgtgtgttttaaagtgaaccactgcccaatatgaaagtttaatcttctcctgagaccaaggcttttgaaatcactaaactcttggatcaattcagtgaaacttgtgctgt

SEQ ID NO: 9230 - DNA, 377 bp, Homo sapiens
  misc_feature 26, 30, 142, 197: n = A,T,C or G
cgaaaataagctggagctcgcgcgcntcgnaggtcgacactagtggatccaaagaattcggcacgagcagactgtaagatgttgttttaggggctaaaggggagaaactgaaagtgttttactctttttctaaagtgttggnctttctaatgtagctatttttcttgttgcatcttttctacttcagtacacttggngtactggggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgct

SEQ ID NO: 9231 - DNA, 400 bp, Homo sapiens
gacaaaagctggagctcgcgcccctgaggtcgacactagtggatccaaagaattcggcacgaggaactttcagcaagtggaccttttgaaagtatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagcc

SEQ ID NO: 9232 - DNA, 400 bp, Homo sapiens
  misc_feature 16: n = A,T,C or G
gacaaaagctggagcntcgcgcgccttgaggtcgacactagtggatccaaagaattcggcacgagcaggaatcaaggcagggatccaggcatcaaggcagggatccaggatccaaatcagagaattaggtaagcctagattcagagctcatcttgtaaccacttatctttttattccatagaacatgacctgttccagaatctagtatgaagttaaatggcctcagcagtaaaattctcattgaaggggtgggggcccagtagtttactatctcagtcctttttctcttgcttataacagaatacttgaaactgggtagtttataaaggaaaagaatttatttcataaagttatagaggctggagaagtccaagatcaagaggcttcattctgatgaggg

SEQ ID NO: 9233 - DNA, 303 bp, Homo sapiens
  misc_feature 49: n = A,T,C or G
ctgcgtactaatctcacgactgttaacttccaactttgacgaggccatncgagcgacacgcgcgactggggaaggtgcaatactgtcctgggcatatgcacctttggtttatcagggatattttattagtgttttgtatgtatttaatgacgtattctataggttccattgtctttgcttttctggttttttttatgagacgttagcgtgtgccaaagtgactgtgaaaatgacctttcattcttactaatgatggaaagacctcctgtcatgcatcccacaaataaactcaataaaagttca

SEQ ID NO: 9234 - DNA, 132 bp, Homo sapiens
  misc_feature 55: n = A,T,C or G
gagggatcagctgggttttggccaggaagttgtctttgtggactctgcctgatgnttaagtagtagaaggaaatttttttttggttttgttttttataattcagtttaatcaataaacatgtatttattgac

SEQ ID NO: 9235 - DNA, 352 bp, Homo sapiens
  misc_feature 40, 244, 247, 325, 343: n = A,T,C or G
ataatttattaaaaagcaaaaaaaaattgaagatgatggncactggggttgaggaaatagggtcagaatatgggaggacaatgtacatgaattcatattatggttaacattctagtactcgtgtgttgggtagtggttggtgtcattatgtaattgaaatcccattattatttaataattttatgattattattaacattaaataaaaaggcaagttaatgagtaaaaataaaagagggccttnatngaatcaatgagacactgtgcacaatctaaggattattaatccctttctgtacatttgtctttcattattttttaaagnaatttatctgtgggtagnaagactaca

SEQ ID NO: 9236 - DNA, 352 bp, Homo sapiens
  misc_feature 26, 270: n = A,T,C or G
gcggagttggacatcgggcagcactncaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtnatcagtcagatcatgagtgtgaaaaactggaaatcccaaagcctcgaatggctgccactcagaaacttgttaaaagacatta

SEQ ID NO: 9237 - DNA, 328 bp, Homo sapiens
  misc_feature 35: n = A,T,C or G
tggctacccaacttgccttcatgcgcctgttggcnaactatgcctctcagaacatcacctaccactgcaagaacagcattgatacatggatgaggagactggcaacctgaaaaaggctgtcattctacagggctctaatgatgttgaacttgttgctgagggcaacaagcaaggttcaccttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtg

SEQ ID NO: 9238 - DNA, 335 bp, Homo sapiens
tttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagt

SEQ ID NO: 9239 - DNA, 319 bp, Homo sapiens
atgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttaggatcagagaagaaattggcat

SEQ ID NO: 9240 - DNA, 339 bp, Homo sapiens
tgacagtatccttgaaactttataaattggccttttacattcaagtctgtctgtactgaacctaattgtcatatcatggagatatgtttcttgcatctaattctcatttggattatgcttcctcacagggaccctgaccactgaacaataaagcaattatcgccatgatgatatgcaatattgagcagattatatcatgcttaattttacatattcataaccctgccacttgcagatactgacatcatactgaagctggttttgattagataaatagaaaatggaaattctgaaaaacacagtagcatcccttgtttcttgattttctctttaaagatt

SEQ ID NO: 9241 - DNA, 400 bp, Homo sapiens
  misc_feature 5, 9, 32, 33, 50, 53, 139, 161, 368: n = A,T,C or G
ctgcntgcnccttggagtgcgacactagtggnnccaaagaattcggcacnagngacagtatccttgaaactttataaattggccttttacattcaagtctgtctgtactgaacctaattgtcatatcatggagatatgnttcttgcatctaattctcattnggattatgcttcctcacagggaccctgaccactgaacaataaagcaattatcgccatgatgatatgcaatattgagcagattatatcatgcttaattttacatattcataaccctgccacttgcaggatactgacatcatactgaagctggttttgattagataaatagaaaatggaaattctgaaaaacacagtagcatcccttgnttcttgagtttctctttaaagattaaatttct

SEQ ID NO: 9242 - DNA, 372 bp, Homo sapiens
  misc_feature 7, 19, 69, 164, 257, 322: n = A,T,C or G
cgtgcgncctggggtcganactagtggatccaaagtaattcggcacgaggtatgcaccatcccataaanactatggagaagaccagtccaatggaatgcaacgtcccatgtaaatcgagggaagattgtgctttgtttgtttcggaactttatcaagaattgtncagcgcttcgaaatattccttcatcaatgacaacgcagcttctggtatttgagtcaacaaggcaacacatgtttatcagctttgatttgcagntgtcacagtcacattgattgtacttgtatacgcacacaaatacactcatttagcctttatctcanaatgttaaatataaggaaaaaagcgtcaacaataaatattctttgagtat

SEQ ID NO: 9243 - DNA, 127 bp, Homo sapiens
  misc_feature 3, 15, 40, 87, 97: n = A,T,C or G
tgncatttgtgtgcnccttggagtgcgtcgactagtggcnccaaagaattcggcacgagtgaggccgagttacagctgccgcggctncccgagctgntcgaaactggtagacaggtactggacgaag

SEQ ID NO: 9244 - DNA, 244 bp, Homo sapiens
  misc_feature 2, 4: n = A,T,C or G
antntgtctggagctccgcgcgcctgcggtcgacactagtggatccaaagcattcggcacgagggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccaca

SEQ ID NO: 9245 - DNA, 399 bp, Homo sapiens
  misc_feature 5, 134, 136, 189, 211, 283, 351: n = A,T,C or G
tgganttggtggcttcggggtccgacactagtggatccaaagaattcggacgagggacgaagcagctggcaacctcaagaaggccctgtcatccagggctccaatgacgtggagatccgggcagagggcaatananggttcaccgtacactgccctgaaggatggctgcacagaaacataccggtaagnggggcaaggactgttatcgagnaccgggcacagaagacctcacgcctccccatcattgacattgcacccatggacataggagggcccgagcagnaattcggggtggacatagggccggtctgcttcttgtaaaaacctgaacccagaaacaacacaatccgntgcaaacccaaaggacccaagtactttccaatctcagtcactctagga

SEQ ID NO: 9246 - DNA, 234 bp, Homo sapiens
  misc_feature 2, 20: n = A,T,C or G
gngctccgcgcgcttgacgntcgacactagtggatccaaagaattcggcacgagtcgaagcgaaaagtcctaatagtagaagaaccctccataaacctggagtggctatatggatgccccccaccctaccacacattcgaagaacccgtatacataaaatctagacaaaaaaggaaggaatcgaaccccccaaagctggtttcaagccaaccccatggcctccatgactttttc

SEQ ID NO: 9247 - DNA, 400 bp, Homo sapiens
  misc_feature 12, 13: n = A,T,C or G
aaaaaccaaatnnctggagctcgcgcgcctgaaggtcgacactagtggatccaaagaattcggcacgagctgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattt

SEQ ID NO: 9248 - DNA, 210 bp, Homo sapiens
  misc_feature 9, 13: n = A,T,C or G
aaaaacganaaanctggggctcgcgcgcctgacggtcgacactagtggatccaaagaattcggcacgagccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 9249 - DNA, 211 bp, Homo sapiens
  misc_feature 6, 12, 32, 34, 40: n = A,T,C or G
aaaacngaacantaagcctggagctccgcgcncntgcagntcgacactagtggatccaaagtaattcggcacgagaccctcagctccaccctcagcggatgataatctcaagacacctcctgagtgtgtctgctcactccccttccaccctcagcggatgataatctcaagaaactaaggaagaataaataaataatataaaaataaaatg

SEQ ID NO: 9250 - DNA, 399 bp, Homo sapiens
  misc_feature 279: n = A,T,C or G
aagcgaacaaaagctggagctcgcgcgcctgcaggtcgacactagtggatccaaagaattcggcacgaggcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagngtcacattggagctattcttcactggtccttaaccttgggttttaaaaagaaggcttctctgtttgggtagccgtaagagctgagtattagtaagtcctcttccaaagagatggcaatat

SEQ ID NO: 9251 - DNA, 266 bp, Homo sapiens
  misc_feature 8, 17, 33, 56, 180, 187, 203, 221: n = A,T,C or G
tggtgcgncttgggggncgacactagtggatcnaaagaattcggcacgagtacggncttcctaatctatgccgaccaggatgaccccaacgaggtatagacatgccacggaggccctccaggcagggaacaagcttctggacttgggcttacagagcaagaccccacaactgtaggctgngggtggngggtcgagtgagcggntctagcctcaggctcacnctcctctgcctctttttttccccttcattaaatccaaaccttttt

SEQ ID NO: 9252 - DNA, 169 bp, Homo sapiens
  misc_feature 16, 25, 33, 37, 62: n = A,T,C or G
aaagcgaacaataagnctggagctngcgcgccntgangggtcgacactagtggatccaaagnaattcggcacgagggagaatggcatgaacccgggaggcagagtttgaagtgagcccgagatggcgccactgcccctccagcctgggggacagagcgagactccatct

SEQ ID NO: 9253 - DNA, 400 bp, Homo sapiens
  misc_feature 5, 181, 211, 222, 243, 298, 333: n = A,T,C or G
aaagncgaacaataagctggagctccgcgcgcctgcaggtcgacactagtggatccaaagcaattcggcacgagttttgctttaaatggtaatcttaaaagttgcattgtgctcttcctttgttttgggatagatatatatacgagagagatactataaggaagtttatttcttaggaagngcactgaataatgtatttcttttacagcgnaatatgggggnggggatatgcgaaagaaatgngtatttttgctagttgcctaccttctgagataaataagcacaatcttgcaatggntccaataacccagttaggtattatagattagtatntaagtttgctgtagattgtgtgtgtgtgtgctaagtaaaagctccatgattcacaattttagtatta

SEQ ID NO: 9254 - DNA, 339 bp, Homo sapiens
  misc_feature 8, 14, 38, 60, 120, 137, 195, 314, 321, 336: n = A,T,C or G
tggagctngtgcgncttggggtcgacactagtggatcnaaagaattcggcacgagcacgntctcacactggaagaagagagtttctaatcagatgcaacggcccaaattcttgatctgcngcttctctgaagtttgnaaaagaaaccttcctttctggagtttgcaggagttcagcaatatgatagggaacaggngctgatgggcccaagagtgacaagcatacacaactacttattatctgtagaagttttgctttgttgatctgagccttctatgaaagtttaaatatgtaacgcattcatgaatttccagngttcagnaaatagcagctatgngtg

SEQ ID NO: 9255 - DNA, 114 bp, Homo sapiens
  misc_feature 8, 12, 30, 34, 43, 45, 49, 58, 62, 63, 66, 67, 70, 73, 79,80, 88, 90, 93, 97: n = A,T,C or G
aaaaaagngtgnagatggtggggctggagngcgncactagtgncnctanagaattcgncacnngcnnatngcnctgatnnctgcgcanantgngcanagggacactagactctc

SEQ ID NO: 9256 - DNA, 188 bp, Homo sapiens
  misc_feature 8, 12, 15, 16, 22, 25, 28, 112, 128, 156, 187: n = A,T,C or G
aactgganctgngtnngcactncantgngagactagtggatccaaaaaattcggcacgagtgaagcacaggaagatggccagtcaacttctgaattgattggccagtttggngtcggcttctattccnccttccttgtagcagataaggttattgncacttcaaaacacaacaacgatacccagcana

SEQ ID NO: 9257 - DNA, 292 bp, Homo sapiens
  misc_feature 271: n = A,T,C or G
gaaaaaagctggagctcgcgcgcctgcaggtcgacactagtggatccaaagaattcggcacgagagaaaagctgctggcaggcaaatccgttgaaactttcatatgtaacagcgtttctatttctgctcttcacatctttgaaagaaagtgtgttttagaaaagaaaatgttaaaaaacagaagatatgatctttcttaaaaatgtatgtgtagctccactttaatatttctcattgtggagatgcatggggtttcattatgtcctatgcnctcttggttcccctacctttc

SEQ ID NO: 9258 - DNA, 122 bp, Homo sapiens
  misc_feature 81, 97: n = A,T,C or G
gaaaaagctggagctcgcgcgcctgaggtcgacactagtggatccaaagaattcggcacgagggctcgtgcgtcgatgaanaacgcagctagctgcnagaattaatgtgaattgcaggacac

SEQ ID NO: 9259 - DNA, 189 bp, Homo sapiens
  misc_feature 8, 148, 167, 174: n = A,T,C or G
gaacaatnagctggagctcgcgcgcctgcaggtcgacactagtggatccaaagaattcggcacgagcggcacgaggtgttttctacctcactggtacaggaagaaattagagaaaactggagcaagttcaacaaactatttccagggntgggattaactttagcatnaagttanaggggaaaagtaagg

SEQ ID NO: 9260 - DNA, 200 bp, Homo sapiens
gaacaaaagctggagctcgcgcgcctgcaggtcgacactagtggatccaaagaattcggcacgagaaaacattctcctccgcataagcctgcgtcagattaaaacactgaactgacaattaacagcccaatatctacaatcaaccaacaagtcattattaccctcactgtcaacccaacacaggcatgctcataaggaaa

SEQ ID NO: 9261 - DNA, 400 bp, Homo sapiens
  misc_feature 180: n = A,T,C or G
aataagctggagctcgcgcgcctgcggtcgacactagtggatccaaagaattcggcacgagcctctctccccaagtagaaaatattctcttgccattcctgaaattccacattcatataatggctgtgcaatacatgcttctcaataagaaaattaactgcatgtttactgtgtgctgancacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtattaaat

SEQ ID NO: 9262 - DNA, 400 bp, Homo sapiens
  misc_feature 43, 146, 166, 307, 380: n = A,T,C or G
ataagctggagctcgcgcgcctgaggtcgacactagtggatcnaagaattcggacgagagaagaaccaactccacattcaacccggttgtgttgaagaggttgtttatgagtcgcaccaaccggccgcctctgtccctttcccggntgatccggaagatgaagctncctggccgggaaaacaagacggccgtggttgtggggaccataactgatgatgtgcgggttcaggaggtacccaaactgaaggtatgtgcactgcgcgtgaccagccgggcccgcagccgcaatcctcagggcagggggcangatcctcactttcgaccagctggcccctggactcccctaaggggctgtgggcacctgtcctggctcttccggncctcgcaaggcccgagaggt

SEQ ID NO: 9263 - DNA, 262 bp, Homo sapiens
  misc_feature 2, 64, 204, 213, 258: n = A,T,C or G
anaaaagctggagctcgcgcgcctgcaggtcgacactagtggatcaaagaattcggcacgaggngtttgataaatgttgtccaggttctattgccaagaatgtgttgtccaaaatgcctgtttagtttttaaagatggaactccaccctttgcttggttttaagtatgtatggaatgttatgataggacatacgtagtagcggnggtcagacntggaaatgggggggagacaaaaatatacatgtgaaataaaactcngtat

SEQ ID NO: 9264 - DNA, 164 bp, Homo sapiens
  misc_feature 17, 56, 138: n = A,T,C or G
aaaataagctggagctngcgcgcctgaggtcgaactagtggatcaaagaattcggnacgagaacaaaccatggatttctcttccccgaggaaagggtatccgcctcaccattgctgaagagagagacaaaagactggngggcaaacagagcagtgggtgaaatg

SEQ ID NO: 9265 - DNA, 400 bp, Homo sapiens
  misc_feature 129, 346: n = A,T,C or G
gacaaaagctggagctcgcgcgcctgcaggtcgacactagtggatccaaagaattcggcacgagcaaggatttgcaatatattgttccatttacagccaatacaggtttaatcgatgttcaatattggnttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgccttcttaggcaaagcagtgtaaaactgtatcaattaaggcttgngagtagtgatttccactggggcatcagagtcttggctgggctgaatctgctgct

SEQ ID NO: 9266 - DNA, 120 bp, Homo sapiens
  misc_feature 94: n = A,T,C or G
gaacaaaaagctggagctcgcgcgcctgcaggtcgacactagtggatccaaagaattcggcacgagaggtggatctggaaaacatcctccctgnctatactggctttgtgattgtggctg

SEQ ID NO: 9267 - DNA, 287 bp, Homo sapiens
gaaaaagctggagctcgcgcgccctgaggtcgcactagtggatccaagaattcggcacgagcagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccccaggggacccgggtttttggaaa

SEQ ID NO: 9268 - DNA, 286 bp, Homo sapiens
  misc_feature 208, 218, 255, 279: n = A,T,C or G
ataagctggagctcgcgcgcctgcaggtcgacactagtggatccaaagaattcggcacgagctcgtgccgctttggagtcagattttagttaacaataatgagcctgggagcagtagtactaaggcgtcttttgtaggcttaagaatttatcctaatggcctttataggaccaatgctgattttttttaaaggcagttcctattatgnggcgaaattntgtaaataaatgattatacaaaacagtcaccacctanaactgggtattctttgtacattgncagatat

SEQ ID NO: 9269 - DNA, 400 bp, Homo sapiens
  misc_feature 68, 138, 357: n = A,T,C or G
aaagctggagctcgcgcgcctgcgggtcgacactagtggatccaaagaattcggcacgagctgaggcnaacctggaatttggctcttatcccttcctttataagcccttgtagacagggctctttgggggatggaggnttaattgtaatggcagtcttttaagcctgggtcatggaacaaaatagggcttaatagatgaatgttaagataagtcagcttcccttatgtaactgctagccctatttcttgtgatattaagatgtgcttagtatatttttgttttaaaatttggaagttcttactaagataatcatgttgcagtcatgccaaactgaattgcctaaaaaggaacctgtnttgacctctatgactttaaaaatctctcctttaatcaagcttc

SEQ ID NO: 9270 - DNA, 370 bp, Homo sapiens
  misc_feature 322: n = A,T,C or G
aagctggagctcgcgcgcctgcaggtcgacactagtggatccaaagaattcggcacgagatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagngtaaacaaggcaagcctcagaccaccaataaattactcagttttggat

SEQ ID NO: 9271 - DNA, 229 bp, Homo sapiens
  misc_feature 99, 125, 157, 173, 221: n = A,T,C or G
gaaaaaagctggagctcgcgcgcctgcaggtcgacactagtggatccaaagaattcggcacgagctcgtgccgtacagtgcctccagcctacccatgtntctaagatgtgttggtgtgatttggncttgtggcactgccaaagggatcgataagcanagaccccatgcttcanatcaagagcctgatgaaagtagttcaaagatgcgatgcccctttctcnccatccct

SEQ ID NO: 9272 - DNA, 400 bp, Homo sapiens
  misc_feature 180: n = A,T,C or G
gacaaaagctggagctcgcgcgcctgcaggtcgacactagtggatccaaagaattcggcacgaggcactagaggacattcgattggatggaaaccctattaatctcagcaaaactcctcaagcatacatgtgtctacctcgtctgcctgttgggagccttgtctaatttcagataatggntagcattacgatggctactataaataaaccattcttactgctctcttccaaaacaaaactcagcatgatactttgagattgtgttctgagagatgatatgactacataaaatacaattaaaaatgttataatataatggaaaatgtaggaattttaagaaaacaccagatgagttaggaataaacctataacatttacaaaaagagcaaaactaagtgat

SEQ ID NO: 9273 - DNA, 400 bp, Homo sapiens
  misc_feature 2, 165: n = A,T,C or G
anaagctggagctcgcgcgcctgcaggtcgacactagtggatccaaagaattcggcacgagcttggctgcctgtgggcttccccaggtggcctggaggtgggcaaagggaagtaacagacacacgatgttgtcaaggatggttttgggactagaggctcagtggngggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcaggg

SEQ ID NO: 9274 - DNA, 400 bp, Homo sapiens
  misc_feature 301: n = A,T,C or G
gacaaaagctggagctcgcgcgcctgcaggtcgacactagtggatccaaagaattcggcacgagcttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggggttgcttgtcatggacaccggngaacatgccgtaactctgtgactgcattgtaagtgcagtgggggtaagcagtcctgtgagtggcgcatgaacgctggagcttattccgccgcctgcccc

SEQ ID NO: 9275 - DNA, 338 bp, Homo sapiens
  misc_feature 3, 100, 113, 129, 177, 179: n = A,T,C or G
ganaaaagctggagctcgcgcgcctgcggtcgacactagtggatccaaagaattcggcacgagctcgtgccgaattcggcacgagcttaatcaatgtggntttattcaatggnttgttctttgaatggntgcaaaaactgtagataatcttactgaggactgtacaaacatgaaggngnggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaaga

SEQ ID NO: 9276 - DNA, 272 bp, Homo sapiens
  misc_feature 15, 50: n = A,T,C or G
ggaaattacactagnggatccaaagaattcggcacgagggctctgcctgntgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgcccccgagtagcatgaggagcc

SEQ ID NO: 9277 - DNA, 400 bp, Homo sapiens
  misc_feature 76, 196, 387: n = A,T,C or G
gacaaaagctggagctcgcgcgcctgcaggtcgacactagtggatccaaagaattcggcacgagcagtgacacttngagagctggtagttagtagcatgttgagccaggcctgggtctgtgtctcttttctctttctccttagtcttctcatagcattaactaatctattgggttcattattggaattaacctggngctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgnaatgttacctgat

SEQ ID NO: 9278 - DNA, 400 bp, Homo sapiens
  misc_feature 3, 104, 152: n = A,T,C or G
ganaaaagctggagctcgcgcgcctgcaggtcgacactagtggatccaaagaattcggcacgaggaaagatctttgtgggcacaaaaggaatccctcatctggngactcatgatgcccgcaccatccgctaccccgatcccctcatcaaggngaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttc

SEQ ID NO: 9279 - DNA, 163 bp, Homo sapiens
  misc_feature 2, 117: n = A,T,C or G
gnaaaagctggagctcgcgcgcctgcaggtcgacactagtggatccaaagaattcggcacgagctcgtgccgaattcggcacgaggggaaaggggcccccggccacctgtccaccgngtgggccgtgctgtgtccttatgtcattgtaatataaatacagatt

SEQ ID NO: 9280 - DNA, 398 bp, Homo sapiens
aaagctggagctcgcgcgcctgcaggtcgacactagtggatccaaagaattcggcacgagctcgtgccgaattcggcacgagaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataatt

SEQ ID NO: 9281 - DNA, 265 bp, Homo sapiens
  misc_feature 43, 185, 257: n = A,T,C or G
aaagctggagctcgcgcgcctgcaggtcgacactagtggatcnaagaattcggcacgagcttcttactaccctagctttggtgagtccagagataaggcaaatttcagtgggctctgccttgatgttgctgtagcagaaggactagtctggcaaatgttatgttaatagtttatcacgctatggngataatgagaccaaggttgcattttgatgccaggtaaggttattctgtttagtcacatactcctgaccctanccagctga

SEQ ID NO: 9282 - DNA, 400 bp, Homo sapiens
gaacaaaagctggagctcgcgcgcctgcaggtcgacactagtggatccaaagaattcggcacgaggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaag

SEQ ID NO: 9283 - DNA, 371 bp, Homo sapiens
  misc_feature 210: n = A,T,C or G
gaaaaaagctggagctcgcgcgcctgcaggtcgacactagtggatccaaagaattcggcacgagcccacccccactgtacagagaccaagaacagaaattgtttgtaaataatgaaccttattttttattattgccaatcccctaagatattgtattttacaaatctccctcttcccttcgcccctcccttgttttatattttatgaagntagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaa

SEQ ID NO: 9284 - DNA, 400 bp, Homo sapiens
  misc_feature 359: n = A,T,C or G
gacaaaagctggagctcgcgcgcctgcaggtcgacactagtggatccaaagaattcggcacgagcatttagaaagatccctggacctgtagctagcacttcttccctcaattacttcttaaaatgaattcacaatatttttggcttttgacattctacaataaggcccctaatataaatcgatacaacagaaatttgacaatgacagtattaagataattggcctggaagagaaaatatgtaaaaatggctttgaaaagattaaagtattgtgcaaataagagatatttctttcttaatatttttattcaaagaatcttatgaatgttttcattttataacagaaaatggaagattgcnttgtagactcctgcaaatttgggacgtcagtttcaaacatc

SEQ ID NO: 9285 - DNA, 187 bp, Homo sapiens
  misc_feature 57, 136, 161, 178: n = A,T,C or G
aaaaaagctggagctcgcgcgcctgaggtcgacactaatggatccaaagaattcggnacgagctcgtgccgctagaaattgccctccttttacccctaccatgagccctacaaacaactaacctggcactaatagntatgtgatccctcttattaatcatnatccctagcccctaagnctggcctat

SEQ ID NO: 9286 - DNA, 400 bp, Homo sapiens
gacaataagctggagctcgcgcgcctgcaggtcgacactagtggatccaaagaattcggcacgagcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtct

SEQ ID NO: 9287 - DNA, 152 bp, Homo sapiens
aaaaaagctggagctcgcgcgcctgcaggtcgacactagtggatccaaagaattcggcacgaggaatggcgtgaacccgggaggtggagcttgcagtgagccgagattgcgccactgcactccagcctgggcaacagagtaagactctgtct

SEQ ID NO: 9288 - DNA, 172 bp, Homo sapiens
  misc_feature 12, 84, 170: n = A,T,C or G
aaagctggagcntcgtgcgcctgaggtcgacactagtggatccaaagaattcggacgaggagtacttctagagcggccgcggcnccatcgattttccacccgggtggggtaccatggtaagtgtacccaattcgccctatagtgagtcgtattacaattcactgggccgnaa

SEQ ID NO: 9289 - DNA, 132 bp, Homo sapiens
  misc_feature 103, 113: n = A,T,C or G
gacaaaagctggagctcgcgcgcctgcaggtcgacactagtggatccaagaattcggcacgagattttctattttctttaaaaactgattgttaaaatttgtntttagtaccntgatcagaataattaaaaa

SEQ ID NO: 9290 - DNA, 277 bp, Homo sapiens
  misc_feature 7, 177: n = A,T,C or G
gaacaanaagctggagctcgcgcgcctgcaggtcgacactagtggatccaaagaattcggcacgagccccaacgaggtatagacatgccacggcgggtcctccaggcagggaacaagcttctggacttgggcttacagagcaagaccccacaactgtaggctgggggtggggggtcnagtgagcggttctagcctcaggctcacctcctctgcctcttttttttccccttcattaaatccaaacctttttatttcatccaaaaaaaaaaactcgtgc

SEQ ID NO: 9291 - DNA, 346 bp, Homo sapiens
gacaaaagctggagctcgcgcgcctgcaggtcgacactagtggatccaaagaattcggcacgagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaag

SEQ ID NO: 9292 - DNA, 400 bp, Homo sapiens
  misc_feature 284, 341: n = A,T,C or G
gaacaaaagctggagctcgcgcgcctgcaggtcgacactagtggatccaaagaattcggcacgagaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggnggccgaaaacgcccagttcctaagggtgcaacttacggcaagcctgtccatcatggngttaaccagctaaagtttgctcgaagccttcagtccgttgcagaggagcgagctggacg

SEQ ID NO: 9293 - DNA, 348 bp, Homo sapiens
  misc_feature 155, 175, 243, 297, 324, 325: n = A,T,C or G
aaaagctggagctcgcgcgcctgcaggtcgacactagtggatccaaagaattcggcacgagctcgtgccgatttcggcacgaggaaaagaatggatcttaaatacctcagaaacaattttatctagattaaaacttccccgttgtggccactgcnacttcaaattatttcttgtnggcacacccatttttctagaatggcacaagtttgtggtctataatttctaaataaaaaatttgctggngttccccaactcatgaattacttcttactcaaataaactctaaaattttgctgngctttagattttctttaagtttggggnnagaagtgggattcaaaggagacc

SEQ ID NO: 9294 - DNA, 178 bp, Homo sapiens
  misc_feature 42, 175: n = A,T,C or G
aaagctggagctcgcgcgcctgcaggtcgaactagtggatcnaagaattcggcacgagtgttgatggccgccatcctcatgacatcatcgatgacatcaacagtggtgctgtggaatgcccagccagttaagcacaaaggaaaacatttcaataaaggatcatttgacaactggngga

SEQ ID NO: 9295 - DNA, 176 bp, Homo sapiens
gacaaaagctggagctcgcgcgcctgcaggtcgacactagtggatccaaagaattcggcacgagaagtaaacttttaagaaaaacatttttaatgagattttaatagtaattctagtcagtcatacaactataactactatagagaaaataaaattttttcctttttttttttaaa

SEQ ID NO: 9296 - DNA, 380 bp, Homo sapiens
gaaaaagctggagctcgcgcgcctgcaggtcgacactagtggatccaaagaattcggcacgagcggcacgagctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttat

SEQ ID NO: 9297 - DNA, 400 bp, Homo sapiens
  misc_feature 111, 143: n = A,T,C or G
gacaaaagctggagctcgcgcgcctgcaggtcgacactagtggatccaaagaattcggcacgagccgaacattacaaccaaatgggttactattctattatgcttcagggncagacgtgttctccatctcactggataatggnactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttaccttcggtggctcaccaatcagtgctcagtatgctaatttcactggctgcataagtaatgcct

SEQ ID NO: 9298 - DNA, 349 bp, Homo sapiens
gaaaaagctggagctcgcgcgcctgcaggtcgacactagtggatccaaagaattcggcacgagctcgtgccgaattcggcacgagcaggtttgcatgagagtatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggcccccctggtgctcttggtttgagggggacctaaaggtgacttgggagaaaaggggggagcgtggcccttccaggaagaaggtcc

SEQ ID NO: 9299 - DNA, 100 bp, Homo sapiens
  misc_feature 97: n = A,T,C or G
gacaaaagctggagctcgcgcgccctgcaggtcgacactagtggatccaaagaattcggcacgaggagttttttttttatgattcatttgccaggtntta

SEQ ID NO: 9300 - DNA, 299 bp, Homo sapiens
  misc_feature 16, 65, 113, 274: n = A,T,C or G
ataagctggagctcgngcgcctgcaggtcgacactagtggatccaaagaattcggcacgaggccntccagactgaggaagacccggaaacttaggggccacgtgagccacggncacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaantgtcaaccttgacaaattgtggact

SEQ ID NO: 9301 - DNA, 210 bp, Homo sapiens
  misc_feature 65: n = A,T,C or G
gaaaaagctggagctcgcgcgccctgcaggtcgacactagtggatccaaagattcggcacgaggngaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgt

SEQ ID NO: 9302 - DNA, 400 bp, Homo sapiens
  misc_feature 379, 383: n = A,T,C or G
gaaaaagctggagctcgcgcgcctgcaggtcgacactagtggatccaaagaattcggcacgagccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctacttttgggaaagttggtatgaagcattaccacttaaagaggaaccaggagcttctgcccaactgtcaaccttgacaaattgtgggactttggtcagtgaacagacacgggtgaatgctgctaaaaacaagactggggctgctcccatcattgatgngggngcgatcggggctactac

SEQ ID NO: 9303 - DNA, 318 bp, Homo sapiens
  misc_feature 222, 289: n = A,T,C or G
gaaaaagctggagctcgcgcgcctgcaggtcgacactagtggatccaaagaattcggcacgagcggcacgagacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgngggctccaagcagatgcagcagatccgcatgtcccttcgcgggaaggctgtggtgctgatgggcaanaacaccatgatgcgcaaggccatccgagg

SEQ ID NO: 9304 - DNA, 393 bp, Homo sapiens
  misc_feature 117, 383: n = A,T,C or G
gaaaaagctggagctcgcgcgcctgcaggtcgacactagtggatcaaagaattcggcacgagccgtgctggtgccattgccccatgtgaagtcactgtgccagcccagaacactggnctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggcatccagcaggtgttcgacaatggcagcatctacaaccctgaagtgcttgatatcacagaggaaactctgcattctcgcttcctggagggngtccgcaatg

SEQ ID NO: 9305 - DNA, 352 bp, Homo sapiens
  misc_feature 269, 295, 301: n = A,T,C or G
gaacaaaagctggagctcgcgcgcctgcaggtcgacactagtggatccaaagaattcggcacgagattcgggaccagcctggccagcgtggtgaaaccccatctctgctgaaaacacaaagggtagccgggtgtggtggtgagcacctgtaatcccagctacttgggaggctgaggcaggagaattgcttgaacccacaggaggcggagcttgcagtgagcagagatcgcaccacggcactccagcctgggcaagagagcgagactcantctcaataaataaataaataaataantaaaantctttacaagtaggagattttactgtaggcaaaatagttggcccaaccctg

SEQ ID NO: 9306 - DNA, 357 bp, Homo sapiens
  misc_feature 3, 152, 207: n = A,T,C or G
ganaataagctggagctcgcgcgcctgcaggtcgacactagtggatccaaagaattcggcacgagcggcacgagcttcgggagccgcggcttatggtgcagacatggccaagtccaagaaccacaccacacacaaccagtcccgaaaatggnacagaaatggtatcaagaaaccccgatcacaaagatacgaatctcttaagggggnggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagat

SEQ ID NO: 9307 - DNA, 178 bp, Homo sapiens
ataagctggagctcgcgcgcctgcaggtcgacactagtggatccaaagaattcggacgagcggcacgagagtacttctagagcggccgcgggcccatcgattttccacccgggtggggtaccaggtaagtgtacccaattcgccctatagtgagtcgtattacaattcactggccgaa

SEQ ID NO: 9308 - DNA, 400 bp, Homo sapiens
  misc_feature 218, 279: n = A,T,C or G
aaagctggagctcgcgcgcctgcaggtcgacactagtggatccaaagaattcggcacgaggaaagttcagtaaagacctaaaaggaaaagcatcctaccacaccacactcatgttgtatgtgcaactattatagtggcttagagacactagttcgtgttcttcgtttctatattagtaaagatgttagaggaaattaatctgtttgttgcgtcagggnttaatgtgaccatgttgtataactattctgaaaggtaagaagtttttcactggagtacagncactggctgagaacatttaagttttcttttgaagcatacacagttaacaactattgcaggaagaactctgaattaaatttcaggcccagagttttgatttaaactccaaacccttggaaaa

SEQ ID NO: 9309 - DNA, 230 bp, Homo sapiens
gaaaaagctggagctcgcgcgcctgcaggtcgacactagtggatccaaagaattcggcacgagggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatct

SEQ ID NO: 9310 - DNA, 400 bp, Homo sapiens
gacaaaagctggagctcgcgcgcctgcaggtcgcactagtggatccaaagattcggcacgagcttagttgttgatataactaggagttaatgtatcaattaagccaaggaaaaggcagcttgagctgaactgggaacaattaatgaaaatagtttacctttctgatattctatctagtccctgtcattaaaatgtatcaaacatttctggacttttaacaggatacaagaataaaagtgaaaataacctatacaaacacctatagaaaattaaagttattttcaagtataggaagaaaatatatttttagcaagacatccaacatcatctacttatctttctatggaagctatgcaaggatttaatttctttttacaaaatgttttcatagataactttg

SEQ ID NO: 9311 - DNA, 400 bp, Homo sapiens
gacaaaagctggagctcgcgcgcctgcaggtcgacactagtggatccaaagaattcggcacgaggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccact

SEQ ID NO: 9312 - DNA, 137 bp, Homo sapiens
  misc_feature 3, 103, 137: n = A,T,C or G
aanatcagcattttgtcatgtgattaatccccgggagaatgcatgtcatgctcacatgatgataggcaagtaaccacctttttctgtactcgtactactgcanttccagcctgggtgacagagtgagactctgtctn

SEQ ID NO: 9313 - DNA, 145 bp, Homo sapiens
  misc_feature 2, 4, 72: n = A,T,C or G
tngnagtactgctgcgagctcacactcatgcattgtcctctttttatttagattggcagcgtagggagttgngggtagtggggaagagggttaggagggtttcattgtctgtgaagtgagaccttccttttacttttcttctatt

SEQ ID NO: 9314 - DNA, 200 bp, Homo sapiens
taaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattg

SEQ ID NO: 9315 - DNA, 299 bp, Homo sapiens
  misc_feature 2, 8, 262, 292: n = A,T,C or G
tnaagacnttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggagctttgttccaagttaagtgttttcagaaaagtatgttttgcatgtatttttttacagtctaaattttgactgctgagaagnttctattgtacaaaacttcatttaaaaggnttttcta

SEQ ID NO: 9316 - DNA, 100 bp, Homo sapiens
  misc_feature 78, 93: n = A,T,C or G
aactgtaaactaactgttgtgagtcaaatgccccctgagtgactgcccccagcccaggccagaagacctcccttcagntgcccgggcgcaggnaacttgt

SEQ ID NO: 9317 - DNA, 212 bp, Homo sapiens
  misc_feature 13, 17, 28, 124, 156, 165, 199: n = A,T,C or G
tagcatgagcaangggncagcgtttganataccgacgtaggctttcctacaatacagcctctaacaaaactaggctgtcccgaacccctggtaatagaattgtttacctttataccaagaaggntgggaaagcaccaaaatctgcatgtggagtgngcccaggcngacttcgaggggttcgtgctgtaagacctaaagntcttatgagattg

SEQ ID NO: 9318 - DNA, 150 bp, Homo sapiens
  misc_feature 7, 72, 96, 103, 112, 144: n = A,T,C or G
acgtctnaagtatgttattttttacaactaattttgtactctcagaatgtttgtcatatgcttcttgaatgnataattttttaatctcaaacgctncaataanaccattttncagatataaagagaattacttcaaattcaganattcag

SEQ ID NO: 9319 - DNA, 100 bp, Homo sapiens
  misc_feature 2, 5, 60, 84, 88: n = A,T,C or G
tnganttagaatctgtttccttaaaaattgatttgactcctgttcttaaacacaagtggnttttcctaattccagagaactggncgtnaccaaacaaggg

SEQ ID NO: 9320 - DNA, 226 bp, Homo sapiens
  misc_feature 3, 205: n = A,T,C or G
atntgctcgacgacttagcgtcaagacatttgctgaactcagcacattcgggaccaatatatagtgggtacatcaagtccatctgacaaaatggggcatgaagagaaaggactcagtgtgtgatccaggtttctttttgctcgcccctgttttttgtagaatctcttcatgcttgacatacctaccagtattattcccgacgacncatatacatattgagaatata

SEQ ID NO: 9321 - DNA, 196 bp, Homo sapiens
  misc_feature 13, 98, 132, 153, 168, 184: n = A,T,C or G
cgcaaaggatctncttcatcccctctccagaagaggagaagaggaaacacaagaagaaacgcctggtgcaagagccccaattcctacttcatggatgngaaatgcccaggatgctataaaatcaccacggtntttagccatgcacaaacggtngtttttgtgtgttgnctgctccactgtcctntgccagcgtaca

SEQ ID NO: 9322 - DNA, 220 bp, Homo sapiens
  misc_feature 11, 26, 27, 37, 43, 48, 52, 61, 62, 121, 141, 158, 159: n = A,T,C or G
acctgcacgcngcccgacactagagnngacaaagcantgcggncgagnacangtcgcactnntctcccctctctttctaagagacctgaactgggcagactgctaaataaaatctcggggntctatttatttattgggttnctgtaagaccttcgggnnaagggagaggcaggaaactaactggggcgagtcaaatgccccctgagtgactgcccccagc

SEQ ID NO: 9323 - DNA, 279 bp, Homo sapiens
  misc_feature 4, 15, 40, 42, 105, 127, 145, 180, 214, 216, 231, 269: n = A,T,C or G
tagntggccccagcngatggcttctctgatcttgccatgnangaatgacgtctccatctaagaactacattctctctgtgatcagtgggagcatctgtatattgntcctgattggcctgatgtgtgnctggatcaccaagcgagngacacgagagctcaaggacaggctacaatacaggncagagacaatggcttataaaggtttagtgtgggntnaggatgtgacaggcngtccagcctgacctttctgcacactccagacaaacttnccagacaagc

SEQ ID NO: 9324 - DNA, 400 bp, Homo sapiens
  misc_feature 4, 67, 71: n = A,T,C or G
cttntttagggaaaaacccctgttttttggcgcgcctgaaggcccgacactagtggatccaaagtantttngcacgagcgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggt

SEQ ID NO: 9325 - DNA, 400 bp, Homo sapiens
  misc_feature 8, 25, 29, 35, 36, 47, 89, 321: n = A,T,C or G
acttcttngggaaaaaacccccttntttngggcgnncatgaagcccngacactagtggatccaaagtttttggcacgagcttaaccttngttgcctttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcangccgcttactctgttggggtctatataaatttgttgaactcttacctacattccaaagaagtttcaaggaaccataaat

SEQ ID NO: 9326 - DNA, 400 bp, Homo sapiens
  misc_feature 6, 8, 42, 51, 197: n = A,T,C or G
tacttngngcgcataaaaaccccacactagtggatccaaagnattttttcncgagcattactgcaggaaaaccccccggagagctgagcagtcaagatgtgtgacttcaccgaagaccagaccgcagagttcaaggaggccttccagctgtttgaccgaacaggtgatggcaagatcctgtacagccagtgtggggntgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatg

SEQ ID NO: 9327 - DNA, 100 bp, Homo sapiens
  misc_feature 2, 11, 12, 14, 16, 27, 29, 64, 67, 78: n = A,T,C or G
gnaaaaacccnnantngggggcgcaanangccgacactagtggatccaaagttttgggcgaggnttngagaaaaaccncttgcttccaacttaggctttt

SEQ ID NO: 9328 - DNA, 133 bp, Homo sapiens
  misc_feature 33, 36, 62, 77, 92, 93: n = A,T,C or G
cttcttagggaaaaaccctttttttggtgcgcntgnaggccgacactagtggatccaaaganttttgcacgagcttntctcccttcacgcanngtgaatgagggcggcatctgatccgcttctcagggggctg

SEQ ID NO: 9329 - DNA, 323 bp, Homo sapiens
gttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcat

SEQ ID NO: 9330 - DNA, 395 bp, Homo sapiens
  misc_feature 33, 63: n = A,T,C or G
ctttgggaaaaaccctgtttttggcgcgcctgnaggccgacactagtggatccaaagaatttngcacgagcgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggt

SEQ ID NO: 9331 - DNA, 298 bp, Homo sapiens
gagcatccctggctacaaacgtatttgaaaccaaaagggaaaagaaaacgcaggcagccagcagttgctacagaaacgtgattttcaaagcatctgcatcacccgcaacctcatggaagcctcggtttggtttacaaaggagcgagtggtcggaaagacgatttgaccactttgtattcgtatgattcattcggagcagaagtttaaaactccatgaaacacttgccccgtggtgggcaccggtggaatggggcttcactgggggcttttgaaagcaaaggctggtttaacaaaagtt

SEQ ID NO: 9332 - DNA, 295 bp, Homo sapiens
gactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgcctgctaaaaacaagactggggctgctcccatcattg

SEQ ID NO: 9333 - DNA, 317 bp, Homo sapiens
caaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagg

SEQ ID NO: 9334 - DNA, 336 bp, Homo sapiens
ctttgtctgagccattcctttattctcacgaaaacttatcagatgaccttgatcccagggttcagcttccttgatcacctgcaaagatgaggatgaagtcattccttggaatcttgcagagattaaccatctttgacaccaatcctcttcttaaacggaccaaagcaatactataaaatgaaggatgctgggccatcaacatagatgacctcatagaggccacaagatccattctcttcctatgtgctgtcttttttttgtttttgttttaagagatggagtcttactatgttgtctaggcttgactcaaactgctgggctcaagcaatcctcctg

SEQ ID NO: 9335 - DNA, 393 bp, Homo sapiens
gtccttactgtccatgagaagggcagaggaggaaggagaaagtgtctaagtgaaatcaagagtcttgctttctcatctcagttctccccaagttcaggtgctgaggatggactggcttctcagaagcccagatttcattttcttcctcttcctcatctcccctctcctacccgggtgcctcctagatccaaaccacaaccccgtgtttgcctgaggtacacatagccagggcgatgatcggggtctctgagagaggcatgcccagacacccaacgcctacaagttcagctagtaaattcaggcgggctccgacaatactctcaggagcccaggaaaggcacaggcagactcttggggaggcatcctccctctctcgcctagggggaggaaggg

SEQ ID NO: 9336 - DNA, 350 bp, Homo sapiens
ttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctat

SEQ ID NO: 9337 - DNA, 398 bp, Homo sapiens
  misc_feature 28, 30, 40, 65, 79: n = A,T,C or G
ctttctaagggaaaaaacccctggtttntngcgcgcctgnaggccgacactagtggatccaaagnaatttggcacgagnaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaa

SEQ ID NO: 9338 - DNA, 389 bp, Homo sapiens
  misc_feature 17: n = A,T,C or G
cagaaaaaagccaggantgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaa

SEQ ID NO: 9339 - DNA, 299 bp, Homo sapiens
  misc_feature 32, 145, 251, 285: n = A,T,C or G
gagcagggttgccatggcaacagccatctcangcccacaagggggcagaggaggggctggcaaggccgaggcaggtggggaccaggcagtgggtgagcaggcactccaggcaggcaggccacagggacaaccgccacgcatgcgnccaccctctctcagaggccagtgtcagatcagcatcctggggccaacggggcaggctgggccctgtttttccactgacctgcccctaaatccactcgttctgtctnctatccacctgtccccttcctgcagggtgccganggtgaagacgggcc

SEQ ID NO: 9340 - DNA, 390 bp, Homo sapiens
gtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttg

SEQ ID NO: 9341 - DNA, 271 bp, Homo sapiens
  misc_feature 236, 255: n = A,T,C or G
tacagcactgagcccaataacttgaaggcccgcaattccttccgctacaacggactgattcaccgcaagactgtgggcgtggagccggcagccgacggcaaaggtgtcgtggtggtcatttaagcggagatccggccagcggaagccttgccaccttcctatgtgcggaccaccatcaacaagaatgctcgcgccacgctcagcagcatcagacacatgatccgcaagaacaagtnccgccccgacctgcgcatnggaagccattccggag

SEQ ID NO: 9342 - DNA, 391 bp, Homo sapiens
  misc_feature 12: n = A,T,C or G
gattttactggncccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaa

SEQ ID NO: 9343 - DNA, 320 bp, Homo sapiens
aactagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggt

SEQ ID NO: 9344 - DNA, 398 bp, Homo sapiens
  misc_feature 6, 23, 28, 38, 63: n = A,T,C or G
cttctnagggaaaaacccctgtnttttngcgcgcctgnaggccgacactagtggatccaaagnaatttggcacgagcatctatatcctgaacatggtgcctagcattcggctggagctcagcgagtatttgttgaatgaatgaatcaatcccatttcgccttcttgccagctctggtctgggtggtcggtactttcctttttgagtactgcacggacccaggtttctggagtctggactcaatggcttatgtgggagcagcctcttccattctgcagtggggattactatccagagccaggtacaggccccagaggagggtgcactggggccacaggcccaaggccatccagttccctttgcccagctggggtcttgtggaagaagaaagccagtgtc

SEQ ID NO: 9345 - DNA, 151 bp, Homo sapiens
  misc_feature 7, 10, 53, 61, 65, 66, 72, 74, 75, 89, 94, 100, 107, 126,141: n = A,T,C or G
gcgcgcntgnaggccccgacactagtggatccaaagtattttggcacgagctnagttcgangatnnagaccncnnatcacctaatacanccatnactcanatgactntttgtgcgccttttatcanatgcatagcctatcnaaaacatcac

SEQ ID NO: 9346 - DNA, 392 bp, Homo sapiens
  misc_feature 16: n = A,T,C or G
tagactggcgccttgngggcaggagttatcgtattccttgttcataatgcatccaagtaatctggttaggggttaccagataatattagcagtatccattagattgttatgttggatcaaagaaaatatttcatgggattttgtttagaaaatctacccttatttatatatttctgtatatgaagtgtgttattctgtagaagaggttggggctacttgtaaaagtttggagaccgggagagctcaggacatggatcctttggccagcccttcaggtggccagtagtagtaatggctttttaactttttgcagtttggagtttaaaaggtaagcaagatgaggctgggcgccgtggcccacacctgtaatccacctgtaatccaccactttg

SEQ ID NO: 9347 - DNA, 370 bp, Homo sapiens
cttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcacttgatccaggcaggcagagcccaagatgccttgactctatgtgagggagttgctcagccgcacatcatctctgctacccaagatgt

SEQ ID NO: 9348 - DNA, 288 bp, Homo sapiens
gcgggatcgagattgcgggctatggcgccgaaggtttttcgtcagtactgggatatccccgatggcaccgattgccaccgaaaagcctacagcaccaccagtattgccagcgtcgctggcctgaccgccgctgcctacagagtcacactcaatcctccgggcaccttccttgaaggagtggctaaggttggacaatacacgttcactgcagcttgctgtcggggccgtgtttggcctcaccacctgcatcagcgcccatgtccgcgagaagcccgacgaccccctgaa

SEQ ID NO: 9349 - DNA, 168 bp, Homo sapiens
aaaaatacaaaaaaaattagccaggcgtggtggcaggtgcctgtagtcccagctacttgggaggctgaggtaggagaatggcgtaaacctgggaggcggagcttgcagtgagccgagatggagccactgcactccagcctgggggaaagagcgagactccgtctcaaa

SEQ ID NO: 9350 - DNA, 165 bp, Homo sapiens
aaaaatacaaaaaaaattagccaggcgtggtggcaggtgcctgtagtcccagctacttgggaggctgaggtaggagaatggcgtaaacctgggaggcggagcttgcagtgagccgagatggagccactgcactccagcctgggggaaagagcgagactccgtctc

SEQ ID NO: 9351 - DNA, 331 bp, Homo sapiens
gacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccc

SEQ ID NO: 9352 - DNA, 326 bp, Homo sapiens
gccatacagcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattac

SEQ ID NO: 9353 - DNA, 100 bp, Homo sapiens
  misc_feature 3, 24, 27, 29, 45, 46, 50, 60, 63, 68, 78, 86, 87, 92, 95,97: n = A,T,C or G
cancacgccagaacaggacagagngcngnatctcaaggtgccggnnaccngacaggaagntgncagtntgaacggtgnaaactggnnttccntgntntgt

SEQ ID NO: 9354 - DNA, 346 bp, Homo sapiens
cctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcaccttttggaagaaaacagccaaagttggcctaaaattggcgctgga

SEQ ID NO: 9355 - DNA, 320 bp, Homo sapiens
tcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttac

SEQ ID NO: 9356 - DNA, 203 bp, Homo sapiens
  misc_feature 155, 170, 172, 191: n = A,T,C or G
gttggttgggggcccgtcccgctcctaaggcaggaagatggtggccgcaaagaagacgaaaaagtcgctggagtcgatcaactctaggctccaactcgttatgaaaagtggaagtacgtcctggggtacaagcagactctgaagatgatcagacnaggcaaagcgaattngncattcttgctaacaactgnccagctttgagg

SEQ ID NO: 9357 - DNA, 322 bp, Homo sapiens
ggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagca

SEQ ID NO: 9358 - DNA, 336 bp, Homo sapiens
gccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttca

SEQ ID NO: 9359 - DNA, 352 bp, Homo sapiens
gtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggatt

SEQ ID NO: 9360 - DNA, 320 bp, Homo sapiens
cagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagcttgttgcagcatccagttcatcttaagaatgtcaacgattagtcatgc

SEQ ID NO: 9361 - DNA, 339 bp, Homo sapiens
atttctgatagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggat

SEQ ID NO: 9362 - DNA, 334 bp, Homo sapiens
  misc_feature 15: n = A,T,C or G
cacaagttaaagccntattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaaga

SEQ ID NO: 9363 - DNA, 279 bp, Homo sapiens
cggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgcttgccccacaaaaccaagcga

SEQ ID NO: 9364 - DNA, 329 bp, Homo sapiens
gtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgc

SEQ ID NO: 9365 - DNA, 226 bp, Homo sapiens
tcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggccctggaagaaggaggacttccagccccgggaggaggccatgctctaccacaaccagaccgccgag

SEQ ID NO: 9366 - DNA, 202 bp, Homo sapiens
  misc_feature 198: n = A,T,C or G
agaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaanaggc

SEQ ID NO: 9367 - DNA, 321 bp, Homo sapiens
  misc_feature 219, 248, 251, 264, 293: n = A,T,C or G
ctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgnacagatatctaagttaatttaaaggtgtntgngcctttttatttntgtttttaatgcttagatatttcaatgtnagcctcaatttctgaacaccataggtag

SEQ ID NO: 9368 - DNA, 141 bp, Homo sapiens
  misc_feature 44, 51, 115, 122, 125: n = A,T,C or G
ttcggcacgagcagccatggcggcgcgttcgcctccctcaccgnacccttngcccccagcgcgacagctgggccccaggtccccacgtgttgggcgggggagcttgaagtacacncaatgcncancgaggcctctggtttt

SEQ ID NO: 9369 - DNA, 337 bp, Homo sapiens
ctagcacggggcaatacagtatgtatgctgcaattcgatatgatacagtgccagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattggtttttgttgtctttatgatgcatgcga

SEQ ID NO: 9370 - DNA, 331 bp, Homo sapiens
acttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgaccctcgat

SEQ ID NO: 9371 - DNA, 277 bp, Homo sapiens
  misc_feature 18, 19, 239: n = A,T,C or G
atcaggtaagccaagatnngtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagntcctaagggcgcaacttacggcaagcctgtccatcatg

SEQ ID NO: 9372 - DNA, 400 bp, Homo sapiens
  misc_feature 24, 31, 41, 68, 71, 245, 277, 306, 315, 365, 378: n = A,T,C or G
cttcttggggaaaaaaccctgtcnttggggngcctgaaggnccgacactagtggatccaaagaaattnttncgagggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgnttaaaccactggatctatctaaatgccgattngagttcgcgacactatgtactgcgttttncattcttgnatttgactatttaatcctttctacttgtcgctaaatataattgttttagncttatggcatgangatagcatatgtgttcaggttt

SEQ ID NO: 9373 - DNA, 395 bp, Homo sapiens
  misc_feature 1, 149: n = A,T,C or G
naaatgcataaggcatggcgcctgttctcaagtttatagtctatatgaagaggcaagacttaaacacattagaaaagacagtttaaaatacagttatgtgctgcataatgacgtttcagtcagtgacagactgaatatatgatggtggncccataagattataatggagctaaaaagttcctattgcctattgatgtcattaccttttctatgtttagatatgggtatatatacatatgccattgtattacacaattatctatactattgagtgcattcacatgctgtacaggtttacagcctaggagcaacaggctataccatatagcctagatgtgtaggaggctataccatccaggtttgtgtaagtatattctatgatggtctcacaatga

SEQ ID NO: 9374 - DNA, 355 bp, Homo sapiens
  misc_feature 10, 17, 44, 111, 207, 322, 350: n = A,T,C or G
gggcgcctgnaggtccnacactagtggatccaaagaaattctgntcgagatttgggagtagtggccaggggccctggacgctagccacggagctgctgcacagagcctggngtccacaagcttccaggttggggttggagcctgggatgagccccggcagcgccttggcccttctgtggtccctgccagcctctgacctgggccggncagtcattgctggactctggccacacactggcgttctcatccacttggaaacaagccagtcttttctgcaaggtcagttgaccaagagcatatttcccctctgttgtacatcgtngttttgtgtttgggttgaaacagggggnggagg

SEQ ID NO: 9375 - DNA, 315 bp, Homo sapiens
  misc_feature 21, 149, 167, 241, 260, 265, 286: n = A,T,C or G
ccaaaatcaagtggggcgacnctggcgctgagtacgtcgtggagtccactggcgtcttcaccaccatggagaaggctggggctcatttgcaggggggagccaaaagggtcatcatctctgccccctctgctgatgcccccatgttcgtnatgggtgtgaaccatganaagtatgacaacagcctcaagatcatcagcaatgcctcctgcaccaccaactgcttagcacccctggccaaggncatccatgacaactttggnatcgnggaaggactcatgaccacagnccatgccatcactgccacccagaagactg

SEQ ID NO: 9376 - DNA, 340 bp, Homo sapiens
  misc_feature 6, 50, 96, 102, 123, 204, 219, 305, 318: n = A,T,C or G
cacccnacgtgtctttctttttctcccagcttcctggacaagatcgacgngatcaagcaggctgactatgtgccgagcgatcaggacctgcttcgntgccgngtcctgacttctggaatcttngagaccaagttccaggtggacaaagtcaacttccagtaagccaactgttacctttttatataacagagatcatggtttctngacattcaccccagnccctctggaataaccagctgtcctcctccccaccagcatgtttgacgtgggtggccagcgcgatgaacgccgcaagtggatccagngcttcaacgatgngactgccatcatcttcgtggtg

SEQ ID NO: 9377 - DNA, 391 bp, Homo sapiens
gggaactgtatatagagcagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcct

SEQ ID NO: 9378 - DNA, 397 bp, Homo sapiens
  misc_feature 6, 26, 34, 41, 66, 87: n = A,T,C or G
gggaanaaaacccctggtcccttggngcgcctgnaggtccnacactagtggatccaaagaattctntacgagcaggcgtgagccagngcacctggccagttctctgaatcttaacaaaaatctgtaacttgcccatttatctatttctttgtttattataccccttggtagaatacagtctcatggagactctgccatgtgcctagtgtctgctatacaatggccactaggtaaatatttgttgaataattgaactttttcccctcattttcaaaacaaggaccatacctgtgtctccaagtttactgaacattttgcggaccaattgaggtaatttagataaaaatgatttagagaaatttgccataatgcctaaaaatattatataattgtcaca

SEQ ID NO: 9379 - DNA, 395 bp, Homo sapiens
  misc_feature 14, 256: n = A,T,C or G
ggcaagatggcagngcaacctatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagngtagagctttatgctgaaaaggtggccactagaggtctgtgtgccattgcccaggcagagtctctgcgttacaaactcctaggagggcttgctgtgccggagggcctgctatggtgtgctgcggttcatcatggagagt

SEQ ID NO: 9380 - DNA, 395 bp, Homo sapiens
cagacaaatgcctgaaaccgagtaagctacacatcattttcaattttggctttgttttgaaatagacaatctttattgacagacagacatataataaatgcacatttcttaaccgtattttgacaaaaatgtagatcatttactgaaaaaataaacaatgtaggattaaacatatacttttcaggatagtgtctttgaataagggagctaaagcttctggttttcaaacatggctttccttggaaacatcagaatattttcttgggttcccctgtctggagttggttatctcataataaatatttgtaattttttatagctttccatttaagggaatgaattacctacttttgtacaaattgcatatttgttggaattttccaataatcacagtc

SEQ ID NO: 9381 - DNA, 395 bp, Homo sapiens
cttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacag

SEQ ID NO: 9382 - DNA, 196 bp, Homo sapiens
  misc_feature 142: n = A,T,C or G
ttcggcacgaggtcgcgtaggagggaggatggagagcggcgacgaagcggccatcgagaggcaccgcgtccacttgcgctccgccacattgcgcgacgccgtacccgccacactgcatctgctgccctgcgaggttgctggnggacggggcccgcccccgggggggcgcttttttcacgcccgccatccgccaggg

SEQ ID NO: 9383 - DNA, 317 bp, Homo sapiens
cccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatcc

SEQ ID NO: 9384 - DNA, 400 bp, Homo sapiens
  misc_feature 25, 30, 40, 44, 364: n = A,T,C or G
cttctaagggaaaaaacccctgtcntttgngcgcgcctgnaggnccgacactagtggatccaaagaattttgcacgaggtccttcgcccacttttctgatggggttgtttgtttttttcttgtcaatttgtttaagttcattgtagattctggatattagccctttgtcagatgagtaggatgcaaacattttctcccattctgtaggttgcctgttcactctgatggtagtttcttttgctgtgcagaagctctttagtttaattagatcctatttgtcaattttggcttttgttgccattgcttttggtgttttagacatgaagtccttgcccatgcctgtgtcctgaatggtaatgcctangttttctcctctttgtacctctggtagaattgccag

SEQ ID NO: 9385 - DNA, 311 bp, Homo sapiens
gaagttacttcaaatgtgaatgtttactttaaactccttaatcaaagaacagagagtagctgatttaattataaaaacttcaaacaataaatgctgtttataaggcactcactgtagatatgaagacttaggctgaaagtgaaaggatggaaaaagatactccatgcaaatagcaaccaaaggaaaaaggaggttagccctacttagacaaaataaactttaagtcaaaaactcacaagagacaaagaaggacattatataatgataaaaggatcagttctccaggaactcaaaacaagtctaaatatata

SEQ ID NO: 9386 - DNA, 400 bp, Homo sapiens
  misc_feature 7, 24, 29, 93: n = A,T,C or G
cttcttngggaaaaacccctgtcnttggngcgcctgaaggcccgacactagtggatccaaagaattttgcacgaggaaatccacaccttaaanggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttcca

SEQ ID NO: 9387 - DNA, 398 bp, Homo sapiens
  misc_feature 4, 7, 27, 29, 67, 91: n = A,T,C or G
cttntangggaaaaaccctgttttttngngcgcctgaaggccgacactagtggatccaaagaatttngcacgagaaaaggtttgagatggnagcgttcttgttagcagtcccttcctgcataaatggggttggagagagaggagagagggaatggccaagggtatggaaagctttcacaatgcatgccgagtgtgaagtgacacccccagcagatggggtttatcatctttacttagtcacacaacatcaaggactggttagttccagggaagggctccatttcattacctgggtcagttctcttcccccgcatgctccacaatgcagtagaaccaaacaacacattcatttacaatagaatgtttaaataacacctgtccaataactgcccttactt

SEQ ID NO: 9388 - DNA, 326 bp, Homo sapiens
ctggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgt

SEQ ID NO: 9389 - DNA, 294 bp, Homo sapiens
  misc_feature 67: n = A,T,C or G
ctttgggaaaaacccctgttttttggcgcgcctgaaggcccgacactagtggatccaaagaattttngcacgaggccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtg

SEQ ID NO: 9390 - DNA, 187 bp, Homo sapiens
  misc_feature 2, 56, 160, 162, 186: n = A,T,C or G
tnaaggtcccactagtggatccaaagaattcacgagcacaggcccaggctgatctnttccctgctcagaggtctttccagtccagatcgccaagctgcgtccagtggctcctggaggagtcaagtgggtactgtggcctgcgcctggtagctggccgttngntgccaagtgaccttgccttgctgng

SEQ ID NO: 9391 - DNA, 400 bp, Homo sapiens
  misc_feature 48, 110, 309, 369: n = A,T,C or G
actagtggatccaaagattcggcacgagcgtgaaccagcaggagtttngtcagagctctggcaagccttcctcaaaaagtccgggaagctgaaagtccccgaatgggtgngataccgtcaagctgccaagcacaaagagcttgctccctacgatgagaactggttctacacgcgagctgcttcacagcgcggcacctgtacctccggggtggcgctggggttgctccatgaccaagatctatgggggacgtcaagagaaacggcgtcatgcccagccacttcagccgaggctccaagagtgtggcccgncgggtcctccaagccctggaggggctgaaaatggtggaaaaggaccaagatggcgggcgnaaactgacacctcaggacaaagagatctggc

SEQ ID NO: 9392 - DNA, 337 bp, Homo sapiens
  misc_feature 47: n = A,T,C or G
actagtggatccaaagaattcggcacgagcagtctccttatctgttnctttcattagactttgggcttcttgggtgggcctgtgtcctgaggacacttcttgtcttgcaaagagaagtccacacaggtttaatgacttccctagaggcctactctcttggcccagaataggcagattaatatttggtgctaaatgaataatgcgagtgaatcgtgcaaagatgggagccatcactgtgcctctctaggcacaagtaccacctgatgctgcacatccagatgcagctgtgtgagctctcgctgtgggattggatagtcgagagaaacaagcggggccg

SEQ ID NO: 9393 - DNA, 207 bp, Homo sapiens
  misc_feature 47, 91, 104, 119: n = A,T,C or G
actagtggatccaaagaattcggcacgagctggtgtgagtcaaattncccctgagtgactgcccccagcccaggccagaagacctcccttnaggtgccgggcgnaggaactgtgtgtgnctacacaaatggtgctattctgtggcaaacacctctgtattttttaaaacatcaattgatattaaaaatgaaaagattattggaaagt

SEQ ID NO: 9394 - DNA, 111 bp, Homo sapiens
  misc_feature 33, 35: n = A,T,C or G
gagcttgcccgatgtgatgaagccccaggactngngaagcaagtgccaatgaacaagccgtgcagtgaggacccccaagaggcccatttcccccaataaaagagatttggg

SEQ ID NO: 9395 - DNA, 398 bp, Homo sapiens
  misc_feature 4, 58, 367: n = A,T,C or G
tganggtccccactagtggatccaaagaattcggcacgagaacgaaagctgcgtcttncttgatttattctttaaaaataaagttccctgaatatttgatgcttttcttctaaacggaaatgattttacagttatctgagtgtaccttttatagttagtaagaaaatgattttaaagaatgtttaagtattgtacttaaatggtatgcagaggcacagatgtaaggtttataactggaaataggtggtaagaaaaatatatagaaagcacaatgatttgaatatttttccacttaggatttcctaatctccttgcatccaattcaagctcaagatgaagcacaattctttgatctccctttgccagntgaatttatagatcatctaatggtgagcaca

SEQ ID NO: 9396 - DNA, 398 bp, Homo sapiens
  misc_feature 56, 313, 349, 357: n = A,T,C or G
tgaaggtcccactagtggatccaaagaattcggcacgagctcgtgccgaattcggnacgaggcgaggcttgggggaggtgttgaaattctcatttacaggtcagatagagcagtgtaccgtcttttctgaggtgtttcttccagcgttgctcatccaggagtaccctttctgattgtaagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagntagcacagcgggcagcctcagtgaaactcttaaggntaagcagntaagtcctggacccagagctgctgggtatttcgagcggcag

SEQ ID NO: 9397 - DNA, 395 bp, Homo sapiens
  misc_feature 1, 3, 57, 363, 368: n = A,T,C or G
ntnaaggtccccactagtggatccaaagaattcggcacgagaacccaggcgctggantactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctcacccactgccagaagatctgtgaacccctggggggctattacccatggccttataattatcaaggctgccgtcggcctgcagagtcatcatgccatgtaagctggggggtggcccgtatcttgggcatggggtgaaatcacttcatatatcatgngctgnaaaataagaactagctgaagagacacc

SEQ ID NO: 9398 - DNA, 329 bp, Homo sapiens
  misc_feature 46, 74: n = A,T,C or G
actagtggatccaaagaattcggcacgagggattttaattgactgntttgtcctttgtcacagattacctcagngaaagctgtatgatgcaggcagagcctcttcggtgatctttggtctgaagggctatgtggctgagcggaagggtgagagggaggagatgcaggatgcccacgtcatcctgaacgacatcaccgaggagtgtaggcccccatcgccctcattactcgggtttcatattttgctgtttttgatggacatggaggaattcgagcctcaaaatttgctgccagaattgcatcaaaacttaatcagaaaatttcctaaag

SEQ ID NO: 9399 - DNA, 263 bp, Homo sapiens
  misc_feature 45, 47, 235: n = A,T,C or G
actagtggatccaaagaattcggcacgagctcgtgccgaattcgntncgaggctaggaaaggtttctcctatttggtaactggagtaactactgtgggtcgtcggcatatgctgccaagaatgccgtcacccagttcgtttccagcatgagtgcttctgctgatgtgttgccctggcgaaaatcgaaatcaagttatccgatattccagaaggcaagaacatggttttcaaatgnagagcaaacccctgtttgtgcgtcatag

SEQ ID NO: 9400 - DNA, 320 bp, Homo sapiens
  misc_feature 2, 6, 147: n = A,T,C or G
tnaagngcccactagtggatccaaagaattcggcacgagtggccccggaggccgttatcttagtcatggctctaaatatgtacctgcaatcggatgttgaggatcaccgagcccgcgacgtagaagtacgggaagttcatgcgcagntgccaggccagctcgaagaaggcgagcagggtgcgggagagccccttgcagaagacgccgtacgagtttctccagcatttggctctaggtgccaaggcacatgtgacaagaaggtgccagctttataaaccttggaacttcttctgtgcaagttctgagacatacaggttact

SEQ ID NO: 9401 - DNA, 397 bp, Homo sapiens
  misc_feature 4, 56, 58, 377: n = A,T,C or G
taanggtccccactagtggatccaaagaattcggcacgagccgacttcaccctctntnaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttggttgttttgttacctttgcaaatatttatgattatcacccccccacatactaaattggttttaaaagntttgcctttccttcagatac

SEQ ID NO: 9402 - DNA, 299 bp, Homo sapiens
actagtggatccaaagaattcggcacgagcagaagtagccaacgatctggacacggagaccctgcggaggctgaagcgggagtgtgggggcctgcagacgctgctccggaacagccaccaggtgttccaagttgtgaatgggagagttcacatccgcgactggcgagaggagacactgtggaagacaaagcaaccggaagcgaaacagagactgctctctgaagcctgcaaaacccgctctgctggttcttcatgcatcaccctgatggctgcgctctgccacggactgctgccgtttg

SEQ ID NO: 9403 - DNA, 400 bp, Homo sapiens
  misc_feature 46, 48, 296: n = A,T,C or G
cactagtggatccaaagaattcggcacgaggagaaatctgccattntntttcacatggaagatgctaaaggacaaattcaacgagtgcggccacgtgctgtacgccgacatcaagatggagaatgggaagtccaaggggtgtggtgtggttaagttcgagtcgccagaggtgccgagagagcctgccggatgatgaatggcatgaagctgagtggccgagagattgacgttcgaattgatagaaacgcttaagcagttgccttttttaaacatcgatacgagacctctgaatttgnattttttcttggtaaccattttaatttgtgggctggatgtataaagatgttaaaaaatcaagttgctttttggggaatttgaattactttttaatgactggggt

SEQ ID NO: 9404 - DNA, 358 bp, Homo sapiens
  misc_feature 2, 55, 57, 87, 88, 90, 128, 174, 201, 222, 226, 237, 335,351: n = A,T,C or G
tnaagggcccactagtggatccaaagaattcggcacgagggccagggaggagaantngggggatcaagaagggaaacccaattcccnngntgaaagtgggttctttgaactatgtgtttgggggaagntcctctggatactaatttgaatttatatacctcatgttttgggggnttgacgtatatatatatatatatatangcatatatatttcataatatntggnaggtttttgangctagaaaaatgggaaacaagagaaccttcaaaaatggacttagatgggaactggaggccaatctttcataaagccagccccatagctgcttgctgtnagcctccagccatttngacattg

SEQ ID NO: 9405 - DNA, 100 bp, Homo sapiens
  misc_feature 99: n = A,T,C or G
gaataatattacagtgaacatccataggaataatactatagtgaaccaccattatcactcaggttaaaaaatttttaatatttttagcaatctcatctnc

SEQ ID NO: 9406 - DNA, 400 bp, Homo sapiens
  misc_feature 36, 38: n = A,T,C or G
acccttagggaaaaaccctgtttttggcgcgcctgnangccgacactagtggatccaaagaattttgcacgaggcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtg

SEQ ID NO: 9407 - DNA, 146 bp, Homo sapiens
attccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttt

SEQ ID NO: 9408 - DNA, 314 bp, Homo sapiens
tgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 9409 - DNA, 400 bp, Homo sapiens
  misc_feature 3, 9, 38: n = A,T,C or G
atnttttanggaaaaaccctgttttttcgcgcgcctgnaggcccgacactagtggatccaaagaatttggcacgagcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtga

SEQ ID NO: 9410 - DNA, 328 bp, Homo sapiens
gttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgagccccagctaaggttgaagccaagg

SEQ ID NO: 9411 - DNA, 329 bp, Homo sapiens
  misc_feature 16: n = A,T,C or G
ggaccctgcagccgcngagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggc

SEQ ID NO: 9412 - DNA, 144 bp, Homo sapiens
tgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaac

SEQ ID NO: 9413 - DNA, 324 bp, Homo sapiens
attgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgcc

SEQ ID NO: 9414 - DNA, 322 bp, Homo sapiens
ccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtata

SEQ ID NO: 9415 - DNA, 324 bp, Homo sapiens
  misc_feature 193, 200, 240, 248, 313: n = A,T,C or G
gatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggggcttgtgaaggatcccaatnggcaccnttttccccacgggggttttccaaccttttttgtcttgggnagtggcantaaaccttggattttcccctgcccaggggaaaggggcattcgacttactgttgctgaagagaganataagaagctg

SEQ ID NO: 9416 - DNA, 348 bp, Homo sapiens
tgaaggttggcctgacaaattatgctgcagcatattgtcctggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatg

SEQ ID NO: 9417 - DNA, 320 bp, Homo sapiens
  misc_feature 11, 26, 41, 45, 72: n = A,T,C or G
actttctatanggaaaaacccctgtnttttcgcgcgcctgnaggnccgacactagtggatccaaagaatttngcacgagcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgccc

SEQ ID NO: 9418 - DNA, 323 bp, Homo sapiens
atgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggt

SEQ ID NO: 9419 - DNA, 323 bp, Homo sapiens
ctcgtgccgtgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcattggtttg

SEQ ID NO: 9420 - DNA, 325 bp, Homo sapiens
gtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggtttgtgggcattgtgggctacgtggaaacccctcgaggcctccggaccttcaagactgtctttgctgagca

SEQ ID NO: 9421 - DNA, 199 bp, Homo sapiens
  misc_feature 10, 11, 38, 40, 59: n = A,T,C or G
gcgcctgaanncccgacactagtggatccaaagtaatntngcacgagcaatgtttcctncaagcaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 9422 - DNA, 357 bp, Homo sapiens
  misc_feature 14, 38, 39, 40, 42, 47, 62, 69, 88, 89, 188, 192, 193, 353: n = A,T,C or G
ggagaataaaaacnccgagactagtggatccaaagtannntntgggngagcggaggtgcaanaaacccntgcttgatggtcgaggccnnctcctgggccgcctggcggccatcgtggctaaacaggtactgctgggccggaaggtggtggtcgtacgctgtgaaggcatcaacatttctggcaatttntatnnaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctnaagg

SEQ ID NO: 9423 - DNA, 320 bp, Homo sapiens
ctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtac

SEQ ID NO: 9424 - DNA, 242 bp, Homo sapiens
  misc_feature 32, 43, 59, 82, 155, 172, 234: n = A,T,C or G
attttttttttttactttttccaggggtattnaaaataatagngcattttatcacctgnggcaccttaaatttctgcaagtngggctataccctatcttacatatgaggcctggagaggttaggaaacctgcctaaggccacacagccactattnggacttgaaacaaaggngtatctggctctcagtccctggctttcaggggggactagagctggggggccccatccttgcnggggaagg

SEQ ID NO: 9425 - DNA, 343 bp, Homo sapiens
aatgaaactgggagaggtggttgtcagtgtcagcaagtgctccatctatctgacgtagaatacagcttcatttcaccttggaatgcaagaattgggttacttctaccatattataacataaaaaataataataaagctgttattgctgtggcattaacattcctctaaaacttagaatcctggattaatctgtacaactagaactaccttattcagttactgtggctattgagatcaaggcactgttgattggtggtgacctttgtataaatagctaaggacattgcagaggatgctgtctgtgtgctgtaggcatagacatgggtgatcatttgggagattt

SEQ ID NO: 9426 - DNA, 110 bp, Homo sapiens
  misc_feature 15, 22, 30, 31, 33, 34, 36, 58, 65, 81, 99: n = A,T,C or G
aaaaaccccgagacnagggganccaagtannanngngggggagtttttttaaaaaacnccggccnctctcaaggatgaggntttgaagattatgccagngcagaagcaga

SEQ ID NO: 9427 - DNA, 102 bp, Homo sapiens
  misc_feature 8, 27, 45, 67, 97: n = A,T,C or G
cttctatnggggaaaaaacccctgtcntttggcgcgcctgcaggnccgacactagtggatccaaagnaatttggcacgagctcgagttttttttttnttttt

SEQ ID NO: 9428 - DNA, 400 bp, Homo sapiens
  misc_feature 23, 28, 42, 64, 70: n = A,T,C or G
cttcttagggaaaaacccctgtnttttngcgcgcctgcaggnccgacactagtggatccaaagnaatttngcacgagtgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatt

SEQ ID NO: 9429 - DNA, 400 bp, Homo sapiens
  misc_feature 2, 17: n = A,T,C or G
cnttttggcgcgcctgnaggccgacactagtggatccaaagtattttggcacgagcaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcccactgtaaagctaacttagcattaaccttttaagttaaagattaagagaacc

SEQ ID NO: 9430 - DNA, 341 bp, Homo sapiens
cagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataacttt

SEQ ID NO: 9431 - DNA, 313 bp, Homo sapiens
ggagtgcattggcacgaacatggctcactgcagccttgacctcctgggttcaagcagtcctcctgcctcagcctcccaagtagttgcaggcgtgtaccaccacacagggctaatttttaaaccttaaatttttttatagagacgaggtttcaccgtgttgcccaggctggtcttcaactcctgaactcaagtgatctgcctgccttggcctcccaaagtgttgggattacaaatgtgagccaccgtgcccagccttgggcaccattttttaataatcaaaaaagcaatcaacactttaaaaattctaattttt

SEQ ID NO: 9432 - DNA, 398 bp, Homo sapiens
  misc_feature 23, 24, 29, 67: n = A,T,C or G
cttcttagggaaaaacccctgtnnttggngcgcctgcaggccgacactagtggatccaaagaatttngcacgaggtaagacggccgcaaagcaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctg

SEQ ID NO: 9433 - DNA, 225 bp, Homo sapiens
  misc_feature 22, 23, 68, 91: n = A,T,C or G
cttcttagggaaaaaccctgtnntttggcgcgcctgaaggccgacactagtggatccaaagtaatttngcacgaggtggtgttcgctatcncttgtgtcaaatctggtgaacgctacgcttacatatattgtctttgtgctgctgtgtgacaaacgcaatgcaaaaacaatcctctttctctctcttaatgcatgatacagaataataataagaatttcatcttt

SEQ ID NO: 9434 - DNA, 398 bp, Homo sapiens
  misc_feature 23, 29: n = A,T,C or G
ctttcttggggaaaaaaaccctncctttngcgcgcctgaaggcccgacactagtggatccaaagtaatttggcacgagccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttc

SEQ ID NO: 9435 - DNA, 251 bp, Homo sapiens
gatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacag

SEQ ID NO: 9436 - DNA, 238 bp, Homo sapiens
atcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatc

SEQ ID NO: 9437 - DNA, 332 bp, Homo sapiens
  misc_feature 98: n = A,T,C or G
ctgccgaggtgtccctgatgccaagattcgcatttttgacctggggcggaaaaaggcaaaagtggatgagtttccgctttgtggccacatggtgtcangatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggc

SEQ ID NO: 9438 - DNA, 400 bp, Homo sapiens
  misc_feature 24, 28, 63: n = A,T,C or G
cttcttagggaaaaacccctgttntttngcgcgcctgaaggccgacactagtggatccaaagnaatttggcacgagcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagacc

SEQ ID NO: 9439 - DNA, 362 bp, Homo sapiens
  misc_feature 25, 41: n = A,T,C or G
ctttcttggggaaaaaacccctttntttttggcgcgcctgnaggccgacactagtggatccaaagtaatttggcacgagtccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 9440 - DNA, 274 bp, Homo sapiens
cttagataatatatattaaaaaataaacctccaattcagggtataaaaacagagcgaaggcacttgggggtgggggtggaggggtggcccccacaggcaatactgagatggcccgggtcaccgtggtgccctccagaatggagccctgagtcccccaagcagagggcaggagggagagatggccgaggctcatgcggggccagtaaccccagctgggcccctcccaggcgtggcccacagctccctctcctcaggccctcggggtgtgagatgc

SEQ ID NO: 9441 - DNA, 211 bp, Homo sapiens
  misc_feature 2, 23, 30, 66: n = A,T,C or G
cntactaagggaaaaaacccctncacttgngtgcgcctgaaggcccgacactagtggatccaaagnaattttgcacgaggctttgttcgccaccccaattacttgggtgatctcatcatggccttggcgtggtccctcccatgtggttttaaccacattctgccttatttctacataatttatttcaccatgttgcttgtccaccgagaag

SEQ ID NO: 9442 - DNA, 310 bp, Homo sapiens
gccagtagccagagacgagtgacagataataaattgggaaaggaagtattggtttccagtcttgtttccaatctgcttcattccacacttcagctttataagcataacttgtctccaaattttgtaagtatgtgtaacactgcttgcattactttaagcactgcttaaagctttcatcattgttttttctgaaaaaaagctgttagggactgaatgtttgtgtcattacccgaactcatatattgaagccctaattcccagtgtgacagtatttggagataggatctttgggaggtatctaaggtaagat

SEQ ID NO: 9443 - DNA, 100 bp, Homo sapiens
  misc_feature 8, 23, 42, 69, 92, 97, 98: n = A,T,C or G
cttcttanggaacaaaccctgtnttttcgcgcgcctgcaggnccgacactagtggatccaaagaatttngcacgaggaacgaattgtaatgnaatgnnat

SEQ ID NO: 9444 - DNA, 289 bp, Homo sapiens
  misc_feature 1, 3, 26, 62, 68, 69, 74, 256, 274: n = A,T,C or G
ngngggaaaaaaccctgtttttgggngagcatgaaggcccgacactagtggatccaaagtantttggnncgagnatagaattgagtcaatcggaaagactatccaacttaacatgaaacttgtcaccatgagatagcattagctgcccaggatgctgctatatatatatatatatatatatatgtgtgtgtgtgtgtgtatatatatatatatatatatatatatatatatatatatatgtgtgtgtgtgtgtgtntatatatatatatgtgtntatatatatatatat

SEQ ID NO: 9445 - DNA, 324 bp, Homo sapiens
gggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccat

SEQ ID NO: 9446 - DNA, 330 bp, Homo sapiens
  misc_feature 330: n = A,T,C or G
atcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggn

SEQ ID NO: 9447 - DNA, 400 bp, Homo sapiens
  misc_feature 2, 15, 40, 47, 93: n = A,T,C or G
tnttggcgcgcctgnaggccgacactagtggatccaaagnaattttngcacgaggggcagaggaagcttccgaaagctgccaaggcaccatcnccaggaactcccagcacgcagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactcc

SEQ ID NO: 9448 - DNA, 400 bp, Homo sapiens
  misc_feature 9, 32, 35, 48: n = A,T,C or G
ctttctttngggaaaaaaaccccctttttttntgngcgcgcctgaagncccgacactagtggatccaaagtttttggcacgagctcctcccgttccccacccccttcctcccccccagccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacga

SEQ ID NO: 9449 - DNA, 315 bp, Homo sapiens
gggtgaccttccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtgg

SEQ ID NO: 9450 - DNA, 227 bp, Homo sapiens
  misc_feature 14: n = A,T,C or G
gacctttgatcctntgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttt

SEQ ID NO: 9451 - DNA, 136 bp, Homo sapiens
  misc_feature 21: n = A,T,C or G
cttggggaaaaaacccctttnttttggcgcgcctgaaggcccgacactagtggatccaaagtatttggcacgagagcacatgtgctgccctacagcaccctgtggtcttcctcgataaagggaaccactttcttat

SEQ ID NO: 9452 - DNA, 400 bp, Homo sapiens
  misc_feature 13, 26, 29, 33, 43, 69, 100: n = A,T,C or G
ctttctattgggnaaaaaaacccctnccntttngcgcgcctgnaggcccgacactagtggatccaaagnaattttggcacgagttaacatactaggttgntgcaaaagtaatgtaaaaccacaattacttttacatcaaccgaatactcaaaactctcgaattgtatgctttgactgtgtataattgaagtgtatgttatgtgaattataattcaagacagttgtgacaaaaaaatttgatgtttatttgctttaaaataaaatttcattttaaaaaaaaaatatgaaagagaataggcctatggaaaagtccttctgcaaacagcaggcatgcagcactccctgcaattccaggagggcgcagtgtatttcctttcctgaagcctgtgcttaccttgtc

SEQ ID NO: 9453 - DNA, 325 bp, Homo sapiens
  misc_feature 16: n = A,T,C or G
atcacaagcctgtggngcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcg

SEQ ID NO: 9454 - DNA, 400 bp, Homo sapiens
  misc_feature 21, 26, 67, 91: n = A,T,C or G
cttcttagggaaaaacccttnttttngcgcgcctgaaggccgacactagtggatccaaagtaatttngcacgaggacactgcagggattgncacctggggatagtcttcaagaatagcagccaggcacggtggctcgcgcctgtaatcccccaactctttgggaggccaaggcaggtggatcacctgaggttgggaggtcgagaccagcctggccaacatagtgaaagcccatttgtactaaaaatacaaaaattagctgggtgtggtggtgcatgcctgtaatttcagctactcgggaggctgaggcaggataatcgcttgaacccaggaggcggaggttgcagtgagccaagatcatgccactgcactccagcctggacgatagagcaagactgtgtc

SEQ ID NO: 9455 - DNA, 322 bp, Homo sapiens
gtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattgga

SEQ ID NO: 9456 - DNA, 326 bp, Homo sapiens
gttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaat

SEQ ID NO: 9457 - DNA, 323 bp, Homo sapiens
ctcgtgccgcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactct

SEQ ID NO: 9458 - DNA, 400 bp, Homo sapiens
  misc_feature 2, 7: n = A,T,C or G
anggaanaaacccctgttttctcgcgcgcctgcaggccgacactagtggatccaaagtaatttggcacgaggctgagcccaaggcccaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccagga

SEQ ID NO: 9459 - DNA, 395 bp, Homo sapiens
  misc_feature 21, 22, 36, 63: n = A,T,C or G
cttcttagggaaaaacccttnntttggcgcgcctgnaggcccgacactagtggatccaaagantttggcacgagaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagctt

SEQ ID NO: 9460 - DNA, 400 bp, Homo sapiens
  misc_feature 6, 22: n = A,T,C or G
cttctnagggaaaaaacccctntttttggcgcgcctgaaggcccgacactagtggatccaaagtatttggcacgagccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttca

SEQ ID NO: 9461 - DNA, 355 bp, Homo sapiens
  misc_feature 1, 40, 42: n = A,T,C or G
nattatttaaaagctcagaaagatgaagagatttgccttncntatcttcctcgggattaccagaattcagaatcaggtctatggtagcaaagctttcggcctccccactatgcatcagtcacacctacagcccagatgttatcacagtactcacatttcttggcagttatgcaagttacaccttaagactttcattctgtactgcttaccaatattagaagggaaaaataaaaaggaaagaatgtcttttttccgtacatattattcacacatgttcatcctatcctccctattggaatgtgagttccaacatcctcaagtcttcccaccacaaataacataagttcaaaacaga

SEQ ID NO: 9462 - DNA, 400 bp, Homo sapiens
  misc_feature 4, 6, 48, 49, 52, 55, 71, 201: n = A,T,C or G
cccntnacttggggcgcataaaaccccgacactagtggatccaaagtnnttntgnacgagctcgtggtccnaagaccccatctgaagcgggtggcagctccaaagcattggatgctggataaattgaccggtgtgtttgctcctcgtccatccaccggtccccacaagttgagagagtgtctccccctcatcattttcctnaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtatta

SEQ ID NO: 9463 - DNA, 397 bp, Homo sapiens
  misc_feature 13, 16, 29, 33, 69, 76, 101: n = A,T,C or G
ctttctatagggnaanaaaacccctgtcntttngcgcgcctgcaggcccgacactagtggatccaaagnaattttngcacgagcctgaaggagttctttcnttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtactt

SEQ ID NO: 9464 - DNA, 279 bp, Homo sapiens
  misc_feature 222: n = A,T,C or G
actatgagaaattaagactgataaaaagaagtgataaaatgagatgtttatacaccagtataaaataatggtggattagaggttccatggtgattctttctaaatagcccattaaacatccatgaaaattacaggaaaagtagcaccataggcttatgcttaaaaaaaaaactcgagagtacttctagagcggccgcgggcccatcgattttccacccgggnggggtaccaggtaagtgtacccaattcgccctatagtgagtcgtattacaattcctg

SEQ ID NO: 9465 - DNA, 400 bp, Homo sapiens
  misc_feature 23, 62: n = A,T,C or G
cttctaagggaaaaaaccctgcntttggcgcgcctgaaggccgacactagtggatccaaagnaatttggcacgagaaaacccttattttttaaacttttctcatgacaaagggatggctggaacaattattccccatttgcaggtaaggacactggcatagtgagtgacagacctgagccttaggctaagtcctctggctccagattatttctttcatggtgttatactagaaattcacagcccttgactggtatctgtccagtctgaagagcttttctttaaaacactattttcctcagctgtattggtttgattgaaattaaatccccttcattcattcacataccttaatcaaacatctacttcctgtcaggaactgtgctgttggccctaggaggt

SEQ ID NO: 9466 - DNA, 317 bp, Homo sapiens
  misc_feature 7, 39, 41, 93, 94: n = A,T,C or G
ctttctntgggaaaaaacccctgtccttggcgcgcctgnangccgacactagtggatccaaagaattttgcacgagcttgtctcctccccgtnnccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcatt

SEQ ID NO: 9467 - DNA, 391 bp, Homo sapiens
  misc_feature 15, 16, 30: n = A,T,C or G
gggaaaaacccctgnntttggcgcgcctgnaggccgacactagtggatccaaagtatttggcacgaggagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattcttcatcatagctaagtaaat

SEQ ID NO: 9468 - DNA, 277 bp, Homo sapiens
  misc_feature 7, 37, 62, 68: n = A,T,C or G
cttcttngggaaaaaccctgttttttggcgcgcctgnaggccgacactagtggatccaaagnaatttngcacgagctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgt

SEQ ID NO: 9469 - DNA, 332 bp, Homo sapiens
  misc_feature 23, 33, 63: n = A,T,C or G
ctttgggaaaaaccctgtttttngcgcgcctgnaggccgacactagtggatccaaagaatttngcacgagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgc

SEQ ID NO: 9470 - DNA, 400 bp, Homo sapiens
  misc_feature 28, 38, 69, 93: n = A,T,C or G
cttcttagggaaaaacccctgttttttngcgcgcctgnaggcccgacactagtggatccaaagaatttngcacgagctcaaacccggtatggnggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagatt

SEQ ID NO: 9471 - DNA, 397 bp, Homo sapiens
  misc_feature 1, 11: n = A,T,C or G
ngcgcgcctgnaggcccgacactagtggatccaaagtaatttggcacgagggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataagga

SEQ ID NO: 9472 - DNA, 300 bp, Homo sapiens
atgttaacatcaataagttttaaaatttagcaataaaaattacattatttttgtggtagacaaaaatttaaaatttagcggagtaaacaaaactacaaaatttgcagtaaacaaaaatatcaaattcttcctaaaataagacacttatgaaatagaaatatgtttgaattgcttgggtgacatacacaattcatactttcctccaaatagctgaaatatatttactgagactgaaaactttggcattcagtgtagcaaaagaagggcatcctttaaaatacagtttctgtttgttgagtg

SEQ ID NO: 9473 - DNA, 400 bp, Homo sapiens
  misc_feature 7, 35, 65: n = A,T,C or G
cttttanggaaaaaccctgtttttcgcgcgcctgnaggccgacactagtggatccaaagaatttngcacgagtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgc

SEQ ID NO: 9474 - DNA, 349 bp, Homo sapiens
  misc_feature 2, 7: n = A,T,C or G
cnttttngggaaaaaccctgtttttggcgcgcctgcaggcccgacactagtggatccaaagaatttggcacgaggctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctcccctttcatactaataatcttat

SEQ ID NO: 9475 - DNA, 255 bp, Homo sapiens
  misc_feature 28, 38, 64, 78: n = A,T,C or G
cttcttagggaaaaacccctgttttttngcgcgcctgnaggcccgacactagtggatccaaagnaatttggcacgagnaaaaatatttcagaagaagaggttttaatacctgtctgtaagaatcaaacagggttaaaacaaaaaagggaaaaggaagtactgcatgaagaactttatgtattgcaggtcactgaatactgtattctttattgagctgggttttttgtttaagcatttttattttcctgcattggt

SEQ ID NO: 9476 - DNA, 168 bp, Homo sapiens
gtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 9477 - DNA, 400 bp, Homo sapiens
  misc_feature 24, 26, 71, 94, 95: n = A,T,C or G
cttactttgggaaaaaaccccttntntttggcgcgcctgaaacccgacactagtggatccaaagtattttngcacgaggaactcctgggctcanncaatccttccaccttggcctcccaagtaggaggattgcttgggattataggcgtgagccaccgtgcctggtctatatgaagtatttattcatcacctcaaactggttttactttgtacatgtttcaaggtgtcacttagagaaggaagtcacaagtaattggcccttcaggttttcaaatgactgactcatctatcatgggctgttgtttgtagaaaaaacattacatagtatagttattaaacatgagtccagcagtgacaatttattttgtgtcatactttaatacccctcatacagagtttt

SEQ ID NO: 9478 - DNA, 400 bp, Homo sapiens
  misc_feature 4, 5, 54: n = A,T,C or G
cccnntacttggggcgcctaaaaccccgacactagtggatccaaatttttttgnacgagggcccagaaaccagacccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtt

SEQ ID NO: 9479 - DNA, 396 bp, Homo sapiens
  misc_feature 16, 22, 27, 32, 88: n = A,T,C or G
agggaaaaaccctgtnttttgngtgcncctgnaggcccgacactagtggatccaaagaattttgcacgagtgatcacagaattagccngaggaataaaagggcttcaaacgcaagcctctctctaaagcccatgctgacaatctgaaaaacataaactgcaaaatataagaagtcttgtctccactgacattcttcctaaaaaaaatctcatttggggaatttcctgatcatacctcttaagcaaagctcatactattgacattgaacactagtacaaagtacttgatattccagatattgctgtttctttttacagaattttaactagtgtatattattaatatttgatacttacattctcaatacaggcaactagatgaaatactagggaggtc

SEQ ID NO: 9480 - DNA, 239 bp, Homo sapiens
aaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacat

SEQ ID NO: 9481 - DNA, 398 bp, Homo sapiens
  misc_feature 8, 35, 89: n = A,T,C or G
cttcttanggaaaaacccttttttcgcgcgcctgnaggccgacactagtggatccaaagtattttgcacgaggcaggatcaaggtgaanaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccagg

SEQ ID NO: 9482 - DNA, 398 bp, Homo sapiens
  misc_feature 18, 25, 35, 66: n = A,T,C or G
cttagggaaaaacccctntttttgngtgcgcctgnaggccgacactagtggatccaaagtattttngcacgagctcactgccacactcccaccagaaccatgacagtttacaaatgccatggcaatgtcaggaagttaccctatatgatctaaaaaggggaggcatgaataatccaccccttgtttagcatatcatcaagaaataaccataaaaatgggcaaccagcagctctcggggctgctctgtctatggagtagccattgttttattccttcactttcttaataaacttgttttcactttacagactcaccctgaattcatttttgtgcgagatccaagaaccctctcttggggtctggatgaggacctctttcctgtaacaaaaggataactt

SEQ ID NO: 9483 - DNA, 400 bp, Homo sapiens
  misc_feature 37, 52, 65, 71, 81, 89: n = A,T,C or G
attttaaaggaaaaaccccattctttggggcgttttnaaacccgacactagnggatccaaagttntttggncgaggttttngaaaaaanccccccgccaggcctttcccaataccaaccgctggttcctcacctgcattaaccagccccagttccgggctgtcttgggggaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcac

SEQ ID NO: 9484 - DNA, 284 bp, Homo sapiens
  misc_feature 2, 7, 62, 64, 68: n = A,T,C or G
cntcttngggaaaaaccctgttttttggcgcgcctgcaggccgacactagtggatccaaagnantttngcacgaggttgcacctcaaggaactagaaaaacaagaacaaactaagctcaaagttagtggaaggaaggaaatgataaatactagagtagaaataaatgaaatagagaccagaaaaaacatagataagatcaattaaaccgagatggtatttttaaaagataaaattgacaaacctttagctaaactaaataagaaaaaaaagagaaaactcaaat

SEQ ID NO: 9485 - DNA, 156 bp, Homo sapiens
  misc_feature 8, 19, 48, 51, 60, 61, 156: n = A,T,C or G
atatcttngggggcgtttnaaaccccgacactagtggatccaaagtanttngggggagcnntttaagaaaaaccccaggccaagaaggaggagatcatcaagactttatccaaggaggaagagaccaagaaataaaacctcccactttgtctgtgn

SEQ ID NO: 9486 - DNA, 216 bp, Homo sapiens
  misc_feature 125: n = A,T,C or G
aaacggcgtcatgcccagccacttcagccgaggctccaagagtgtggcccgccgggtcctccaagccctggaggggctgaaaatggtggaaaaggaccaagatggcggccgcaaactgacacctnagggacaaagagatctggacagaatcgccggacaggtggcagcttgccaacaagaagcattagaacaaaccatgctgggttaataaattgc

SEQ ID NO: 9487 - DNA, 326 bp, Homo sapiens
gacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccagg

SEQ ID NO: 9488 - DNA, 400 bp, Homo sapiens
  misc_feature 8, 9, 27, 65: n = A,T,C or G
ctttctannggaaaaaccccttttttntcgcgcgcctgcaggcccgacactagtggatccaaagnattttgcacgagcttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatgg

SEQ ID NO: 9489 - DNA, 308 bp, Homo sapiens
  misc_feature 256, 259: n = A,T,C or G
cggaagcggcggtgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactccctgcttcagaanaanaaattccacgggtactttcaagttccagggtcaggacaccattcctgga

SEQ ID NO: 9490 - DNA, 309 bp, Homo sapiens
cctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttt

SEQ ID NO: 9491 - DNA, 244 bp, Homo sapiens
ccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaa

SEQ ID NO: 9492 - DNA, 238 bp, Homo sapiens
cttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaaga

SEQ ID NO: 9493 - DNA, 355 bp, Homo sapiens
aataaactcacatacatgtactgttacagctgatcttagtatgaatattttctattaaagactgttttaaaataagttattaatatttgttgaaatggttccagataacaagaaatatgatgcaataaaacctgataaataaaagcaatataaagattagaatggttttgaataggtagtggaataaaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaa

SEQ ID NO: 9494 - DNA, 262 bp, Homo sapiens
catgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctg

SEQ ID NO: 9495 - DNA, 244 bp, Homo sapiens
ctgtgccatatttatggaggcactaaatggccacaaggaaatgacttccaagatgccaacatttgggcctatcaaaaacaaaggcagcttgctaccttatcgctgaatgataaaaagattttaatgctttgctcttaaatgtaaaagaacagcaagaattgttctttagtggtggaaagtctcaaccgtgaatgagagtaatcaacagacaaattgcaatgaacttgaaaaaaaaaaaaaaaaa

SEQ ID NO: 9496 - DNA, 132 bp, Homo sapiens
gtttcattcttattgcccaggctggagtgcagtggcgtgatctcagctcactccaacctctgcctcccgagttcaagcaatgcctcagcctcatgagtagctgggattacaggcgcgcgccgccacgcctgg

SEQ ID NO: 9497 - DNA, 228 bp, Homo sapiens
tgccactgcagtccagcctgggtggtggagggagaccttgtctcaaaaaaaaaaagtgcttcctattaaggaagatagtgagtggtgggggcagttggagggggttgtgtacataatgtatttgaaaactttcagttaaaaaaattttgaaaaactgtgcaaaatagtcaggaaaagagactttcccaaagtatttttctctgtctgccaccgtaattacttgaaagt

SEQ ID NO: 9498 - DNA, 220 bp, Homo sapiens
  misc_feature 8, 219: n = A,T,C or G
gcagctgngagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcang

SEQ ID NO: 9499 - DNA, 397 bp, Homo sapiens
  misc_feature 22, 28, 42, 64: n = A,T,C or G
cttcttagggaaaaacgcctgntttttngcgcgcctgcaggnccgacactagtggatccaaagnaatttggcacgagcccacctccaaatatctcatcaacaaccgactaatcaccacccaacaatgactaatcaaactaacctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttat

SEQ ID NO: 9500 - DNA, 194 bp, Homo sapiens
  misc_feature 123, 124: n = A,T,C or G
aaaacaagatacatgcataaaatggaatatcattgtctataaaaagggatgaaatgctgatacatgctaccatgtggatgaattctgaaaacattatactgagtataatccatccgttcattnntccatccatccatccatttatcacccattcatccatccacccatctattcatctatccatccatcatcca

SEQ ID NO: 9501 - DNA, 265 bp, Homo sapiens
ggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaagcgcattttggaggaccaggaggaaaacccgctgcccgccgccctg

SEQ ID NO: 9502 - DNA, 322 bp, Homo sapiens
tctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagaga

SEQ ID NO: 9503 - DNA, 351 bp, Homo sapiens
  misc_feature 118: n = A,T,C or G
gcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 9504 - DNA, 238 bp, Homo sapiens
  misc_feature 4, 18, 21, 96, 168: n = A,T,C or G
ctcnaggccatacgcttncgnacccagggttggaagcgaagaggcagggtacgtggtgtgtatttttagtgttcacacactgagaagggaggtggngagcaaacgcgtttgcagtgtgtgcgcgcacagctgtggagccaaattagattctgcctggaaatagcgagntggtgacaaatccaatctgtgtctaagctgtgtggaggggggaggtgtgaggaagtagaacacactcaga

SEQ ID NO: 9505 - DNA, 392 bp, Homo sapiens
gtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctcca

SEQ ID NO: 9506 - DNA, 300 bp, Homo sapiens
tgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagagg

SEQ ID NO: 9507 - DNA, 340 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctgg

SEQ ID NO: 9508 - DNA, 399 bp, Homo sapiens
  misc_feature 4, 29, 30, 31, 32, 54, 179: n = A,T,C or G
aaancccgacactagtggatccaaagtannnnttcacgagtagaagcttctgcnggcccctcgtgcaattgttgccattgaaaaccctgctgatgtcagtgttatatcctccaggaatactggccagagggctgtgctgaagtttgctgctgccactggagccactccaattgctggcngtttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtg

SEQ ID NO: 9509 - DNA, 318 bp, Homo sapiens
  misc_feature 18, 230, 284: n = A,T,C or G
ccatcaaccagataggcnagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtanctttaccattttagtgagggaagccagccccgggggtgggagggggtgtgtctngggtgtgcctattgagagcgtgtaatggcgtttg

SEQ ID NO: 9510 - DNA, 117 bp, Homo sapiens
  misc_feature 14, 18, 40, 56, 72, 73, 74, 76, 78, 81, 84, 87, 90, 91, 92,98, 99, 107, 115: n = A,T,C or G
tttcgcgcgcctgnaggnccgacactagtggatccaaagnaatttggcacgagganctcggacgcttgtgannngngnganaangantgnnntctttnnttaataanagaaatgntt

SEQ ID NO: 9511 - DNA, 388 bp, Homo sapiens
gcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctat

SEQ ID NO: 9512 - DNA, 356 bp, Homo sapiens
gttgctcagtgacgccactgtggagaaggatgagtcccatgcaggcaatgtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgccccctgccacatcagtgactgctttattcttttccaataaagaagtgcacgtgtcagaaaaaaaa

SEQ ID NO: 9513 - DNA, 179 bp, Homo sapiens
ggaggattgcttgggtccgggagttcaagaccagcctgcctaacatggggtggaacaagcctgtagtcccagatactcaggaggctgaggtgaaaggattgcttgagccagggaggtcaaggctgcagtgagccgtgaaaggccactgcactccagcctgggtgacagaatgagacctt

SEQ ID NO: 9514 - DNA, 398 bp, Homo sapiens
  misc_feature 4, 5, 47, 49, 79, 201: n = A,T,C or G
cctnntacttggcgcgcctgaaaccccgacactagtggatccaaagnantttttcacgagctcgtgccgaattcggccncgaggcaggaggcgccatcatgggagtggacatccgccataacaaggaccgaaaggttcggcgcaaggagcccaagagccaggatatctacctgaggctgttggtcaagttatacaggtttntggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccattaactgatgatgtgcgggttcaaggaggtacccaaactgaagg

SEQ ID NO: 9515 - DNA, 376 bp, Homo sapiens
cggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaa

SEQ ID NO: 9516 - DNA, 400 bp, Homo sapiens
  misc_feature 26, 40, 65: n = A,T,C or G
ctttcttagggaaaaaacccctgtcntttcgcgcgcctgnaggccgacactagtggatccaaagnaattttgcacgaggcccaagaagcaggccaaggagatggacgagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacattttaagaataaacttttgtaaaaaaagaaaaatcttacagtggc

SEQ ID NO: 9517 - DNA, 366 bp, Homo sapiens
gggggatgaagggatgcagtaacaactaactgtacaaagttacagttagaaaggacgaataagtcctggtgctctattgcacactagggtaactacagttagtaatgtgttgtatgtttcaaaattgctaaaagagaggattttgaatgttcccaccacaaataaataacaagtgtttcaggtgatatactaatgatcatgatttgatttacacaatgtatacattgtgtattgaatacaatacatgtattcaatacatgtattgaaatatcacactgcaactcatatatacatgtgcatttctatatacatgtgtgcatatatatttgtctatataactgatatgtatatataataattttatat

SEQ ID NO: 9518 - DNA, 331 bp, Homo sapiens
  misc_feature 151: n = A,T,C or G
gttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcangatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactata

SEQ ID NO: 9519 - DNA, 362 bp, Homo sapiens
gtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctg

SEQ ID NO: 9520 - DNA, 391 bp, Homo sapiens
attgttcaagacagcgtggtgattcctcaaagacctaaaaacagaaataccattcaactcagcaatcccattgctgggtatataccaaaggaatacaaaccgttctatcataaagacacatgcacatgttatgttcactgcagcactattcacaatagcaaagacaacgaatcaacctaattgcccatcagtggtagatggagtaaagaaaatgtggttcatatataccatgaaatactatgcagccataaaaggaacaagatcatgtcctttgcagtaacatggatggagctggaggccattatccttagtagaccagcaaaggaacggaaaactaaatgtcacatgttctcacttataagtgggagctgaatgatgagaacacatggat

SEQ ID NO: 9521 - DNA, 335 bp, Homo sapiens
cggcggtcgtgcggacgcaaacatgcagatctttgtgaacaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcacc

SEQ ID NO: 9522 - DNA, 159 bp, Homo sapiens
ctcgtgccgaattccgcacgagagggaggggagtgtcttctctctccaggtttcaccttccagtgtgcagaagttagaagggtctggcgggggcagtgccttacacatgcttgattcccacgctaccccctgccttgggaggtgtgtggaataaattat

SEQ ID NO: 9523 - DNA, 148 bp, Homo sapiens
  misc_feature 9, 79, 123, 136, 140: n = A,T,C or G
ctggacagnttaccagttgccttttatcccaaagttgttgtaacctgctgtgatacgatgcttcaagagaaaatgcggntataaaaaatggttcagaattaaacttttaattcattaaaaaanaaaaaaaaaaacncganagtttttt

SEQ ID NO: 9524 - DNA, 377 bp, Homo sapiens
ggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaaga

SEQ ID NO: 9525 - DNA, 369 bp, Homo sapiens
ctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatg

SEQ ID NO: 9526 - DNA, 329 bp, Homo sapiens
  misc_feature 16: n = A,T,C or G
gactaatactaccttnatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtgg

SEQ ID NO: 9527 - DNA, 350 bp, Homo sapiens
cttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgg

SEQ ID NO: 9528 - DNA, 392 bp, Homo sapiens
ccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttgga

SEQ ID NO: 9529 - DNA, 109 bp, Homo sapiens
tacttctagagcggccgcgggcccatcgattttccacccgggtggggtaccaggtaagtgtacccaattcgccctatagtgagtcgtattacaattcactgggccgtca

SEQ ID NO: 9530 - DNA, 400 bp, Homo sapiens
  misc_feature 6, 28, 38, 64, 70: n = A,T,C or G
cttctnagggaaaaacccctgttttttngcgcgcctgnaggcccgacactagtggatccaaagnaatttngcacgagtggccactgcgcagaccagacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctg

SEQ ID NO: 9531 - DNA, 399 bp, Homo sapiens
  misc_feature 3, 124, 153: n = A,T,C or G
ccncacgagggaacgtcagcctctccacggccatcgttgctgacctgggctcgcctctggcccgcagtcaaggcatgcctccgacctgctgttcatcttctgcttcctgccagagacgctgccnttggagaaacgggcgccctctatcgcccnggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccat

SEQ ID NO: 9532 - DNA, 393 bp, Homo sapiens
gctccatgggggcctgcggagggcagaccacacagctgcagcctggggagggcccagggtagaaacagcacagggaggggccgtggcattcatgctcgccctgtctttgagtctcattaatactgatcttttccagctatattcttttactggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccaca

SEQ ID NO: 9533 - DNA, 325 bp, Homo sapiens
  misc_feature 16: n = A,T,C or G
gcctgcccttgcccanatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccac

SEQ ID NO: 9534 - DNA, 393 bp, Homo sapiens
  misc_feature 17: n = A,T,C or G
tttgctttttcatagangcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcga

SEQ ID NO: 9535 - DNA, 391 bp, Homo sapiens
  misc_feature 14: n = A,T,C or G
gagctgggcagcancgctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaa

SEQ ID NO: 9536 - DNA, 400 bp, Homo sapiens
  misc_feature 9, 24, 28: n = A,T,C or G
ctttctaanggaaaaaacccctgntatntcgcgcgcctgcaggcccgacactagtggatccaaagaattttgcacgaggcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaac

SEQ ID NO: 9537 - DNA, 334 bp, Homo sapiens
  misc_feature 26: n = A,T,C or G
ttcttagggaaaaacccctttttttngcgcgcctgaaggcccgacactagtggatccaaagtaatttggcacgaggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaa

SEQ ID NO: 9538 - DNA, 323 bp, Homo sapiens
aaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttat

SEQ ID NO: 9539 - DNA, 398 bp, Homo sapiens
gaaattactggtgtgatgagagtatgaaacaggtaattttgcagttaacaacagtttcaggaaacttcctttctattattgtttatccttatgttagaagttggaaggtattgtactactgataaaaaccattatacaagttggaatgtgagctgcttgtacaaccagtatttcctcagaccacactagactgaaaattcaatagtagtttgaaaattatactgcagaactgtgagaatttagttaccttcagatccctcccaacaattataagcatttcctgttagaaaggcgtctcaaaatgctcccaagattaactccttgggattccagaagatagatagttacaatttaagtgtacacctcctctaccaagactcagatgcaagtccatagga

SEQ ID NO: 9540 - DNA, 399 bp, Homo sapiens
  misc_feature 40, 66, 90: n = A,T,C or G
ttcttagggaaaaaccctgttttttcgcgcgcctgcaggncgacactagtggatccaaagaatttngcacgagcttccggccgggccganaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgcca

SEQ ID NO: 9541 - DNA, 338 bp, Homo sapiens
accaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggaga

SEQ ID NO: 9542 - DNA, 189 bp, Homo sapiens
gccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcaga

SEQ ID NO: 9543 - DNA, 140 bp, Homo sapiens
ggcatgtttaattgtgatatttgacagacatccttgcagtttaagatgacacttttaaaataaattctctcctaatgatgacttgagccctgccactcaatgggagaatcagcagaacctgtaggatcttatttggaatt

SEQ ID NO: 9544 - DNA, 400 bp, Homo sapiens
  misc_feature 42: n = A,T,C or G
tcgcgcgcctgcaggccgacactagtggatccaaagaatttngcacgagtccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggcc

SEQ ID NO: 9545 - DNA, 400 bp, Homo sapiens
  misc_feature 6, 17, 31, 43, 70: n = A,T,C or G
cttctnagggaaaaacncctgttttttgcgngcgcctgcaggnccgacactagtggatccaaagaatttngcacgaggaacagactgctcctttcttgaccctgcccatgggggctttgtgacatatctctatcaggggaaccagcacccaatatttcaatgtaggttcttttctgttttccctaagtgttggccagtctgagaaataaagagaaagagtacaaaagaaataaattttacagctgggtctccggggtgacatcacatgtcagcaggttccacgatgcccccgagccgcaaaaccagcaagtttttattagcgattttcgaaggggagggagtgtacgaatagggtgtgggtcacagagatcacatgcttcaaaggcgataaaatatcaca

SEQ ID NO: 9546 - DNA, 310 bp, Homo sapiens
gccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaata

SEQ ID NO: 9547 - DNA, 395 bp, Homo sapiens
  misc_feature 145: n = A,T,C or G
ctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatnccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcat

SEQ ID NO: 9548 - DNA, 326 bp, Homo sapiens
ggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagcttggaagtgctgctgatgtgcaacaaatcttactgtgccgaga

SEQ ID NO: 9549 - DNA, 349 bp, Homo sapiens
ggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggcttgtacccgctgcggaagtacgccggtcaaggcctgaggggcg

SEQ ID NO: 9550 - DNA, 303 bp, Homo sapiens
gcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 9551 - DNA, 324 bp, Homo sapiens
  misc_feature 294: n = A,T,C or G
gtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggntttgatgaagatgaagtggcagcagaggaa

SEQ ID NO: 9552 - DNA, 293 bp, Homo sapiens
actgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgaaaaa

SEQ ID NO: 9553 - DNA, 328 bp, Homo sapiens
tcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagtttggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactg

SEQ ID NO: 9554 - DNA, 347 bp, Homo sapiens
acagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggccaag

SEQ ID NO: 9555 - DNA, 248 bp, Homo sapiens
gttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcaga

SEQ ID NO: 9556 - DNA, 338 bp, Homo sapiens
atgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacat

SEQ ID NO: 9557 - DNA, 335 bp, Homo sapiens
ctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcag

SEQ ID NO: 9558 - DNA, 340 bp, Homo sapiens
ggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcat

SEQ ID NO: 9559 - DNA, 324 bp, Homo sapiens
ggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaat

SEQ ID NO: 9560 - DNA, 332 bp, Homo sapiens
  misc_feature 13, 305, 311: n = A,T,C or G
cacatattaaganctgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaatttttttttttganactccncctcaaaaacaaaaagaaaga

SEQ ID NO: 9561 - DNA, 338 bp, Homo sapiens
caggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagatacc

SEQ ID NO: 9562 - DNA, 324 bp, Homo sapiens
cacatataaggaaacccccttcggactaacagcaactttctcagcttaaaccttacagatcgggagacagtgtaaattgatatattcaaagtgttaaaagcaaaaaacaattcatccaagaatactattcccagcaaagttttcccagacaagcaaaacttgagggaattcattcgcattagaacatccctacaacaaatgcataaagaagtccagattttacctctataagcaaaacaacaatatctaccatcacaaaaacacaagaataaaattcagtggcagagcagacacacaaatgagaaagagaaaggactcaagtgt

SEQ ID NO: 9563 - DNA, 352 bp, Homo sapiens
  misc_feature 348: n = A,T,C or G
ctttcaaggaggcggccgacacggagcggctcaccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtcccctcctgtccaagagccaggagcacgagcagcgcctggccgccctgcangggc

SEQ ID NO: 9564 - DNA, 165 bp, Homo sapiens
gaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatccc

SEQ ID NO: 9565 - DNA, 345 bp, Homo sapiens
  misc_feature 1: n = A,T,C or G
natcaggaatataggtttatttcattaaaaaataaaacaaaacaaaccagactcatcccccaaagagtactttatcctttaaagcagcagcaatcacaaggcacatatgtacaaaatacctcaagcaaaatagaaactgaacattcaaaaagtatgtgttgtttaaaaagatgttgaagaccatttgagtaataagcacaggttataaaaatcacaattttattcttctacctttaacaagagaaggaatgatggcataatatttatatgctatattgtggcacgtataacaaacctttacaccacataacctggtttgctaaagaaaaaacaggtaaagtactg

SEQ ID NO: 9566 - DNA, 336 bp, Homo sapiens
actgccagcatgcgaatgctgaacgtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttg

SEQ ID NO: 9567 - DNA, 329 bp, Homo sapiens
  misc_feature 13, 16, 58, 75: n = A,T,C or G
ggcacctgctgcntanggtggtatgctgaggcctgtgtgaaataatttatggcctgcnctgaacgatttctctcnttattaaatataataagggctcctaggaggctagccggtcccctgaaatggccagaaagtaattcccagcaggaagataagaagttttacactttttctttatccgggaagaagacacagatgaggggcagttggggttttcctctggctttgagcgtgagaatggtagctgaaaacggggaaggctggctcgccaagttacccccatgctactttcttggcaagtgttacgttttgggattagatttgaaagg

SEQ ID NO: 9568 - DNA, 332 bp, Homo sapiens
caatgcccctagtcacccaagtgttctgatggagatatacaaggagattaatgttgtttatgcagtaacacaacatccattctgtagcccatggatcaagttgtacttttgactttgaactcttattatttaagaaacacattttgtaaggctatagctgtcatatatagtgatttctctgatggatctggtcaaagtctgttaaaaaccttctggaaaggattcactattctagataccatttaagaacatttgtgattcatgagaagaggtcaaaatatcaaacaggagtttggaataagttgattccaaccctcatggatgactttgag

SEQ ID NO: 9569 - DNA, 324 bp, Homo sapiens
cctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctat

SEQ ID NO: 9570 - DNA, 372 bp, Homo sapiens
  misc_feature 16: n = A,T,C or G
agtggatccaatgtanttcggcacgagggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttct

SEQ ID NO: 9571 - DNA, 309 bp, Homo sapiens
aaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgaccttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcc

SEQ ID NO: 9572 - DNA, 341 bp, Homo sapiens
ggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaataga

SEQ ID NO: 9573 - DNA, 341 bp, Homo sapiens
ggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagc

SEQ ID NO: 9574 - DNA, 285 bp, Homo sapiens
cggcacgagctgtgacactctgataccctgacaaatgctcaactcctctgccaacctcagtttttctaaggtcaactctacagagaacagaaagagccagagatgtcgggaaaaaaatgagagaaattatggattaaaatataatctaaaataatcatggctgggcgcggtggctcgtgcctgtaatccagcactttgggaggccatttcaggcagatcatctgaggtcttgagtttgagaccagcctagccaacatggtgaaaccccgtctctactaaaaatac

SEQ ID NO: 9575 - DNA, 175 bp, Homo sapiens
gtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcac

SEQ ID NO: 9576 - DNA, 323 bp, Homo sapiens
  misc_feature 22: n = A,T,C or G
actagtggatccaaagaattcnttacgagctgacagctggtgcgcctgccccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctg

SEQ ID NO: 9577 - DNA, 344 bp, Homo sapiens
ccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaaga

SEQ ID NO: 9578 - DNA, 324 bp, Homo sapiens
ggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctc

SEQ ID NO: 9579 - DNA, 327 bp, Homo sapiens
gcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagg

SEQ ID NO: 9580 - DNA, 350 bp, Homo sapiens
gctttcctgtctttccttttttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgccccctccccaccagggcttcagcagga

SEQ ID NO: 9581 - DNA, 294 bp, Homo sapiens
aaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagcctt

SEQ ID NO: 9582 - DNA, 169 bp, Homo sapiens
cggcacgagctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaaca

SEQ ID NO: 9583 - DNA, 346 bp, Homo sapiens
gcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtatttttttaaattatt

SEQ ID NO: 9584 - DNA, 349 bp, Homo sapiens
tcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagacca

SEQ ID NO: 9585 - DNA, 232 bp, Homo sapiens
gttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctac

SEQ ID NO: 9586 - DNA, 352 bp, Homo sapiens
agaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgccggaagccagcggaaagcggagcgctacaagctggagcgcctag

SEQ ID NO: 9587 - DNA, 331 bp, Homo sapiens
cgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaag

SEQ ID NO: 9588 - DNA, 227 bp, Homo sapiens
cccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaaga

SEQ ID NO: 9589 - DNA, 273 bp, Homo sapiens
  misc_feature 145, 148, 191, 203, 248: n = A,T,C or G
ctaagagccagcggctgcagctgggtgcagagagaacctccggctttacttctgtctcgtctgccccaaccgctagcctcggcttgggtaaggcgaggcggaattaaaccccgctccgagagcggcagctttcgcgcgcggtgcnctnggcctatgcctgccccgaggggcgtttggtaggcaccccgccnttctcccgcagntcgacccccatgatagatacgctcagacccgtgcccttcgcgttnggaaatggcgatcagcaagacggtg

SEQ ID NO: 9590 - DNA, 107 bp, Homo sapiens
gtccactgcaatggcaaaaatatttccagttgcactgtatctctggaagtgatgcatgaattcgattggattgtgtcattttaaagtattaaaaccaaggaaacccc

SEQ ID NO: 9591 - DNA, 137 bp, Homo sapiens
gagcagttgaaaacagaacctcagaacttaacatctgtcctgatgttaaagtgcttttcatgaccaccctgttatctatgtatatgtaaagttaaggatgagatcttaagtttacaattaaaaactcagtactcaat

SEQ ID NO: 9592 - DNA, 332 bp, Homo sapiens
cggcacgagaaaaaacccaaacccttgtattcataggatatgtgaggcgttatatcagttccttatgtgggtttcccattcatactcattagaataatctgcactgggtatttttatttccattttacagatgaggaaccctaatatcagagaaggtaaacaaaacatgctgtcatagctacacaattgacatattttagaggcaggatttaaattcgatgtgatagaatgtcagtagctttgttctttgtattgaaccatccatatttgactgtgaccttctccctaaactgcttttctcaacatgtggagggatcaataatgaatgcatg

SEQ ID NO: 9593 - DNA, 306 bp, Homo sapiens
cgtggacactatacaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaag

SEQ ID NO: 9594 - DNA, 331 bp, Homo sapiens
tgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggg

SEQ ID NO: 9595 - DNA, 207 bp, Homo sapiens
attgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaattt

SEQ ID NO: 9596 - DNA, 321 bp, Homo sapiens
  misc_feature 293: n = A,T,C or G
tgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggtnattttcgggagtgttattttatcttccc

SEQ ID NO: 9597 - DNA, 329 bp, Homo sapiens
caggacgcctggtctgccttgtgggtcctggacggagcccctacctctgcaaagatgacttggagacaggccgtcctgctgtcttgcttctccgccgtggtgctcctgtctatggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgcacccatcctatctctacaaccgccaccacacctgatcccatcctgaagccggcca

SEQ ID NO: 9598 - DNA, 271 bp, Homo sapiens
gaaaagtttgtgaatattaagtaaatttgattcaatagacattttatttttttgtaaagatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgttt

SEQ ID NO: 9599 - DNA, 173 bp, Homo sapiens
cacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgcc

SEQ ID NO: 9600 - DNA, 319 bp, Homo sapiens
attttatgacatttaaatagctaacattataaaataatacaatacaatggatttaattttgatattatggaattttaactagaaacttatagcttagccaacaacgtgaatgaaggctatagggttctaatacttgtctacagcggtgtaacattttccctcccatctctccctctggatttttccacttttaaaatggattctatatctcaatgtagctttctgtttggaaacaggagaattgcttgaaccctggaggcggaggttgcagtgagctgagatcacgccattgcactctaggctgggcaacagagtgaga

SEQ ID NO: 9601 - DNA, 330 bp, Homo sapiens
aaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttcta

SEQ ID NO: 9602 - DNA, 156 bp, Homo sapiens
tatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaat

SEQ ID NO: 9603 - DNA, 325 bp, Homo sapiens
acttcaccaaaggagatatatgatggcaaagaaataaatgaaaagatgctcaacattattagtcattagagaaatgcaaattaaaaccgtaataggcacaaccattaaaataacttaattctttaaattgacagtagtatgtgctggtgaggttttgaactccggtagacagaataatgcccccccaaaaatgtccgtatcctaatccccaggacctttgagtatattatattacatggcaagggaggaatacagtcacaaaggaaaataaattcgtgaatcatctgactttatttatttatttatttatttatttatttattta

SEQ ID NO: 9604 - DNA, 133 bp, Homo sapiens
cccaagcctactgcctcccgctgccgccagtaccccctccagccccacacctgggcctccccctgccactcccctcccttgctcccctctgtccccagggatcaaacagaagcagccgtgggcaaaatacaat

SEQ ID NO: 9605 - DNA, 304 bp, Homo sapiens
ggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatc

SEQ ID NO: 9606 - DNA, 119 bp, Homo sapiens
tcaagacaagcctgggcaacacagcaaaaccctgtctctaaaataaaaattaaaacacacacacacacacgtgcgcacactatgccttggtgtgagaggaaataaattaccaaaagctg

SEQ ID NO: 9607 - DNA, 323 bp, Homo sapiens
ggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtg

SEQ ID NO: 9608 - DNA, 105 bp, Homo sapiens
agtacttctagagcggccgcgggcccatcgattttccacccgggtggggtaccaggtaagtgtacccaattcgccctatagtgagtcgtattaaattttcactgg

SEQ ID NO: 9609 - DNA, 327 bp, Homo sapiens
cagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaag

SEQ ID NO: 9610 - DNA, 312 bp, Homo sapiens
cgaaccttacccggatgatggcatggggtatggcgactacccgaagctccctgaccgctcacagcatgagagagatccatggtatagctgggaccagccgggcctgaggttgaactggggtgaaccgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctg

SEQ ID NO: 9611 - DNA, 107 bp, Homo sapiens
caggaagacccaggaaaggtgtgagctggaagcactgaacctacctcatcctcctggagggtgtggctaccctcgccaccccaaattccatgtcaataaagaacagc

SEQ ID NO: 9612 - DNA, 330 bp, Homo sapiens
caaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagagg

SEQ ID NO: 9613 - DNA, 326 bp, Homo sapiens
aggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagc

SEQ ID NO: 9614 - DNA, 329 bp, Homo sapiens
ctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctg

SEQ ID NO: 9615 - DNA, 145 bp, Homo sapiens
ggaaacctcagaactggtctatttggtgtcgtggaacctcttactgctttcaatacacgattagtaatcaactgttttgtatacttgttttcagttttcatttcgacaaacaagcactgtaattatagctattagaataaaatct

SEQ ID NO: 9616 - DNA, 322 bp, Homo sapiens
aaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaaca

SEQ ID NO: 9617 - DNA, 197 bp, Homo sapiens
  misc_feature 93: n = A,T,C or G
ctgtcttgtagggcctggccttgtgggcagggggcagtcctgtgccttgtgggccctcagcctctgagggcagagatgctgtcagtgccgcangtgcatcacatacttctagcatcctctccaccctgcattccaaatgctgcttgctgcctgccctgccctccgatgcaggggtggggtggggggcggagtcccgc

SEQ ID NO: 9618 - DNA, 328 bp, Homo sapiens
gaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtggccctgaaagggccagcacatcactggttttctaggagggactcttaagttttctacctgggctgacgttgccttgtccggaggggctttgcagggtgggcttgaagccctggggcagagaacagagggtccagggccctcctggctcccaaca

SEQ ID NO: 9619 - DNA, 287 bp, Homo sapiens
atttttataaacaaacttccatcctttttgtttttaataaggcaagttataaattgaaccccttggtacatccttccctgagcgtagttgctgaggagtgaggtgcagagcagtccagatagaccctgccctcaagggatctcaatgcactgtgaaggcaagatgatatcacccatttcaggagcatcatagctccaacagccaaaaacacaaagcctcaggaaggaaaatgtctttgcagtctcggggtaggaaaacagatcttaggatacaaaaactatagccat

SEQ ID NO: 9620 - DNA, 303 bp, Homo sapiens
agcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctg

SEQ ID NO: 9621 - DNA, 325 bp, Homo sapiens
gtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtgggggctgtgcactgggcagatcaagactggtgcccc

SEQ ID NO: 9622 - DNA, 331 bp, Homo sapiens
gtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggac

SEQ ID NO: 9623 - DNA, 351 bp, Homo sapiens
  misc_feature 1: n = A,T,C or G
nagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagc

SEQ ID NO: 9624 - DNA, 241 bp, Homo sapiens
ggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatg

SEQ ID NO: 9625 - DNA, 293 bp, Homo sapiens
  misc_feature 10: n = A,T,C or G
tattactatnatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcag

SEQ ID NO: 9626 - DNA, 348 bp, Homo sapiens
cccttttcagtttccatgtactagagcgactgtcagtgtggttggcagtgacctgtgtttttcatgcatgtttttgtttcagaataactgggagatgaaacaggaagctctatgacacacttgatcgaatatgacagacactgaaaatcacgactcatccccccccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctgtgtgt

SEQ ID NO: 9627 - DNA, 334 bp, Homo sapiens
ttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaa

SEQ ID NO: 9628 - DNA, 100 bp, Homo sapiens
caaggccggggcaggggagcctgtgctgatgccatccagagcactgggctgtgcctggaaggcgagccttgattgtctgaacacataaagcaaactgtcc

SEQ ID NO: 9629 - DNA, 206 bp, Homo sapiens
  misc_feature 72, 104, 153, 174, 200: n = A,T,C or G
ctcatttcactcaagccaaagtgcttgacccacaggaaaatgcttaactggatggattttttttttttaaanaataatctccttgaaagggtaaaggacctaanagtgagtgctataatcccagcttttgtaataccactcaatggaggtctntgaattccagtaaagagcagngaaattttattatcacaaaaaagganaaaaat

SEQ ID NO: 9630 - DNA, 294 bp, Homo sapiens
ctcgtgccgcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttttt

SEQ ID NO: 9631 - DNA, 331 bp, Homo sapiens
gtttctgagctttcctgtctttccttttttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgc

SEQ ID NO: 9632 - DNA, 104 bp, Homo sapiens
  misc_feature 99: n = A,T,C or G
agtacttctagagcggccgcgggcccatcgattttccacccgggtggggtaccaggtaagtgtacccaattcgccctatagtgagtcgtattacatttncactg

SEQ ID NO: 9633 - DNA, 324 bp, Homo sapiens
aaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatg

SEQ ID NO: 9634 - DNA, 313 bp, Homo sapiens
ctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagac

SEQ ID NO: 9635 - DNA, 202 bp, Homo sapiens
tttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttcc

SEQ ID NO: 9636 - DNA, 272 bp, Homo sapiens
aagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaa

SEQ ID NO: 9637 - DNA, 269 bp, Homo sapiens
caccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatg

SEQ ID NO: 9638 - DNA, 178 bp, Homo sapiens
cccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtcttgt

SEQ ID NO: 9639 - DNA, 227 bp, Homo sapiens
cggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaat

SEQ ID NO: 9640 - DNA, 243 bp, Homo sapiens
ctgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttg

SEQ ID NO: 9641 - DNA, 322 bp, Homo sapiens
ccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagtt

SEQ ID NO: 9642 - DNA, 289 bp, Homo sapiens
gaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactg

SEQ ID NO: 9643 - DNA, 105 bp, Homo sapiens
aggaagacccaggaaaggtgtgagctggaagcactgaacctacctcatcctcctggagggtgtggctaccctcgccaccccaaattccatgtcaataaagaacag

SEQ ID NO: 9644 - DNA, 323 bp, Homo sapiens
  misc_feature 2, 4: n = A,T,C or G
cntngcgcgcctgcaggtcgacactagtggatccaaagaattcggcaccagtgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttaga

SEQ ID NO: 9645 - DNA, 255 bp, Homo sapiens
cacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaaga

SEQ ID NO: 9646 - DNA, 258 bp, Homo sapiens
  misc_feature 14: n = A,T,C or G
agtggatccaaagnaattcggcacgaggaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaattttt

SEQ ID NO: 9647 - DNA, 103 bp, Homo sapiens
agtacttctagagcggccgcgggcccatcgattttccacccgggtggggtaccaggtaagtgtacccaattcgccctatagtgagtcgtattacatttcactg

SEQ ID NO: 9648 - DNA, 275 bp, Homo sapiens
gtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctt

SEQ ID NO: 9649 - DNA, 279 bp, Homo sapiens
caggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtaga

SEQ ID NO: 9650 - DNA, 323 bp, Homo sapiens
acatataagtcaagaataggcaagagttagagcaaaaacacagtgcatgaaaccccaggacactgtcagtcttgaattattgttcttgactatgtctgtctccaccactagactctctaatgctgaggactgtgatttatagagcctcacatggtgttttgcatgttgtatttactcaattaatgtttgctatatgaatgaaacttgagaaacagaaacatcataattgttacttattccatagtcttgtctgtgctggcctcagtaataaagcaaaaactaacttaaagactagcattcttatgttcattagtaaaacaggt

SEQ ID NO: 9651 - DNA, 233 bp, Homo sapiens
  misc_feature 72, 86, 97, 232: n = A,T,C or G
tcgccaaaattcgagaccggagcaccagtgggggcaagatgaaggtcaatggggcgccccgggaggatgccnggcctgtgccccanggctcctgccnagagcgagctgcaccggtcgctggagcggctggccgcttcacagagccgcacccacgaggacctctacatcatccccatccccaactgcgaccgcaacggcaactttccaccccaagcagtgtcaccccagcttnt

SEQ ID NO: 9652 - DNA, 308 bp, Homo sapiens
  misc_feature 297: n = A,T,C or G
ctctggtggcgacggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatgaacaaagaagaccacacactgggaaacatcattaaatcgctggagtgcaatggcacgatcttgctcactgcaacctccgcctcccgggttcaagtgattctcctgcttcagctacttgggaggctgaggcaggaaaattnttttgaagtcc

SEQ ID NO: 9653 - DNA, 183 bp, Homo sapiens
  misc_feature 16, 32: n = A,T,C or G
agtggatccaaagtanttcggcacgagtctantgtagccgttgagttgtggtagtcaaaatgtaataattattagtagtaaggctaggagggtgttggttattaaaattaaggcgaagtttattactcttttttgaatgttgtcaaaactagttaattggaagttaacggtactatttatact

SEQ ID NO: 9654 - DNA, 123 bp, Homo sapiens
ctccactgtcctctgccagcctacaggaggaaaagcaaggcttacagaaggatgttccttcaggaggaagcagcactaaaagcactctgagtcaagatgagtgggaaaccatctcaataaaca

SEQ ID NO: 9655 - DNA, 375 bp, Homo sapiens
  misc_feature 2, 17: n = A,T,C or G
tngggaaaaaagctggngtttcgcgcgcctgcaggtcgacactagtggatccaaagcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattat

SEQ ID NO: 9656 - DNA, 119 bp, Homo sapiens
aggaagacccaggaaaggtgtgagctggaagcactgaacctacctcatcctcctggagggtgtggctaccctcgccaccccaaattccatgtcaataaagaacagctaaattctcctag

SEQ ID NO: 9657 - DNA, 345 bp, Homo sapiens
ctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgaca

SEQ ID NO: 9658 - DNA, 323 bp, Homo sapiens
gtttcccgcattccttggctctggcctcctcctccaccttcaaagccagcaaaggctggttgaatcattctcacatcgcatcactctcatgccgcctcttgtgtctccctcttcctttctgattgcgttgggcctacctgggtaatctaggatattcttgctatttcaggatcagccaattaccaaccttaattttgtctgctatcttaattctcctttgccatgtaacataacgcattcacaggttcctgggattagtatgtggacatttcagggaggctgtcattctgcctgccacactgcctatcactgatggtgataat

SEQ ID NO: 9659 - DNA, 105 bp, Homo sapiens
attccactaagtgtaccaaaacatcacgttgtatgccataaatatatacaacttccatttgttaatttagacaattattttatttataaatttttaaaagaaatg

SEQ ID NO: 9660 - DNA, 311 bp, Homo sapiens
ttcggcacgagcagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccc

SEQ ID NO: 9661 - DNA, 264 bp, Homo sapiens
  misc_feature 79: n = A,T,C or G
atcaaatcaacagaaaatataccttggtgccaccaacccattttgtgccacatgcaagttttgaataaggatggtatangaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctg

SEQ ID NO: 9662 - DNA, 319 bp, Homo sapiens
gctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcacc

SEQ ID NO: 9663 - DNA, 342 bp, Homo sapiens
gtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcag

SEQ ID NO: 9664 - DNA, 289 bp, Homo sapiens
ctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtg

SEQ ID NO: 9665 - DNA, 350 bp, Homo sapiens
tagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggt

SEQ ID NO: 9666 - DNA, 344 bp, Homo sapiens
aaaaaatctcccaagctcctctcttaggtatgtttccttattattcagtttttctgggaacaactgattgcataagaatatagaaccacctggaaggtgttaaatagaatctctaagaaattaggaataatttggatttgattagaatgaaagttttaaaaatcaagaatgccagtgagcgtttgtcatataaaactatctatagatactattggtactgatcctgggttgatttaataatcttagaaatgatttagagacaaagacatatttgaaaataatgagagtaaaatgtattaatatggaagattttggttctactgtttcagggttggtctaaggat

SEQ ID NO: 9667 - DNA, 127 bp, Homo sapiens
gacttgcacagtccttctgagattgttaagcagattacttccatcagtattgagccaggagttgaggtggaagtcaccattgcagatgcttaagtcaactattttaataaattgatgaccagttgtt

SEQ ID NO: 9668 - DNA, 328 bp, Homo sapiens
gctcacgggggctccagcagccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggtt

SEQ ID NO: 9669 - DNA, 221 bp, Homo sapiens
caggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggc

SEQ ID NO: 9670 - DNA, 269 bp, Homo sapiens
  misc_feature 223, 251: n = A,T,C or G
tctcggtctgggtcaaggggccgtgactctccttaccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacntaatttctaccagggccatattagcagngaaacattttaaactgca

SEQ ID NO: 9671 - DNA, 257 bp, Homo sapiens
ttcggcacgagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaaggtggctc

SEQ ID NO: 9672 - DNA, 256 bp, Homo sapiens
gtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttg

SEQ ID NO: 9673 - DNA, 356 bp, Homo sapiens
  misc_feature 15: n = A,T,C or G
agtggatccaaaganttcggcacgaggaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctg

SEQ ID NO: 9674 - DNA, 311 bp, Homo sapiens
ttcggcacgagtgattttttttaatgctgcacaacacaatatttatttcatttgtttcttttatttcattttatttgtttgctgctgctgttttatttatttttactgaaagtgagagggaacttttgtggccttttttcctttttctgtaggccgccttaagctttctaaatttggaacatctaagcaagctgaagggaaaagggggtttcgcaaaatcactcgggggaagggaaaggttgctttgttaatcatgccctatggtgggtgattaactgcttgtacaattacgtttcacttttaattaattg

SEQ ID NO: 9675 - DNA, 321 bp, Homo sapiens
ttcggcacgaggaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgctttcaaggccgggacagtgtggccgagcagatggctatgtgctagagggcaaagagttggagttctatcttag

SEQ ID NO: 9676 - DNA, 331 bp, Homo sapiens
ccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatc

SEQ ID NO: 9677 - DNA, 324 bp, Homo sapiens
ttcggcacgagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtagggtaagaaaggaaagaaggctgctgttggtgttaagaagcagaagaagcctctggtgggaaaaaaggcagcagctaccaagaaaccagcccctgaaaagaagcctgcagagaagaaacctactaca

SEQ ID NO: 9678 - DNA, 329 bp, Homo sapiens
gacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgt

SEQ ID NO: 9679 - DNA, 311 bp, Homo sapiens
ttcggcacgagaataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattc

SEQ ID NO: 9680 - DNA, 345 bp, Homo sapiens
ctggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctggggtggtctcccaattgtcgcaaagattctcaata

SEQ ID NO: 9681 - DNA, 333 bp, Homo sapiens
tgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcgggagggccccctcaagggcatcctgggctacacttgagcaccaggtggtcttcctctg

SEQ ID NO: 9682 - DNA, 332 bp, Homo sapiens
gggtgtggcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaag

SEQ ID NO: 9683 - DNA, 332 bp, Homo sapiens
caaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctataga

SEQ ID NO: 9684 - DNA, 326 bp, Homo sapiens
atcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagacca

SEQ ID NO: 9685 - DNA, 321 bp, Homo sapiens
caagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatg

SEQ ID NO: 9686 - DNA, 251 bp, Homo sapiens
acggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggctta

SEQ ID NO: 9687 - DNA, 329 bp, Homo sapiens
ggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatatttgtatgttttgtatcaatagcataattaacttgttaagcaagtatggtcttgataatgcatt

SEQ ID NO: 9688 - DNA, 241 bp, Homo sapiens
gtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttat

SEQ ID NO: 9689 - DNA, 216 bp, Homo sapiens
ccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatga

SEQ ID NO: 9690 - DNA, 345 bp, Homo sapiens
ggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagaggg

SEQ ID NO: 9691 - DNA, 286 bp, Homo sapiens
ctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggat

SEQ ID NO: 9692 - DNA, 125 bp, Homo sapiens
ttttgacttgacattttgaattatgccacttggttcagttctagtatctgttttgtttttttgtttttttcctaattgagtcaaggtctcactgcactctagcctgggcgacagagcaagactac

SEQ ID NO: 9693 - DNA, 333 bp, Homo sapiens
ctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcagg

SEQ ID NO: 9694 - DNA, 321 bp, Homo sapiens
caggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagctta

SEQ ID NO: 9695 - DNA, 358 bp, Homo sapiens
gttgagctgagatcaagtagaagttctgctgatgggcagaggaggagaaaagcatccaggtagaagaatcagcaggcacaaagatgcggaggcccaggaggcatttggcttgaggccagtgcagtttgcttcagcatggctgctctgcagaatcccagaggaccagtggtaaaggaggaggtctttccctgagaccattttcatcaggcctgggcaggcatgatgcaggcaggcccaggtcaaggagagctttggtttccagctggggagccttgtggcttagggatgggcttttaagcagtggcaagatgtgattgtcacttgttccagatgggtgggtctcttcgcttttctcatg

SEQ ID NO: 9696 - DNA, 338 bp, Homo sapiens
  misc_feature 308: n = A,T,C or G
tcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaaaaaaaaaaacggcacgagagtacttntagagcggccgggggcccatcgattttcca

SEQ ID NO: 9697 - DNA, 266 bp, Homo sapiens
aaaagaaaagaatctcaaagtgaaaggaccagttcgaatgcctaccaagactttgagaatcactacgagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgtt

SEQ ID NO: 9698 - DNA, 267 bp, Homo sapiens
  misc_feature 21, 23, 30, 33, 53, 58, 59, 61, 62, 74, 77, 97, 144, 162,193, 216: n = A,T,C or G
atttattcacagatttagcancntaacctnccncaacttgccacctgcctggnggatnngnncacagtgacctnggntgaaccacctaatccttcantgtccagcaaacggactcagagcacagcacagggctccggggcgctnggacgtgatgggatgggnccctcacctagcaggttctaaaagcctgggngaatggatcaaacaggccttggntgagcccacccactgcagccgatccccatgggggacccgctctgccgctgg

SEQ ID NO: 9699 - DNA, 177 bp, Homo sapiens
caaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaattt

SEQ ID NO: 9700 - DNA, 369 bp, Homo sapiens
  misc_feature 5, 19, 48, 150: n = A,T,C or G
ctcgngccgcccagacgcngcccatggaggcgtccagcgagccgccgntggatgctaagtccgatgtcaccaaccagcttgtagattttcagtggaaactgggtatggctgtgagctcagacacttgcagatctcttaagtatccttacnttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacactt

SEQ ID NO: 9701 - DNA, 398 bp, Homo sapiens
  misc_feature 23, 39, 69, 72, 113, 142, 197, 205: n = A,T,C or G
cttctttgggaaaaaacccctgntttttggggcgcctgnaggtccacactagtggatccaaagaattcnttncgaggctgacctgacctgatgtccattcatcccaccctctnacagttcggacttttctcccctctctttntaagagacctgaactgggcagactgcaaaataaaatctcggagttctatttattnattgtctncctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatatt

SEQ ID NO: 9702 - DNA, 106 bp, Homo sapiens
gagtacttctagagcggccgggggcccatcgattttccacccgggtggggtaccagggtaagtgtacccaattcgccctatagtgagtcgtattacaatttcactg

SEQ ID NO: 9703 - DNA, 359 bp, Homo sapiens
  misc_feature 110, 168, 205, 218: n = A,T,C or G
ctcgtgccgcaggtgtagacttttcaggagtgaagaatgaggcaggcattccaaacctggaccttcatcaccttttgtttcatctcaagacaattctgagggactgtttnggagcgtgtctggaaggtgaaccttgaagaagagtgtgggttttgatgtgactcagtngagatctttcatggggaggcaggaattcaatgcccanaatctgggctggngtctttgaggtcagtaggttgcgtctttgtatccaagtccattgttactaggttggaggctggagattctaaatggcttccagaccatctctctgattctctttgggagatggggtctgaaagacaatgtcagtagttttg

SEQ ID NO: 9704 - DNA, 309 bp, Homo sapiens
  misc_feature 1, 13, 28, 189, 203, 219, 248: n = A,T,C or G
nggaaaccatgtnttctgggggtgagangaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagntcctggaccctcangacagtgaacttccanacctcagggcaggtctatgggccactgcnggagatgagaccagccttctgtgttcacctaacgatttatactgtgtatctgtctttgatg

SEQ ID NO: 9705 - DNA, 335 bp, Homo sapiens
  misc_feature 7, 40, 115, 220: n = A,T,C or G
ttcggcncgagcaaacatgacatttactaaaacatctcanaagtttggccagtgggctgatagccgggcaaacaccgtttatggattgggattctcctctgagcatcatctttcnaaatttgcagaaaagtttcaggaatttaaagaagctgctcgacttagcaaaggaaaaatcacaagagaagatggaacttaccagtacaccttcacaggaatccgnaggcggggatcttcagtctcctttaacaccggaaagtatcaacgggacaggatgatgaaagaacacctgatgtgacacaggaactcagagccaagggctgaaccaactcaaaatg

SEQ ID NO: 9706 - DNA, 243 bp, Homo sapiens
  misc_feature 1, 7, 36, 37, 70, 128, 206: n = A,T,C or G
ncaccgnagggatgccagagacataccaggcgcggnngacgcaaagttttcccgggattgaggtgacggncaaggccaaagcagatgccctctacccggtggttagtgctgccagcatctgtgccaangtggcccgggaccaggccgcgaagaaatggcagttcgtggagaaactgcaggacttggatactgattatggctcaggntaccccaatgatcccaagacaaaagcgtggttgaagg

SEQ ID NO: 9707 - DNA, 340 bp, Homo sapiens
  misc_feature 5, 11, 49, 53, 58, 223, 226, 231, 268, 320: n = A,T,C or G
gtagngtttcngcaaccctgttataagtttattaatattatgtaagtgntgtncttgnatttatgtatagtgtatgtattgtaaatatactcagagcttttttccttttactgtaaaatggagatttttttgccctatgataatgtaaagggagaccctcctaatgagattctctcagaggatgattattccagtctattctcagagatttaaatgaacaagngtnattgnttttaatggtgtctcagacatattctgttggggcatngcttttctgtattcaactttcctatgaattgagctgtgaactgaaatagagnttaaacctttaactgtatgc

SEQ ID NO: 9708 - DNA, 196 bp, Homo sapiens
  misc_feature 20, 127: n = A,T,C or G
gtcaaggcagaggcaggaanctaactggtgtgagtcaaatgccccctgagtgactgcccccagcccaggccagaagacctcccttcaggtgccgggcgcaggaactgtgtgtgtcctacacaatggngctattctgtgtcaaacacctctgtattttttaaaacatcaattgatattaaaaatgaaaagattattg

SEQ ID NO: 9709 - DNA, 301 bp, Homo sapiens
  misc_feature 3, 5, 75, 214: n = A,T,C or G
atncncctctgcgctatgtggacattgccatcccatgcaacaacaagggagctcactcagtgggtttgatgtggnggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagngaccaaggaggaatttcagggtgaatggactgctcccgctcctgagttcactgctactcagcctgaggttgcagactggtctgaagg

SEQ ID NO: 9710 - DNA, 341 bp, Homo sapiens
  misc_feature 14, 20, 23, 129, 132, 191, 249, 308, 329: n = A,T,C or G
gtaaaaccagtggnacaggnggngtcacagctagcactgggtcatcattccctccaaaatataatcaggagataaacaacaagtaacagtttacagctagtttcttattcgagcatttcaagttgggtnttnctagctctttatacctgtatactgcatacctcaattaatttatatgtttctgaagaggngaagactgactttcatgtcgtttaacctcttactgacatgggcaagaaaagaccaggnattcatatagtatttcctcattcaaggcttatctgcatggtaggtgttggggacacagnggtgagcaagacacaataatncctgtctccatg

SEQ ID NO: 9711 - DNA, 295 bp, Homo sapiens
  misc_feature 14, 19, 90, 117, 148, 159, 178, 194, 197, 230, 263, 284: n = A,T,C or G
cttttgaggctggncgccngtgattgtttactgcctactggatttttttctattaacattgaaaggtaaaatctgattatttagcatganaaaaaaaaatccaactctgcttttggncttgcttctataaatatatagtgtatacttnggtgtagactntgcatatatacaaatttgnagtattttcttgtttngangtctaatctgtatctataatgtaccctagtagncgaacatacttttgattgtacaattgtacattngtatacctgtaatgtaaatgnggagaagttag

SEQ ID NO: 9712 - DNA, 243 bp, Homo sapiens
  misc_feature 2, 4, 34, 35, 38, 160, 188, 218: n = A,T,C or G
gnangacccccactagtggatccaaagaaattcnnttngagactattcctataagatagccgaaagaagctgctgtgaggagctcagctccaaacacaggatcagcaccttgtataggaattcccatgaattatgacttctcattctgttttatcagagngcatatatgtcctacttcaggaaaagtnaaacagtcatttacgaaagaaagtcaatcngtatcctaagcattttaataaaaag

SEQ ID NO: 9713 - DNA, 339 bp, Homo sapiens
  misc_feature 20, 70, 147, 236, 250, 297, 336: n = A,T,C or G
caggaaagattagaaaaggnccccaaaaaaccctttaacagtgtgaatctttatagtatttgaaaatganaagaagcagcagattgtaatttggtttactggatgtgatggacgttctgtaatagaaaacctgaaacgatgattgantgggaaaaagagactacaaaatttgtcgtaggatgtatacaagacttattttctttattacagtattataagaaaacatatgtatttgnaaaaatggtttccngtgtcaagtatttgtgcagtcagagctgacttgtaaactattcttgnaatagctcattattttgaaagatttatatatgatgaatnctg

SEQ ID NO: 9714 - DNA, 257 bp, Homo sapiens
  misc_feature 5, 49, 175, 240: n = A,T,C or G
ctcgngccgaattcggcaccagccagctacagttttttttgggttatgncgtcatgaagccggcgctttcagttgtgcaaccttgaacaaatgggttcagtatctcggaatttcagttttgtcttcattttaaaaaataaatctggtttagaactcgacctcaagcgatccgccngcctccgccttccgaagtgctgggattaaaggcgtaagccaccgccccagcctaacgaacatggngaaacgccgtctctact

SEQ ID NO: 9715 - DNA, 136 bp, Homo sapiens
  misc_feature 93, 107, 111, 115: n = A,T,C or G
ctcactcgaccttgaggaggcctcccacgaagggcgaagatggccgagatgatcctaaaaataaccgaagaaagagaggaccagaccagaatnccctttggacattngagntttntggtttttttattttgtattg

SEQ ID NO: 9716 - DNA, 217 bp, Homo sapiens
  misc_feature 3, 29, 80, 133, 134, 155, 169: n = A,T,C or G
aancacctcaggagtgtccagggacagcngaaggatacgcagctccacctggatgatgccctccggggccaggaggaccngaaggagcagctggcgattgtggagcgcagagccaacctgctgcaggcctganntggaggagctgcgggctactntggagcagacgganagggcccggaaactggcggaacaggagctcctggactccaacgagagg

SEQ ID NO: 9717 - DNA, 330 bp, Homo sapiens
  misc_feature 95: n = A,T,C or G
tgagcctacgcacacgagaacatgcctctcgcaaaggatctccttcatccctctccagaagaggagaagaggaaacacaagaagaaacgcctggngcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 9718 - DNA, 261 bp, Homo sapiens
  misc_feature 4, 8, 54, 127, 130, 208, 247: n = A,T,C or G
cccnggcngcctccacactcaagggccctccacctgaggcagatcacctgaggncgggagttcaagaccagtctgaccaacatggagaaatcccgtctctactaaaaatacaaaattagccgggcgnggnggtgcttgcctgtgatcccagctactcaggaggctgaggcaggagaatcgcctgaacccaggaggcggaggttgcggngagccgagatcacaccactgcactccagcctgggcaacngagtgaaactccgt

SEQ ID NO: 9719 - DNA, 143 bp, Homo sapiens
  misc_feature 11, 32, 58, 122: n = A,T,C or G
cagtaaatgcnagatcctattttaattttctngtgaatggaaatatatgtgttttctnttctaggtatgaaaactttcaaagacgactagcacagaaccctctcttttggaaaacataattngaataaaataatttttaatgg

SEQ ID NO: 9720 - DNA, 301 bp, Homo sapiens
  misc_feature 12, 19, 44, 60, 63, 125, 150, 166, 281: n = A,T,C or G
cgccgatccggntgcaccncgctcgctccgagtttcaggctcgngctaagctagcgccgncgncgtctcccttcagtcgccatcatgattatctaccgggacctcatcagccacgatgagatgtnctccgacatctacaagatccggganatcgcggacgggttgngcctggaggtggaggggaagatggtcagtaggacagaaggtaacattgatgactcgctcattggtggaaatgcctccgctgaaggccccgagggcgaaggtaccgaaagcacagnaatcactggtgtcgatattg

SEQ ID NO: 9721 - DNA, 311 bp, Homo sapiens
  misc_feature 19, 21, 96, 205, 302: n = A,T,C or G
gggaagtgtcaagcgggcncncccccatctccgccgctattaccactgaacccggaccccctacccaggtccagggccagccgccatgacgaacgngtactccttggatgggattctggagtttggtttgctctttgtttgcacctgtgcctacttcaagaaagtacctcgtctcaaaacctggctgctatcagagaagaagggngtttggggtgtgttttacaaaggtgaggccatgtctggacagggagaagagactgccatctctggacagtgtggagctacaaagtagggagtacagngagctggga

SEQ ID NO: 9722 - DNA, 121 bp, Homo sapiens
  misc_feature 21, 27, 28, 33, 40, 98, 102, 112: n = A,T,C or G
gaaaaaggtgctgggggctcngatggnnaaccngggcctnagggtcttactggtgcacctggacgatcagaggacaggcgaggacctccaggagaagnaggncccaaagganatagagggg

SEQ ID NO: 9723 - DNA, 318 bp, Homo sapiens
  misc_feature 13, 211, 261, 303: n = A,T,C or G
aaatggtttgagntggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttntattaccaacacactggctggaaaagggacaaaccacatcacgggtgagngatacttctcagtcttctctactcattcaacaaaggaaatgngggctggggcagagg

SEQ ID NO: 9724 - DNA, 315 bp, Homo sapiens
  misc_feature 4, 67, 121, 126, 133, 150, 204, 213, 271, 274: n = A,T,C or G
gtcnttaagaacatgtgacaggtgttttttttttccaatatgaactcatgcaagttaccaaaactgngataacccttttttacttactgtaaagagtcattttcataaagatcaattcatngattngtttttngtaaagctatcattcantatatattataaattaatataaatttaagggaagctctatgtaaggagacttanagccaaacngtttaagctgtatcatcccaacaaagtatcctttcatgaacggggcatgcaatagctnaanaattgctaggattaaattaaggaaagtaaagctactcagag

SEQ ID NO: 9725 - DNA, 374 bp, Homo sapiens
  misc_feature 43, 93, 127, 130, 154, 196, 210, 212, 233, 271, 351: n = A,T,C or G
tccctccttccttccttccttccttccttcttttcgactgagnctccttttgtcacccaggctggagggcaggaggcacaatcttggctttcngcaacgtccacctccaaggttcaagcgaatctcntgnctcagcctccagagtagctgcgantacaggcgcctgccaccacgcccaactaatttttgtattttnagtagagacagggntncaccacgttgcccaggctggncctgaactcctgaccccaggcgatccacccgcctcggnctcccaaagtgctgggattacaaccgtgggccaccacacctggccctatagctgctttctcatggtttcataagatgtgnagttatacatcttcaggataata

SEQ ID NO: 9726 - DNA, 156 bp, Homo sapiens
  misc_feature 6, 38: n = A,T,C or G
ctttcnaccagctggccctggactcccctaagggctgnggcactgtcctgctctccggtcctcgcaagggccgagaggtgtaccggcatttcggcaaggccccaggaaccccgcacagccacaccaaaccctacgtcccgcttccaaagggccgga

SEQ ID NO: 9727 - DNA, 400 bp, Homo sapiens
  misc_feature 2, 16, 106, 143: n = A,T,C or G
tngagatcttccagtnattcgccacaatgacgaacacaaagggaaagaggagaggcacccgatatatgttctctaggccttttagaaaacatggagttgttccttnggccacatatatgcgaatctataagaaaggtgatatngtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctg

SEQ ID NO: 9728 - DNA, 183 bp, Homo sapiens
  misc_feature 18, 72: n = A,T,C or G
gcgagttcgaggaggagnctgaggaggaggtggcctagagccttcagtcactggggaaagcagggaagcagngtgaactctttattcactcccagcctgtcctgtggcctgtcccactgtgtgcacttgctgttttccctgtccacatccatgctgtacagacaccaccattaaagcattttc

SEQ ID NO: 9729 - DNA, 351 bp, Homo sapiens
  misc_feature 18, 19, 148, 206, 271: n = A,T,C or G
ggtcaaggaagcccagcnnagagaaaagaaaaaacaaaattcctaaacatgtgaaaaaaagaaaggagaagacagccaagacgaaaaaaggcaaatagaatgagaaccatattatgtacagtcattttcctcagttccttttctcgcntgaactcttaagctgcatctggaagatggcttattggttttaaccagattgtcatcgnggcactgtctgtgaagacggattcaaatgttttcatgtaactatgtaaaaagctctaagctctanagtctagatccagtcactgactctgtctggtgttgacagaggatttatttaagctattattttaataaagaactttgtac

SEQ ID NO: 9730 - DNA, 393 bp, Homo sapiens
  misc_feature 64, 177, 328: n = A,T,C or G
ggaaaagattgatcgccgttctggtaaaaagctggaagatggccctaaattcttgaagtctggngatgctgccattgttgatatggttcctggcaagcccatgtgtgttgagagcttctcagactatccacctttgggtcgctttgctgttcgtgatatgagacagacagttgcggngggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgttngtttcaattggccatttaagtttagtagtaaaagactggttaatgataacaatgcatcgtaaaac

SEQ ID NO: 9731 - DNA, 262 bp, Homo sapiens
  misc_feature 19, 79, 233: n = A,T,C or G
gggtgctctgcctgctccnccaggcctctcctgggagccactcgcccagagactcagcttggccaacttggggggctgngtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgncatttaataaagaaggaacatcaggcatg

SEQ ID NO: 9732 - DNA, 396 bp, Homo sapiens
  misc_feature 15, 21, 147, 209, 287: n = A,T,C or G
gtcgtaagggctgangatccntggtccgcacgctcctgctcctgactcaccgctgttcgctctcgccgaggaacaagtcggtcaggaagcccgcgcgcaacagccatggcttttaaggataccggaaaaacacccgtggagccggangtggcaattcaccgaattcgaatcaccctaacaagccgcaacgtaaaatccttggaaaaggngtgtgctgacttgataagaggcgcaaaagaaaagaatctcaaagtgaaaggaccagttcgaatgcctaccaagactangagaatcactacaagaaaaactccttgtggtgaaggttctaagacgtgggatcgtttccagatgagaattcacaagcgactcattgacttgcacagtccttctgagatt

SEQ ID NO: 9733 - DNA, 400 bp, Homo sapiens
  misc_feature 2, 25: n = A,T,C or G
gnacgagagccaagccatataatcnatttatataacctcctctttccttaaggtaagagttcagatggttgacataaccatttcatgtaactgttaacagcaaacaaacaagcacacggaaagccagggatttaaaactctacctatctcacagggttgtagtgagaattatatgtactgtttatgaaagtgtttactttttgatgggcacatagtagatagtaaatgtttgctgagtctgaaaatatgctcctaccagcctaaggagctgatgcactgtcggttctgcccacttaccttaaggagagccagagaaagttcttgtctgtagcctcctttccctttgtgctgtcccacaccatccacccaaataatgcctatcactctggccaagatgctg

SEQ ID NO: 9734 - DNA, 252 bp, Homo sapiens
cccaggccatgtggggtccgcacatagtcctgctggcctctcattgcttaggaggacaggaggctgtggtcaaggtgcctgttattttttttggacagagtcttgttctgttgcccaggttggagtgcagtggtatgatcttggctcacttgcaacctcctcatcccaggttcaagcgattttcctgcctccgcctcccgagtagctgggattacaggcgtgagcgtcgcgtccggactgggctttggtttc

SEQ ID NO: 9735 - DNA, 400 bp, Homo sapiens
  misc_feature 39: n = A,T,C or G
ccaggagcttccgaagaaacaggacccgagagggaaggngacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaaggctgcagtgcagtggcgtgatctcggctcactgcaacctctgcctcccgtgttcaagtgattttcctgcctctcagcctctcgagtaatttggattacaggcatgcgccaccatgcccggctaatttt

SEQ ID NO: 9736 - DNA, 400 bp, Homo sapiens
  misc_feature 3, 5: n = A,T,C or G
gtncncaccaaaaccgtgaagaaggcggcccgggtcatcatagaaaagtactacacgcgcctgggcaacgacttccacacgaacaagcgcgtgtgcgaggagatcgccattatccccagcaaaaagctccgttcaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaat

SEQ ID NO: 9737 - DNA, 395 bp, Homo sapiens
  misc_feature 20, 147: n = A,T,C or G
ctattctccgagcttcgccntgccgcctaaggacgacaagaagaagaaggacgctggaaagtcggccaagaaagacaaagacccagtgaacaaatccgggggcaaggccaaaaagaagaagtggtccaaaggcaaagttcgggactngctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcat

SEQ ID NO: 9738 - DNA, 400 bp, Homo sapiens
tcgaggacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcgg

SEQ ID NO: 9739 - DNA, 227 bp, Homo sapiens
  misc_feature 101: n = A,T,C or G
tacgaggtgacgcagaatgggaggggcggcctgcggagccagctggaggccattttcctgagggactgggactccccttacagccatgaccttgacacctnagctgacagcgtgggcaacgcctgccgcctgctctgaggcccgatccagtgggcaggccaaggcctgctgggcccccgcggacccaggtgctctgggtcacggtccctgtccccgcacccccgctt

SEQ ID NO: 9740 - DNA, 299 bp, Homo sapiens
  misc_feature 2: n = A,T,C or G
cncgagccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaacccccacaaaagccaaaaaatgggagacaatttcacatggactttggaaaatatttttttcctttgcattcatctctcaaacttagtttttatctttgaccaaccgaacatgaccaaaaaccaaaagtgcattcaaccttacca

SEQ ID NO: 9741 - DNA, 361 bp, Homo sapiens
  misc_feature 87, 92, 149, 216, 244, 308: n = A,T,C or G
cctacgctaccctatggccgtgggcctcaacaagggccacaaagtgaccaagaacgtgagcaagcccaggcacagccgacgccgcgngcgtntgaccaaacacaccaagttcgtgcgggacatgattcgggaggtgtgtggctttgccncgtacgagcggcgcgccattggagttacttgaaggtctccaaggacaaacgggccctcaaatttatnaagaaaaggggggggacgcacatccgcnccaagaggaagcggggaggagcttgagcaacgtactggccgccatgaggaaagctgctgccaanaaagaatgagcccctcccctgccctttccctgaaataaagaacagcttgacag

SEQ ID NO: 9742 - DNA, 391 bp, Homo sapiens
gcactgtggagagctcaacaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggat

SEQ ID NO: 9743 - DNA, 394 bp, Homo sapiens
  misc_feature 13, 23, 34, 57, 58, 60, 63, 80, 84, 92, 130, 164, 173, 184,306: n = A,T,C or G
actcaagccaagnaaaaacccantgccgggcacnacagaacttcactggtgatatgnngnacncacatatttcatgatgncttnttggaatntctaggaaccccacccaaaagaaaatcattactgcttnaaccatggcatattttatattttgctacagcagngaccctggnggtcacaaagnctccctttgatttttaaaaagcatatacttccatgaacttgatcactgctttctgaaatatttctcaactcattaaggctttaggcctcacttatgtttaaatataaactaactgatggttnggaataagaataaaatctagtccaaaagtcctaggacctatattctcatccaagagttttcacttagaaacaggatttattctgggaa

SEQ ID NO: 9744 - DNA, 329 bp, Homo sapiens
  misc_feature 19, 20, 148, 284: n = A,T,C or G
ccgggccccgcccaccccnngccacatccccacccatctggaagtgaaggcccagggactcctccaacagacaacggacggacggatgccgctggtgctcaggaagagctagtgccttaggtgggggaaggcaggactcacgactganagagagaggagggggatatgaccaccctgccccatctgcaggagcctgaagatccagctcaagtgccatcctgccagtggcccccagactgtggggttgggacgcctggcctctgtgtcctagaagggaccctccngtggtctttgtcttgatttttcttaataaacggtgctatccccgc

SEQ ID NO: 9745 - DNA, 396 bp, Homo sapiens
tgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttaagatacactctacagatatgcaaaattc

SEQ ID NO: 9746 - DNA, 386 bp, Homo sapiens
  misc_feature 9: n = A,T,C or G
ctgagaggncgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccg

SEQ ID NO: 9747 - DNA, 400 bp, Homo sapiens
  misc_feature 24: n = A,T,C or G
tcgagcgaagaaggagattcagancgagaagatccatttggacacgtcctccttcatggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgccgggcctcagctgcggaagccctgacccgggagttctcggtgctcaagatccggcccctcacgcagggaaccaagcagtcaaagctcaaagccttgcagaggccaaaactcctgcgtctggtgaaggagaggccacagacaaatgcgactgtggcccggcggctggtggcccggggc

SEQ ID NO: 9748 - DNA, 400 bp, Homo sapiens
  misc_feature 25: n = A,T,C or G
tcgaggaggcagcagagttgcaggncgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgctttttcttagtctgatgccaagcaaggccttttctgaata

SEQ ID NO: 9749 - DNA, 400 bp, Homo sapiens
tcgagccatgacctgactccaccccctacacagttcaccaaaccctttctctctgtccgtccctggggcaggagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcggacgccatggcctgggagctggcgggcagaagcaacagatgtccctgatgagtggagtcagagatggggtggaagccctgcctgggaataggacctcgttcttccctgcccggtgggtggagtagtggcag

SEQ ID NO: 9750 - DNA, 399 bp, Homo sapiens
  misc_feature 4, 118, 121, 358: n = A,T,C or G
gccnggtgcggagcgccggccgggggtgggctctccagggctgctaggcccctgccctcacctgcggccgcccggccccgccctaggtgtgccgtcaatggatcatgaagatggaggnggnggctcatgcctgttaatccccacactatgagaggctgagggaggaggatcacttggggccagtagtttgagaccagcctgggcaacatggcaagactccatctctacaaaaaaatgcaaaaagaaatcagtggaccatgtatgtacacatctattttggattcatgcctgtaagatactgagcatcgaccaggcgcaggggctcacaactgtaatcccagcactttgggaggctganatgggtggatcacctgagctcgggagttcgagaccagcctg

SEQ ID NO: 9751 - DNA, 230 bp, Homo sapiens
  misc_feature 5, 18, 23, 26, 43, 46, 55, 158: n = A,T,C or G
acagnaggttgctgacanaaganaangctaaaggaaataattnganctaagggancagggttgtaaaatgtaaatatcagcatgtttgatagatttaataaaaggtgtagctgggcagagtagaaacaggtaattttttaagtttttatcaatagggntgatagaggatgcccttacaaacaaaataaagtaccactgtatttttcacccaggaaggtatttatttatta

SEQ ID NO: 9752 - DNA, 326 bp, Homo sapiens
  misc_feature 93: n = A,T,C or G
tgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 9753 - DNA, 395 bp, Homo sapiens
  misc_feature 19: n = A,T,C or G
cagacgtccgccaggcgcnggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaagggggggtgccacaccacctgccctgctcctgctgctctcccgcctctgcctggactacgagacggccaccatctcctacatcctcactctcactgatgaacagtttctggtgcagga

SEQ ID NO: 9754 - DNA, 400 bp, Homo sapiens
  misc_feature 27, 41, 45, 67, 73, 74, 99: n = A,T,C or G
ctttctgtgggaaaaaacccctggctntttggggcgcctgnaggncccacactagtggatccaaagnattctnntcgaggcttcatgggagcaggctangaaaatgattattaatgatccacgatacaggtagtacttcaactttttatttacttttcactttgagcatatagcaggcctagcacatttaaagttgtgtagaaagataaaacatttaactgttgacttctgtttaggataccaagtatagagttgttttgtgtctaataaccaaaaagtcaaaggcttatcaaacaatttgagtactccgctacatataaaataataattattttaaaagtagaaattactttctacaatcatttgtaataaatttttgaaaatttttaaattatatgtg

SEQ ID NO: 9755 - DNA, 400 bp, Homo sapiens
  misc_feature 24, 25: n = A,T,C or G
tcgagggcatggtaaaccagtttnnaggtattaatcaaaaagtttaagttatttaggccccaaacccacattacttgattcaacttctattttaaaataaagttagtcctaaattaaattttaattgcagagaatacatgggtattcacaaggctgctaggcagactaaataggaaaaaaggggaaatgagaacatttagtccatgaaccccaacactaaaacataaacacacatgtgttcccatatggagaaactgtgggattctaaagcagtgcagaggcacagtgctttcctatgctgcctggattgattataactgagaaaaccaggcaaattctggtcaggggaaaagtgtcttcaccatacaagaagcttccctcccccagtagggctgcatta

SEQ ID NO: 9756 - DNA, 284 bp, Homo sapiens
  misc_feature 21: n = A,T,C or G
taaaagtgtcaatgaagggcngaacattagtgccccctatatattttaaagccacattttatgatttaatttgtctgaagataatggaaaggtgattaataatttgggagaaaaactagattctgtagaatatttggagtcaagatttatcatacaaagtttaaggttagtcagaactcaagataaaatatgaagcccttatgtgatctctgatgtctccacttttaacatgtatgcatattaattagtttgtccttcatttaaataaaatttagatatccaga

SEQ ID NO: 9757 - DNA, 350 bp, Homo sapiens
  misc_feature 19: n = A,T,C or G
tcgaggaaaacacttcagncagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattg

SEQ ID NO: 9758 - DNA, 247 bp, Homo sapiens
  misc_feature 19: n = A,T,C or G
gttgggccatgttacttgnccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgt

SEQ ID NO: 9759 - DNA, 396 bp, Homo sapiens
  misc_feature 14, 243, 385: n = A,T,C or G
gcgtggtctacgcngagtgccagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagngtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggngaacgccatca

SEQ ID NO: 9760 - DNA, 398 bp, Homo sapiens
  misc_feature 2, 4, 226: n = A,T,C or G
cncnagataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgnggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagagg

SEQ ID NO: 9761 - DNA, 395 bp, Homo sapiens
  misc_feature 20: n = A,T,C or G
cccgcctgctcccatcctcncccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggaggcccgcagggcccaccttggaccctggtgacctcctgtcactcactgaggccatcagggccctgccccaggcctggacgggccctccttccctcctgtgccccagctg

SEQ ID NO: 9762 - DNA, 400 bp, Homo sapiens
  misc_feature 5, 9: n = A,T,C or G
gcttngttnactacggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttg

SEQ ID NO: 9763 - DNA, 384 bp, Homo sapiens
  misc_feature 6: n = A,T,C or G
gagagnccaccctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggc

SEQ ID NO: 9764 - DNA, 201 bp, Homo sapiens
  misc_feature 14, 16: n = A,T,C or G
attcccagaaggangncaggccccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagttttt

SEQ ID NO: 9765 - DNA, 225 bp, Homo sapiens
accaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagccccagc

SEQ ID NO: 9766 - DNA, 395 bp, Homo sapiens
  misc_feature 16: n = A,T,C or G
tggagacgacgtgcanaactggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagat

SEQ ID NO: 9767 - DNA, 143 bp, Homo sapiens
  misc_feature 3, 67: n = A,T,C or G
acnctttggggaaaaaccctgtttttggcgcgcctgcaggccgacactagtggatccaaagaatttngcacgagcaaaatcaagcagaagaaagtatccgttaacctaaaaataggtcatttaaaattgcccagtaagaggag

SEQ ID NO: 9768 - DNA, 398 bp, Homo sapiens
  misc_feature 16, 21, 61, 85: n = A,T,C or G
agggaaaaaccctgtnttttngcgcgcctgcaggccgacactagtggatccaaagaatttngcacgagcaccgaggtcgcacgcntgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcag

SEQ ID NO: 9769 - DNA, 219 bp, Homo sapiens
tggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctg

SEQ ID NO: 9770 - DNA, 398 bp, Homo sapiens
  misc_feature 5, 36, 67: n = A,T,C or G
ccctnagggaaaaacccctgtttttcgcgcgcctgnaggccgacactagtggatccaaagtaatttngcacgagggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttcc

SEQ ID NO: 9771 - DNA, 300 bp, Homo sapiens
ctggtgatattaattttatatttaattcagcatatccaaaatacgacctcctgggttcaagtgattctcccacctcagcttcctgagtagctggaactacagctgcgctaccatgcccagctaattttttttttatctttaggagatgaggttttgccgtgttgcccaggctggtctcaaactcctgagctcatgcctgtaaccccagcactttgggaggccaaggcgggcggatcacgaggtcaggagttcaagaccagcttggccaacatggtgaaactccgtctccactaaaaatac

SEQ ID NO: 9772 - DNA, 399 bp, Homo sapiens
  misc_feature 20, 39: n = A,T,C or G
ccttagggaacaaaccctgnttttcgcgcgcctgcaggncgacactagtggatccaaagaatttggcacgagttttggtgaagaaattgaaacagagatacgataacttttaagttcatttagccagcaaggtggaaaactacgaatatgtggtaaaaaataatattgtagactattggagaaagtggcttgttcaatgtatggtgctaggactattggttatccattttttaaaaatgttttctgcctcataggctaaaaaaaatcaaaggaaatctaaatgacaaagagcaataaaaattctaaaatagaagaaaatgtagaatactacttaaaaatatgtatgtacctagattgaaaagaatcctccgtgcatgatactaaagaagtaataaaggc

SEQ ID NO: 9773 - DNA, 217 bp, Homo sapiens
  misc_feature 25, 35: n = A,T,C or G
tcttagggaaaaacccctgtttttngcgcgcctgnaggcccgacactagtggatccaaagaatttggcactgactgttgaggagtacttacatatcctacatttgactacattatttccaaaccaagtattccatccaaaggaacatactgctatcatagagaccaaggagggactgtttaaggttgccaaggtgaagcgagctgagaggctttgtc

SEQ ID NO: 9774 - DNA, 325 bp, Homo sapiens
atatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggc

SEQ ID NO: 9775 - DNA, 384 bp, Homo sapiens
  misc_feature 24, 65, 89: n = A,T,C or G
tcttagggaaaaaccctgtttttngcgcgcctgcaggcccgacactagtggatccaaagaatttngcacgagctgcattccagtatggnatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccacggttttctttctacaatttccaaaggttgcaagatgtttttttgtggatgaatataaaattttattgtgtaattacttggttccattaaaattggtt

SEQ ID NO: 9776 - DNA, 323 bp, Homo sapiens
caggctaccacgcccagctaatttttatatttttagtagagacggggtttcaccatggtagccagaatggtctctatctcttgaccttgtgatccgcccgcctcagcctcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaat

SEQ ID NO: 9777 - DNA, 342 bp, Homo sapiens
  misc_feature 22, 23, 41, 67: n = A,T,C or G
cttcttagggaaaaaccctgtnntttcgcgcgcctgcaggncgacactagtggatccaaagaatttngcacgagcagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtgggtgggggttaaatttggtaacaaataaaaattttttttttggtcaaattt

SEQ ID NO: 9778 - DNA, 363 bp, Homo sapiens
  misc_feature 23, 27, 69, 92: n = A,T,C or G
cttctttgggaaaaacccctgtntttngcgcgcctgcaggcccgacactagtggatccaaagaattttncacgaggtgtggcctggtttgtnacatgaaatgtatttgtgcctgtgagtctggtccaaacagtttgaaggcaccactcagcaacatgggtgggaaggtggcactgcatggttggagctcacaggttctgggggcaacgaggcctgggcacaaatccctgtcctgctccctacccagccgagtggccctgcgtaagttctccagcctttctgagcctcacttccctcctctgtgcaacaaggattgttggagtccttatttcctgacattttagatgctgaaaagaacgggaga

SEQ ID NO: 9779 - DNA, 375 bp, Homo sapiens
  misc_feature 10, 19, 29, 59, 298, 305, 373: n = A,T,C or G
ggaaaaaccntgtttttgngtgcgcctgnaggccgacactagtggatccaaagaatttngcacgagctgactcctgggccagcgatttttccttaagcccctgctattcctttgacaaaatttgcactttggaatcagaaaaatcttcaagactcatttatacatctaaatatacaactatgtctcaaacataaaaaaccactcaatatattgtactttttacatcattccacttgtgagaaaggggctcatctatatgttttacacaatcacccccaccacacacccaaatgttgcnaaacccntttgctgagctagtaagaaacacacacacacatacacacacagacacggatgtcatttctatgctggntt

SEQ ID NO: 9780 - DNA, 400 bp, Homo sapiens
  misc_feature 2, 5, 28, 38, 42, 63, 69: n = A,T,C or G
anttntttagggaaaaaccctgtttttngcgcgcctgnaggncgacactagtggatccaaagnaatttngcacgaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggtt

SEQ ID NO: 9781 - DNA, 345 bp, Homo sapiens
  misc_feature 17: n = A,T,C or G
ctgagattatcaataanctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaactt

SEQ ID NO: 9782 - DNA, 398 bp, Homo sapiens
  misc_feature 2, 16, 35, 56, 62: n = A,T,C or G
anggaaaaaccctgtnttttcgcgcgcctgcaggncgacactagtggatccaaagnaatttngcacgagggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaaggg

SEQ ID NO: 9783 - DNA, 301 bp, Homo sapiens
gaaaaagagaggcagagaaaaagaagagacagaggcaaaaggaaagtcaaagagaaagagacaaagtcaaagagaaaaaaaaagaaagagatatacaagtagttaagaaaaaaaagtgtaccctattcctttaaaagacaaggtaaatttaaaacctataattgatcattgaaggtattctctgtaaccctataacactccaataccaccttgttgtcactgtaaacaaggacatatcccaaaagcactgagtccttcctatcaaaaatccttaactcagtaacccgcagatggcccaaat

SEQ ID NO: 9784 - DNA, 341 bp, Homo sapiens
  misc_feature 1, 18: n = A,T,C or G
nacagtagcttaaaatcngcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatac

SEQ ID NO: 9785 - DNA, 396 bp, Homo sapiens
  misc_feature 24, 38, 385: n = A,T,C or G
ctttgggaaaaaccctgttttttngcgcgcctgcaggncgacactagtggatccaaagaattttgcacgagggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccanctccttgagga

SEQ ID NO: 9786 - DNA, 398 bp, Homo sapiens
  misc_feature 15, 20, 25, 35, 37: n = A,T,C or G
ctttgggaaaaaccnctgtnttttngcgcgcctgnangcccgacactagtggatccaaagaattttgcacgagatggagaatatttgattcttttgatgaacagtgttgcaataatttatgaaaactatcatgcgtgtgtgtctatatgggtatgtgtgtgtgtattttatatttatgaatcgtttatgcagatcgtttcaagaaaagggagtcttgtaagttaactcctaacttagtttctttggggtcctgtgggaagcattggggaaggattagatattgaagtcaaactcaaaaattttactctttagggagagacaattgcacaaaaataaatgtgatgtatagtaaagtgtaaaaactaccatttgaaaaatgcagatgatcagtggtggat

SEQ ID NO: 9787 - DNA, 195 bp, Homo sapiens
aaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatattt

SEQ ID NO: 9788 - DNA, 400 bp, Homo sapiens
  misc_feature 4, 24, 36, 61, 91: n = A,T,C or G
tctntggggaaaaaaccctgcctntggcgcgcctgnaggccgacactagtggatccaaagnaattttgcacgagagtagtttttagcattncgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagaggg

SEQ ID NO: 9789 - DNA, 312 bp, Homo sapiens
  misc_feature 209: n = A,T,C or G
aatacctgaaaggtagatacagattgcaacatgcgtttgtgattattttgactgtgcacaaaagtttatctttaaattagtagaaatagcaactataagggtggggttaaaatataaaataaacccatgggttgtcttgctgctccttaagtaacacaccagtgatgcttgtaaacactttctatagaaagtatctgtgacaatacttnaatatttggccaaaagcttataactcctagaggatggtaggaagcttgatagcatccaagctgctaaattcttaggagcctgttcgtgttaaagtacgtgagc

SEQ ID NO: 9790 - DNA, 218 bp, Homo sapiens
  misc_feature 23: n = A,T,C or G
cttcttggggaaaaaccctgttntttggcgcgcctgaaggcccgacactagtggatccaaagtaattttgcacgagctgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattatt

SEQ ID NO: 9791 - DNA, 114 bp, Homo sapiens
  misc_feature 6, 25, 45, 68: n = A,T,C or G
ctttcntgggggaaaaaacccctgncctttggcgcgcctgcaggncccgacactagtggatccaaagnaatttttgcacgagttgacaagtgtctttttgaaataaagaaccag

SEQ ID NO: 9792 - DNA, 400 bp, Homo sapiens
  misc_feature 11, 19, 63, 334, 339: n = A,T,C or G
ggaaaaaaacncccttccnttggcgcgcctgaaggcccgacactagtggatccaaagattttngcacgagctttttttaatacaatccgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgngctgngagaattgatgtttgtagattaataatcattttgtttagaattacaaaatagtttttaaat

SEQ ID NO: 9793 - DNA, 140 bp, Homo sapiens
  misc_feature 8, 10, 28, 37, 44, 67, 69, 83, 90, 93, 110: n = A,T,C or G
actacctnanaggaaaaaaaccctgacnttgggtganaatgaangccgacactagtggatccaaagnanttttgcacgagcangaagagncangaacccggtcgagcagnaaacactgaacctacctcatgcctgcctgg

SEQ ID NO: 9794 - DNA, 206 bp, Homo sapiens
ggaacaaccatactcatatttgtatttctggtacctaacactgggtcggtaatacgtactccagatgcaggccagttgcggtggttcacacctgtaatctcagcactctgggaggaggccaaggccacaggattgcttgaggccaggagtttgagaccagcccaggcaacatagcgagacccaccgccccccacccctattaaatt

SEQ ID NO: 9795 - DNA, 198 bp, Homo sapiens
  misc_feature 10, 14, 28, 36, 39, 46, 48, 72, 79, 80, 102, 105, 147, 172: n = A,T,C or G
accccctganaggnaaaaaacccctgtnccttgggnganaatgaangnccgacactagtggatccaaagtantttttgnncgaggaggaagacccaggaaanccngggagctggaagcactgaacctacctcatcctcctggagggngtggctaccctcgccaccccaaatnccatgtcaataaagaacagctaaatt

SEQ ID NO: 9796 - DNA, 272 bp, Homo sapiens
  misc_feature 20, 30, 34, 60: n = A,T,C or G
agggaaaaaccctgtttttngcgcgcctgnaggncgacactagtggatccaaagaatttngcacgagcctacgccagatccggaaccgacgcgcctaccacttggagaaagtccggctggagctgaccgagctggaggccatccgtgaggacttcctgcgtgagcgggacaccagccctgacaagggtgagctgcagctcctgtgctgaccttcaagttacgttttggaactgtaatactaaaggaagaaataaactactaatttgtataat

SEQ ID NO: 9797 - DNA, 398 bp, Homo sapiens
  misc_feature 5, 15, 59, 61, 62, 66, 68, 78, 85: n = A,T,C or G
ggaanaaaacccctnctacttggggcgctttaaagccccgacactagtggatccaaagnanntctngncgagcacatnttcatanactccccttgacattaaaatttatcatttttcctgaagccttctttttaagcccagcctatggcacctttcttctatttgcttgcatttaacccattccgtttctctgtttgtgccttttgtctctccagccagcattctctctttccatatagattgatattcattccttaaagacagacaccacaacttccatttcttatgccgttagaagtggggagcgaaactttttttcagtttttatttgactactcctgtaatgttttgagaagtcttagtcttcagaatgatggaaaagattaatcatttgcctg

SEQ ID NO: 9798 - DNA, 397 bp, Homo sapiens
  misc_feature 23, 25, 27, 37, 62: n = A,T,C or G
tctatagggaaaaaacccctgcntntngcgcgcctgnaggccgacactagtggatccaaagnaattttgcacgagctgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtatagaaaattgaatattgaaaaattgacaaattgtgtac

SEQ ID NO: 9799 - DNA, 389 bp, Homo sapiens
  misc_feature 26, 40, 42: n = A,T,C or G
ctttcttggggaaaaaaacccttctntttggcgcgcctgnangccgacactagtggatccaaagtattttgcacgagatgaagcattaccactcaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactac

SEQ ID NO: 9800 - DNA, 266 bp, Homo sapiens
  misc_feature 4, 20, 32, 64, 68, 73, 88, 90, 237, 245: n = A,T,C or G
tctnagggaaaaaacccctntacttggggcgnttttaaagccccgacactagtggatccaaagntctnttggngagctttttttcaanantccctggaaattctgacccaaaataacatgaaaagaaaaaaaggattcatacaaattggaaagaaagaaattacttacatgacacactcatgtatgaagaaagtctattaagcttctattaaaaagctactaacagccctacatatntaaggggnctgcatccactgattcaacta

SEQ ID NO: 9801 - DNA, 400 bp, Homo sapiens
  misc_feature 28, 42, 64, 70: n = A,T,C or G
cttcttagggaaaaacccctgttttttngcgcgcctgcaggnccgacactagtggatccaaagnaatttngcacgaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggtt

SEQ ID NO: 9802 - DNA, 400 bp, Homo sapiens
  misc_feature 40, 42, 73: n = A,T,C or G
ctttctttgggaaaaaacccctgtctcttggcgcgcctgnangcccgacactagtggatccaaagaatttttncacgagagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttca

SEQ ID NO: 9803 - DNA, 116 bp, Homo sapiens
  misc_feature 2, 4, 40: n = A,T,C or G
tntngcgcgcctgcaggcccgacactagtggatccaaagnaatttggcacgaggtgaaatgaactgtatggcttatttacagtatttttaattcttaataaacacttgagctttgt

SEQ ID NO: 9804 - DNA, 303 bp, Homo sapiens
tgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtc

SEQ ID NO: 9805 - DNA, 310 bp, Homo sapiens
  misc_feature 2, 19, 39, 65: n = A,T,C or G
cncttagggaaaaacctgntttttcgcgcgcctgcaggncgacactagtggatccaaagaatttngcacgagcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtct

SEQ ID NO: 9806 - DNA, 327 bp, Homo sapiens
ccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgag

SEQ ID NO: 9807 - DNA, 326 bp, Homo sapiens
acatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagc

SEQ ID NO: 9808 - DNA, 386 bp, Homo sapiens
  misc_feature 5, 17, 30, 45, 68: n = A,T,C or G
gggcnttttaaaccccngacactagggganccaattctcttgggncgagcttttaacaaaaaaccccngtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttg

SEQ ID NO: 9809 - DNA, 398 bp, Homo sapiens
  misc_feature 19, 21, 27, 37, 61, 85, 90: n = A,T,C or G
ctttgggaaaaacccctgntntttggngcgcctgaangccgacactagtggatccaaaganttttgcacgagccacaatttgcgngctcnctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaag

SEQ ID NO: 9810 - DNA, 252 bp, Homo sapiens
  misc_feature 7, 17, 33, 45, 46, 47, 48, 50, 53: n = A,T,C or G
aaactgnggggcgtttnaaaccccgacactagnggatccaaatcnnnntnggncgagggttttgagaaaaaccccgaaccagacctcatcagcccaacatcaaagacaccatcggaacagcagcgcccgcagcacccaccccgcaccggcgactccatcttcatggccaccccctgcggtggacggttgaccaccagccaccacatcatcccagagctgagctcctccagcgggatgacgccgtccccacca

SEQ ID NO: 9811 - DNA, 400 bp, Homo sapiens
  misc_feature 24, 38, 40, 92: n = A,T,C or G
cttctttgggaaaaacccctgtcntttggcgcgcctgnangccgacactagtggatccaaagaattttgcacgagcttactgtgggcccagnaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggtgagaggggccttctatcaaaatagaggactcctatgggaattgtaaggcccttggagttcattcagttcaatcccctcatttacagataaggaaaactggagccaggtgtgcttccagggcctctcaactttcacag

SEQ ID NO: 9812 - DNA, 314 bp, Homo sapiens
  misc_feature 5, 6: n = A,T,C or G
gtctnngcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctg

SEQ ID NO: 9813 - DNA, 303 bp, Homo sapiens
  misc_feature 272, 289: n = A,T,C or G
ctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaanagttgtctccctctaanagtatactattttt

SEQ ID NO: 9814 - DNA, 252 bp, Homo sapiens
  misc_feature 38, 93: n = A,T,C or G
cttctttgggaaaaaaccctgttttttggcgcgcctgnaggccgacactagtggatccaaagaattttgcacgaggccctggaacccaaagcntgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgta

SEQ ID NO: 9815 - DNA, 196 bp, Homo sapiens
  misc_feature 7, 18, 33, 48, 51, 54, 56, 61, 64, 65, 67, 69, 80, 85, 99,101, 106, 111, 143, 145, 177: n = A,T,C or G
aaggggnaaaaccccgantactggggggggttntaaaaccccgacacnagnggnanccaangtnnantngggggaggttntttanaaaaaaaccccgancnacccntggangcgaagctcaggaactgaccgcaaacgaggcngncagacctacacccgctaccagaccctggagcnggagaaagaatttcactac

SEQ ID NO: 9816 - DNA, 153 bp, Homo sapiens
  misc_feature 94, 142: n = A,T,C or G
caggtattactatttccccacactttacaagggaggaaaagaggggttggggaatttgtccacagctatgtcagtcatagagatgggatttggnaaaccagaatagcccggattccatgggcccaacacacaagagcccctnatactagaagc

SEQ ID NO: 9817 - DNA, 211 bp, Homo sapiens
  misc_feature 12: n = A,T,C or G
ggcgcgcctgangcccgacactagtggatccaaagattttggcacgaggcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcag

SEQ ID NO: 9818 - DNA, 397 bp, Homo sapiens
  misc_feature 4, 28, 38, 68, 91: n = A,T,C or G
cttntttagggaaaaacccctgtttttngcgcgcctgnaggccgacactagtggatccaaagaatttngcacgaggcggaggcctacgtcngacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttga

SEQ ID NO: 9819 - DNA, 400 bp, Homo sapiens
  misc_feature 14, 29, 71, 94, 95: n = A,T,C or G
cttctttagggaanaaaccctgttttttngcgcgcctgcaggcccgacactagtggatccaaagtaatttngcacgagtcgacattccagaaanngtcgacattactctgaagggacgcacagttatcgtgaagggccccagaggaaccctgcggagggacttcaatcacatcaatgtagaactcagccttcttggaaagaaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatt

SEQ ID NO: 9820 - DNA, 400 bp, Homo sapiens
  misc_feature 66, 89: n = A,T,C or G
ctcttagggaaaaaccctgtttttggcgcgcctgcaggcccgacactagtggatccaaagaatttngcacgagggtaactgggtgaagngaaaagagctgggcattggaatcagccaggcttagctttgaattccagccctgattctagccatataacctctttgagtttctgtctctttttctgtaaagtgagcttaatcagctgccatgcaggattagaataatattctttaagctactggcacatgatggatattcaaataatttatcaaagaaaacaaattactgatttattctgtttgtagtcctagaaaacgtggcatattttccttatttttactcttaaagaaaaatggaaaaatcagcaattggcttagcagctttactaatattgtagtt

SEQ ID NO: 9821 - DNA, 400 bp, Homo sapiens
  misc_feature 20, 22, 27, 37, 64, 91: n = A,T,C or G
cttctttgggaaaaaccctntnttttngcgcgcctgnaggcccgacactagtggatccaaaganttttgcacgagcccacagcaccccggnctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttg

SEQ ID NO: 9822 - DNA, 175 bp, Homo sapiens
ctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttc

SEQ ID NO: 9823 - DNA, 397 bp, Homo sapiens
  misc_feature 17, 25, 60, 64, 275, 286, 298, 328, 342, 359, 370: n = A,T,C or G
cttagggaaaaaccctntttttggngcgcctgaaggccgacactagtggatccaaagtantttngcacgaggagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtatngacctgtgttncccaagacagcnggtgccacggcccgccccgcctgccagccngaattcccgttctnctgtgtctactaacaangacatgggggngggcggagacctccgcatccctcagag

SEQ ID NO: 9824 - DNA, 400 bp, Homo sapiens
  misc_feature 4, 29, 37, 63: n = A,T,C or G
cttntttagggaaaaaccctgtttttggngcgcctgnaggccgacactagtggatccaaaganttttgcacgagttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattg

SEQ ID NO: 9825 - DNA, 215 bp, Homo sapiens
  misc_feature 7, 37, 68: n = A,T,C or G
cttcttngggaaaaaccctgttttttggcgcgcctgnaggcccgacactagtggatccaaagaatttngcacgaggaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 9826 - DNA, 190 bp, Homo sapiens
  misc_feature 13, 15, 41, 46, 48, 64, 165: n = A,T,C or G
actggggggcgtntnaaaccccacactagtggatccaaagntctantnggggagcgttttttanaaaaacccccaaactgacttgagtgtggcaaaaagttaacaaaaaaggagaaaaaatgaacaatcgtttgtggtttcttgggaaaacttttcataccaggngatactattcaaaaaccccgttgtc

SEQ ID NO: 9827 - DNA, 400 bp, Homo sapiens
  misc_feature 2, 22, 28, 36: n = A,T,C or G
cntcttagggaaaaaccctgtntttggngcgcctgnaggccgacactagtggatccaaagaattttgcacgagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggc

SEQ ID NO: 9828 - DNA, 398 bp, Homo sapiens
  misc_feature 20, 26, 62, 89: n = A,T,C or G
cttttagggaaaaacccctntttttngcgcgcctgaaggccgacactagtggatccaaagantttggcacgagcttgtgcttcctgtgngtggggtgagggccaaaggctatggtttcctgcctccaggagaatggagagaaagggcttccaggcccctccaagcctggggaaggacgtggcatccaagctgagccagagggaactgctgctgtcctcccttcatttctgtggaccttggaggctttggctttgtggcagggcctccccaggcagctctgggacctaggagtttgcttctgatagggtcagctttcccatttcccttcaatgcttgggaaccttctcccttagcttcacacttgccgtttcaagccctgctgggaccttgtggcttgg

SEQ ID NO: 9829 - DNA, 400 bp, Homo sapiens
  misc_feature 5, 38: n = A,T,C or G
acttntttagggaaaaaccctgtttttggcgcgcctgnaggcccgacactagtggatccaaagaattttgcacgaggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatcta

SEQ ID NO: 9830 - DNA, 396 bp, Homo sapiens
  misc_feature 20, 22, 64: n = A,T,C or G
cttcttggggaaaaaccctntnttttggcgcgcctgaaggcccgacactagtggatccaaaganttttgcacgaggttctctctcctgctcgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctcttctcaaacaatggatgacacaaaactatgagagtgacaaaatggtgacaggtagctgggacctaggctatcttaccatgaaggttgttttgcttattgtatatttgtgtatgtagtgt

SEQ ID NO: 9831 - DNA, 391 bp, Homo sapiens
  misc_feature 22, 89: n = A,T,C or G
acttcttggggaaaaacccttntttggcgcgcctgaaggcccgacactagtggatccaaagatttggcacgagacttcatatatcatgngctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtt

SEQ ID NO: 9832 - DNA, 351 bp, Homo sapiens
  misc_feature 15, 19, 27, 29, 30, 31, 32, 34, 43, 49, 55, 60, 182, 204: n = A,T,C or G
aaaccccacactagngganccaaagtncnnnntnggggagtgnttttcnaaaaanccccnattgtgtctgagagaaatgaacttcttattcagtttttatcagacttaagtttaactgcagatgggtttattggtcactacatattcaggccaaaaaaactgcctacaactacagaacagcntgtcaccaccacattccctgtnaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccaca

SEQ ID NO: 9833 - DNA, 157 bp, Homo sapiens
  misc_feature 2, 19, 32, 35, 48, 53, 65, 66, 67, 68, 102, 116, 122, 145: n = A,T,C or G
anaactggggggcgttttnaaaccccgacacnagnggatccaaagttnaactnggggagtatttnnnnaaaaaaacccccagcctgcacagctgaccacagnggggaaacggggcnggcttnggattcaggatctttgcatgganctccagaacttg

SEQ ID NO: 9834 - DNA, 396 bp, Homo sapiens
  misc_feature 3, 13, 42, 44, 62, 65: n = A,T,C or G
ggngcgcctgaangcccgacactagtggatccaaagattttngnacgagtgccagtaaaagnggncgggatgaggaaaaggtgatattcattaaaacacacaagctccttatcctaagaatccattagtactggaattaggtttgtatacagtccttccattttaatgtatacataccgcattccagttaaattagaaatgtaaaattttggcaaattccttttgtaatccaagcttaagtttcactgtttaaaaatattaataatgtcctccatctcttaaagggatatgttaaatattaaatgaataatacccataaagaactcaacacaatgcctgacctatggtaaatttataagttatagctatcattaatatttttattccatagtattt

SEQ ID NO: 9835 - DNA, 400 bp, Homo sapiens
  misc_feature 37, 67, 92: n = A,T,C or G
cttcttagggaaaaaccctgttttttggcgcgcctgnaggccgacactagtggatccaaagaatttngcacgagaaaaataccaaaataaangtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagac

SEQ ID NO: 9836 - DNA, 397 bp, Homo sapiens
  misc_feature 60, 64: n = A,T,C or G
ctttgggaaaaaccctgttttttggcgcgcctgaaggccgacactagtggatccaaagantttngcacgagttcatctgaaagaagacacctccctcccagtccacctcatttagaaaaccaaagtgtgggtagaaaccccaaatgtccaaaagcccttttctggtgggtgacccagtgcatccaacagaaacagccgctgcccgaacctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatca

SEQ ID NO: 9837 - DNA, 400 bp, Homo sapiens
  misc_feature 38, 93: n = A,T,C or G
acttctttgggaaaaaccctgttttttggcgcgcctgnaggcccgacactagtggatccaaagaattttgcacgagtgactatgtatacaganaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatc

SEQ ID NO: 9838 - DNA, 304 bp, Homo sapiens
caaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatgg

SEQ ID NO: 9839 - DNA, 398 bp, Homo sapiens
  misc_feature 2, 25, 62: n = A,T,C or G
cncttagggaaaaaccctgtttttngcgcgcctgcaggccgacactagtggatccaaagtantttggcacgagcaaaactgcaccaaacgtgtcatatatgtagaaactcatcttctacaagctatacaaagcaatcccttatctgttagaaagtaaggactaaacaaattaacaaaaggactaggatgattgaaaagatattggtgccttattatgaatgtttgccaagacatttataaataagatagagatgttaaaagaaaaaacaatgtaaattctattgcctaatgtgtacttccatttcaaatatctagttcacatattagtaggtatcattcatcttaattgggttcaagaaggctcttcactgctaatggcaaatcaatcaccatctctg

SEQ ID NO: 9840 - DNA, 400 bp, Homo sapiens
  misc_feature 18, 23, 88: n = A,T,C or G
cttagggaaaaacccctnttttntggcgcgcctgaaggccgacactagtggatccaaagattttggcacgagccacaggccccaggangcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattca

SEQ ID NO: 9841 - DNA, 117 bp, Homo sapiens
  misc_feature 7: n = A,T,C or G
gacggcncggccgagaggccttacttcatgtcttccaccctcaagaaactcttgaacaagaccaacaagaaggcagcggagtcctgaaggccccgtgctccccacctctcaaggagt

SEQ ID NO: 9842 - DNA, 397 bp, Homo sapiens
  misc_feature 18, 34, 65, 88: n = A,T,C or G
cttggggaaaaacccctntttttggcgcgcctgnaggccgacactagtggatccaaagtattttngcacgagggacaacagattcttncagatttttagactcagcctgctgtcccgcagaataataaggagctaatggcagaagtacagtatgaactaaactccaagtggagaaaactgaagaatcaactttaaaacctttttgatgagcctgttttaatccttctcctgctctgtcccaattttccgcatcaagagtgcctgcctgtggaaaccatgggtgatgcgtgaataaccatttgtggcttctgcaggaggttagttagtgcctgcgaattaacctgagctccagactgtctcaacagaaacttaagcaagtgcacataatgtttttctt

SEQ ID NO: 9843 - DNA, 100 bp, Homo sapiens
  misc_feature 7, 8, 55, 65, 70, 74, 76: n = A,T,C or G
ccctgcnntggggtgacaatagaaccgcgacactagtggatccaaagtttttggnacgagcaggnagacncagnanccgagagagctggaagcactgaac

SEQ ID NO: 9844 - DNA, 398 bp, Homo sapiens
  misc_feature 20, 63, 67, 90: n = A,T,C or G
ctcttagggaaaaacccctntttttggcgcgcctgaaggccgacactagtggatccaaagtantttngcacgagctgaagtgcaaatctnccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgattttt

SEQ ID NO: 9845 - DNA, 398 bp, Homo sapiens
  misc_feature 4, 18, 60: n = A,T,C or G
cttngggaaaaacccctntttttggcgcgcctgaaggccgacactagtggatccaaagantttggcacgagggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatc

SEQ ID NO: 9846 - DNA, 200 bp, Homo sapiens
  misc_feature 6, 134, 140: n = A,T,C or G
gcctgnaggtcccactagtggatccaaagaattcggcacgagcagatttgtaattcttcttttgggagctgagctagtgcttttaggagaacagataaatgtggtctcagccagccctagagactgcttcttgngtttgngtcattctgtcctgagaaatgaagtcatctgaaaaataaaatgaaagaaactgaattgca

SEQ ID NO: 9847 - DNA, 385 bp, Homo sapiens
  misc_feature 45, 47: n = A,T,C or G
actagtggatccaaagaattcggcacgagtactgttattagctgntnagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgctgtccagagaggctttccaatgtagctcaagtaattcctgttactttacagacaggaaagttcagaaactttaagaacaaactctgaaagacctatgagcaaatgggctgaatactttttttttaaagcccatttcattgcttaagcaaagcaggattattaagtgattattt

SEQ ID NO: 9848 - DNA, 137 bp, Homo sapiens
  misc_feature 48: n = A,T,C or G
cactagtggatccaaagaattcggcacgagagacaattgtgtgggttncaaaatattgacattgaatgggatcaatacacacacacagacatatatatatatatgcacacatatataggcagttgcatgctagcatg

SEQ ID NO: 9849 - DNA, 219 bp, Homo sapiens
  misc_feature 33, 86: n = A,T,C or G
actagtggatccaaagaattcggcacgagctgnaagaggatcttgttcgccgccagtctttaacaccagttggtgtaggagttganacctacttcacagtagttctgtggacaatcacaatgggaatccaaggagggtctgtcctgttcggctgctgctcgtctgctgcttctgcattcaggcatagcctgcagtgctacaactgtcctaacccacttg

SEQ ID NO: 9850 - DNA, 282 bp, Homo sapiens
  misc_feature 45, 48, 147, 215: n = A,T,C or G
actagtggatccaaagaattcggcacgagctcgtgccgaattcgnttngagattccaccctcaccccagaccctggtaaccactatttcactttctttctgaatttcccttcatatgaagtgggatcaaacaagagttgccttttgngtttagcattcttacttagcaagccatcaactgctcgaacagcactggggcaactacttttcgccagngcctccagaaaagaaagatctggagggcaggccactctttttcttcaaaataatggggtgcagaagg

SEQ ID NO: 9851 - DNA, 200 bp, Homo sapiens
  misc_feature 3, 5, 57, 59, 71, 92: n = A,T,C or G
tananggtccccactagtggatccaaagaattcggcacgagtgaactcccagcttantnaaaaaagaagtngttcataactgttttctgttnccacactggaaagaagctctcctcctttgacctgtcatggcacttcatttaaaattttgaaacattcttggctggcgtggtgctcacgcctgtaatttcagcactttg

SEQ ID NO: 9852 - DNA, 339 bp, Homo sapiens
  misc_feature 30, 42: n = A,T,C or G
tacacttgtaattataattaacttgggggnctctactcagangagcaaataagaacattaattgccattaaattctggtgatgttgacaatgaagcacaccttaatttcaataattaagggtatggcttctactagtttcttctgctgaagccaaagggagcattttttagtctacttcagaattcattcaagtgattttaagatgaatacctattaatgttaatgcaatacactgtacttgtaagggcaacaaaattctagaacaacagaatattatttacaactgtaaaattttaaaaaaataaattattaaatggttttataattgcacggctgat

SEQ ID NO: 9853 - DNA, 101 bp, Homo sapiens
  misc_feature 21, 45, 61, 74: n = A,T,C or G
actagtggatccaaagaattnggcacgagctattgaaatgacaanttttcatcttactgcncaatcaaaatganattgataggaatgaactcagaggctgg

SEQ ID NO: 9854 - DNA, 101 bp, Homo sapiens
  misc_feature 46, 48: n = A,T,C or G
actagtggatccaaagaattcggcacgagggggagttggggggatntnggcagatgttagccaggtctgccctccccattcaagccccttctccactgtag

SEQ ID NO: 9855 - DNA, 379 bp, Homo sapiens
  misc_feature 169, 342: n = A,T,C or G
actagtggatccaaagaattcggcacgagcctgactgaggccattttcaagaacaaggccgacttgtcacgcatgtcaggcaagaaggacctgtacctgccagcgtgttccacgccaccgctttgagttggacacagatggcaacccctttgaccaggacatctacggncgcgaggagctgcgcagccccaagctgttctacgccgaccaccccttcatcttcctagtgcgggacacccaaagcggtccctgctattcattggcgcctggccggctaagggtgacaagatgcgagacgagttatagggcctaagggtgcacacaggatggcaaggaggcatncaaagctcctgagacacatgggtgctattgggggttg

SEQ ID NO: 9856 - DNA, 276 bp, Homo sapiens
  misc_feature 46: n = A,T,C or G
actagtggatccaaagaattcggcaccgagtgccacttgagtgcgntttgcaggcactcccagagcagccatggaaggagctggcctcacaccatccacctccacactgcctcctgccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctg

SEQ ID NO: 9857 - DNA, 272 bp, Homo sapiens
  misc_feature 47: n = A,T,C or G
actagtggatccaaagaattcggcacgaggctaaccagacctcgttntgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttggtagccctcctctctgcccctgaatcaacagacagagctctgggaccttggcaatgactcagaggttggggctttctgagtaaaggggc

SEQ ID NO: 9858 - DNA, 244 bp, Homo sapiens
  misc_feature 243: n = A,T,C or G
gcctgaaggtcccactagtggatccaaagattcggcacgagtttccgcgccgccacaatggtgcgcatgaatgtcctgcagatgctctcaagagtatcaacaatgccgaaaagagaggcaaacgccaggtgcttattaggccgtgctccaaagtcatcgccggtttctcactgtgatgatgaagcatggttacattggcgaatttgaaatcattgatgaccacagagctgggaaaattggtgng

SEQ ID NO: 9859 - DNA, 135 bp, Homo sapiens
  misc_feature 38, 40, 45, 47, 50, 51, 55, 85, 93: n = A,T,C or G
tccccactagtggatccaaagaattcggcacgagcgangncgacngngannttgnatgccgagggggacggggtccccaatgaanaggacaantgcccgctggtgcgggaacccagaccagcgcaacacggacga

SEQ ID NO: 9860 - DNA, 282 bp, Homo sapiens
  misc_feature 46: n = A,T,C or G
actagtggatccaaagaattcggcacgagaaaaaaagcaaaaatgncaacagaaaaacaatcttattccgagcattccagtaacttttttgtgtatgtacttagctgtactataagtaagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttct

SEQ ID NO: 9861 - DNA, 219 bp, Homo sapiens
agtgccggcaagacagaacttcactgggggatatgtttcactcacatatttcatgatgtcttcttggaatctctaggaaccccacccaaaagaaaatcattactgctttaaccatggcatattttatattttgctacagcagtgaccctgttggcacaaagtctccctttgatttttaaaaagcatatacttccatgaacttgatcactgctttctgaa

SEQ ID NO: 9862 - DNA, 400 bp, Homo sapiens
  misc_feature 48, 354: n = A,T,C or G
actagtggatccaaagaattcggcacgagcggcacgagggaaagtttntattttatataggcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacaggtttcttacccaacacaaatggacagtggatttgctttctaaagacttttttgngggcatttggcatttggagaagaaagatggcacactaacccagata

SEQ ID NO: 9863 - DNA, 214 bp, Homo sapiens
  misc_feature 46: n = A,T,C or G
actagtggatccaaagaattcggcacgagggctaaacaaaagcttntacttgccacttcagcggggagatgagaggcaggtgcactcagctgcactgcccagagctgtgatgctctgtacatcttgtttgtagcacacttgagtttgtgtattccattgacatcaaatgtgacaattttactaaataaagaattttggagttagttacccttga

SEQ ID NO: 9864 - DNA, 236 bp, Homo sapiens
  misc_feature 4, 5, 28, 57, 73, 99: n = A,T,C or G
tganntggactcgaatggaatggcatgnaatggctcgaatagaatagaatgtaatgngcttcgaaaataatgnagtgaaatgaaatggattccgaatgnaatggctcgaaaataatggagtagaatggagtggacttgaatggaatggagtttaatggactcgaatgccaagaaatggaattcaatggaattgactgcaatggaatgtaacagaaagaaatgtctaggatggaatg

SEQ ID NO: 9865 - DNA, 225 bp, Homo sapiens
  misc_feature 42, 206: n = A,T,C or G
actagtggatccaaagaattcggcaccgagctcgtgccgaantcgtttcgagagaagaaccaactgaaaaaaaaattctcaggctttacaagcaagcaaacttcactatgatttttacaattctgattctgtatcccctgggggttatcccagttgcttctttaggatggggtttattacgttgtacatatatcccgatgtgctgngtgaatctttgcttttttg

SEQ ID NO: 9866 - DNA, 139 bp, Homo sapiens
  misc_feature 45, 48: n = A,T,C or G
actagtggatccaaagaattcggcacgagagaacatacactattnttnaataccttagagaaagattttgacctgctttagataaaactgtggcaagaaaaatgtaatgagcaatatatggaaataaacacacctttgt

SEQ ID NO: 9867 - DNA, 398 bp, Homo sapiens
  misc_feature 30, 31, 78, 79, 127: n = A,T,C or G
actagtggatccaaagaattcggcacgagnncttgacccctagatttaatgtttgtgagcctgagtttccttaaatcnnggttcagttgagaataaacattttgacaaaatagaagatttattctgntaatttttggtcttcataaacctaactaaatttgctaaaacaacaaaaactttctaatttttactagttttgttttttaaaaagttgtttccttttaagtgcataacactttaaaatgagctcagctgtattagcagataaacatgttgattcatttggccagagctactgaatgaagcttgcaggagcacagtttgttctttatgccgccaggggcagaatggttctcttctctcctccttattgagagaaggggactggaataagggct

SEQ ID NO: 9868 - DNA, 399 bp, Homo sapiens
  misc_feature 374: n = A,T,C or G
actagtggatccaaagaattcggcacgaggagccatccaacatttttctgggatgaaagacagcaagacaattgtggcaattaataaagacccagaagctccaattttccaagtggcagattatggaatagttgcagatttatttaaggtaagttcctgaaatgactgagatattgaagaaaaaatgaatcaggatcatgccttaaaaagaaaacttttgttaaagtattccactgaaatcacagatatttgtgggtattataacaatcattggaaagcatggagagctcatttcataatttgagggaaaatttctaacagatgccagaatgcttggttatgggatgctgggttccttttaattatttggggtncaaacaattatggttggaacttttt

SEQ ID NO: 9869 - DNA, 400 bp, Homo sapiens
  misc_feature 5, 44, 46, 59, 338, 383: n = A,T,C or G
gctgnaggtcccactagtggatccaaagaattcggcacgagcananatgcttatagacnggacacctggccatcaaacccagtttggcccagcctggttgggtgactttgtgggagccacttaacagctctgggtccctgttttaccatcctgggagcaaggccctgcagctccacgagacctttaccccgggaagaagccgccgccatgaaagcatttctgaagcccctttctaagacaaggctcagcatcttgatatttttgacagattcctcccaagtctgctctgggaggtatgtacccatctcaaatgttcccaagataaattcatccttcangaaatggaaatgaacttgcttactaatgtgtgattcctaagttgnagccccggatgtgctga

SEQ ID NO: 9870 - DNA, 320 bp, Homo sapiens
  misc_feature 30, 32, 45, 47, 52, 57, 103: n = A,T,C or G
actagtggatccaaagaattcggcacgagncntctctttctaatntnctganctggncagactgcaaaataaaatctggggtgttctatttatttattgtctncctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 9871 - DNA, 158 bp, Homo sapiens
  misc_feature 4, 57, 72: n = A,T,C or G
tganggtccccactagtggatccaaagaattcggcacgagcttggcctcccaaagtnttggggattacaggngttaaccactgcactgggccagaaaactatgtatttttaaaaactttttgaaatgatagctatagttcttattgcaacttcacctg

SEQ ID NO: 9872 - DNA, 181 bp, Homo sapiens
  misc_feature 47, 48: n = A,T,C or G
actagtggatccaaagaattcggcacgagaggaaatggcatggaatnnctgcctcctgtgatttgaaggccattgtgaaggaaaacaatgcagtgaaagaaagttcttcatattaggacagatatcattgcatcacatttatttatctttctgggtatttttatagcccttaataaaaaat

SEQ ID NO: 9873 - DNA, 362 bp, Homo sapiens
  misc_feature 47, 316, 354: n = A,T,C or G
cactagtggatccaaagaattcggcacgaggcaatcttggagcaagntttttgacccacccatcattatttttgtcaaccagaagaagggctgcgacgtgtttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggtggcaactatgatatggccaaaaatattgaagattacatccaccgnattggccgacgggacgagcaagcaagaatggggggggncatcacct

SEQ ID NO: 9874 - DNA, 100 bp, Homo sapiens
  misc_feature 43, 46, 55: n = A,T,C or G
cactagtggatccaaagaattcggcacgaggccgaacaggagncgntttcatggnagtggacatccgccataacaaggaccgaaagttcggcgcaaggag

SEQ ID NO: 9875 - DNA, 100 bp, Homo sapiens
  misc_feature 32, 37, 92: n = A,T,C or G
actagtggatccaaagaattcggcacgagcangagcncactgcgtttttgctgcaagccatgcttcccacagttggagagggctacggttanggaccaga

SEQ ID NO: 9876 - DNA, 300 bp, Homo sapiens
  misc_feature 45, 74: n = A,T,C or G
actagtggatccaaagaattcggcacgagagcaagagaggcatcnttaccctgaagtaccccatcgagcacggnatcggcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctggctatccctgtacgcctctggccgtaccactgg

SEQ ID NO: 9877 - DNA, 332 bp, Homo sapiens
  misc_feature 217: n = A,T,C or G
actagtggatccaaagaattcggcacgagcaagaaacatgagtgtttgtgtctgtgtgtgtgtgtctgaagagtatcacttatatgcagtgcatatacatgtaagtgcattactttgctcaaatatcttctgacctattacagtcaactcatgcatgagtgtgaacatgtattacagaaggtcttacagccttagtttctgttttaagattttatgngctgcttcctttctcaaacaaaagcatgaaaggaaagaggataagtactagaaatattcattttttttccttcacaaatctaaatgtgcttatgaaaactcatcttagagtaatg

SEQ ID NO: 9878 - DNA, 180 bp, Homo sapiens
  misc_feature 47: n = A,T,C or G
actagtggatccaaagaattcggcacgagcggcacgagcccgcgatntggtgaattcccagccccagaagtggaagttaagattgtggatgactttttcattggccgctatgtcctgctggctttccttagtgccatcttccttggaggcctcttcttggttttaatccattatgttctg

SEQ ID NO: 9879 - DNA, 400 bp, Homo sapiens
  misc_feature 45, 47, 278, 341, 356, 381, 384: n = A,T,C or G
actagtggatccaaagaattcggcacgagggtggttttcagtttntntacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggntgcaccgaaacacactggggaatggagcaaaacagtctttgaatatcgaacacgcaaggctgngagactacctattgnaagatattgcaccctatgacattgnggncctgacaagaatttgg

SEQ ID NO: 9880 - DNA, 386 bp, Homo sapiens
  misc_feature 1, 5, 374: n = A,T,C or G
ntganggtccccactagtggatccaaagaattcggcacgaggatgacgaagggaactttatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagcttgttgcagcatccagttcatcttaagaatgtcaacgattaagtcatgcaataaatgtctggntttaaaaaatac

SEQ ID NO: 9881 - DNA, 199 bp, Homo sapiens
actagtggatccaaagaattcggcacgagcatggatgggcttcctttaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 9882 - DNA, 284 bp, Homo sapiens
  misc_feature 3, 10, 57: n = A,T,C or G
tgnaggtccncactagtggatccaaagaattcggcacgagccccaactccggtatcntgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctggccttcttctacaagtttgagctgcagcatg

SEQ ID NO: 9883 - DNA, 397 bp, Homo sapiens
  misc_feature 4, 56, 58, 344: n = A,T,C or G
taanggtccccactagtggatccaaagaattcggcacgaggcgcgaggccttgcgntngggtgaacccaaggtggggtggaaggctccaacccgcccaatctgagcccgaggcctgctgagaagcatgggggccttgggatagttccagaatgaggatgtgcgtttctagctgctttgcgccctcctcccccaaaaatctgctaccacaattccaccccggcggcacgcccccaagactcctttgtcgcccaggggcgggacctgagctgcgggtttcaggagcccttcgtgacttcaaaagtctgggcactgttgctcatgagtgctgcacaactgtcgcctntaaagccacctcatccttactgggctggcttctgagccttcggtgaggaaacg

SEQ ID NO: 9884 - DNA, 271 bp, Homo sapiens
  misc_feature 4, 14, 171, 173: n = A,T,C or G
aatnactgagtctnaaaaatttcatttttacataaccaagacaatatttacaactatatacaaaagactcccacctgtgcataacctttggtccatctgtgctatctctcatatctgcaagagaaacctaaaatgttaatatttgagtgttaagtatttacatctttttgngntggtttttaaatgcacaagtacccctgaatggctcaaagggatgggataatgctagaaacactaacttgcaataaagtgcagttttcatgcaaactta

SEQ ID NO: 9885 - DNA, 278 bp, Homo sapiens
  misc_feature 31, 45, 47: n = A,T,C or G
actagtggatccaaagaattcggcacgaganaaatggcacctcgntnggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggc

SEQ ID NO: 9886 - DNA, 269 bp, Homo sapiens
  misc_feature 30, 45, 47, 79: n = A,T,C or G
actagtggatccaaagaattcggcacgagnaaaggctgattgacntncagggggatggagttggtccttgtccattctntcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattg

SEQ ID NO: 9887 - DNA, 195 bp, Homo sapiens
  misc_feature 45: n = A,T,C or G
actagtggatccaaagaattcggcacgagcagatgacaagcagcnttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaaga

SEQ ID NO: 9888 - DNA, 233 bp, Homo sapiens
actagtggatccaaagaattcggcacgaggacagcctaactttatttaccttgtgatgcagtacagggtgaaatacaaaacatcacctatctggtattctaatcaaaagtgtgggatattctataaaacaactggcctcagttctttaaaaaagttagtgcgattaaaaacaaaacggcagagaactggtctagattaagagggataaaatgcatgaagctgatcctggattt

SEQ ID NO: 9889 - DNA, 365 bp, Homo sapiens
  misc_feature 213, 281, 296, 299, 330, 345, 352: n = A,T,C or G
tgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttccgaggcccctaccacttccggcccccagccgcatnttctgcggaccgtgcgaggtatgctgccccacaaaaccaagcgaggccaggccgctctggaccgtttnaaggtgtttgacggnatnccaccgcctacgacaagaaaaagcggatggnggttctgctgccctnaaggcgngcgtttgaagcct

SEQ ID NO: 9890 - DNA, 305 bp, Homo sapiens
cccgggagcccagaggctgaggagtggggcagcccccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggccaacctgaccccactggcacttgcatcctgctgccttccaatggggctggtcaagggggaacctggccactgcctactggaatggaagg

SEQ ID NO: 9891 - DNA, 397 bp, Homo sapiens
  misc_feature 2, 4, 57, 392: n = A,T,C or G
tnanggtccccactagtggatccaaagaattcggcacgagtgatccctcagtgcatnttaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggacaggagctcttactggtgagtgcaaagagctggaaaagaagaacgaggctctnaaaga

SEQ ID NO: 9892 - DNA, 290 bp, Homo sapiens
  misc_feature 150, 242, 264, 270, 289: n = A,T,C or G
gacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccangtgagggagccacgttgcatttggaggcagactggaaaagcacatggcggccggcagcgccgagtgccaaaactacgccaaggaggtggcanggcttgaagcaacttcttctanaatctnaatcttaactcgatgccgnc

SEQ ID NO: 9893 - DNA, 109 bp, Homo sapiens
  misc_feature 45: n = A,T,C or G
actagtggatccaaagaattcggcacgagctcgtgccgaattcgntacgagaccgctaatataagtaaagtttgtaaaattcatacttaataaacaatttaggacagtc

SEQ ID NO: 9894 - DNA, 268 bp, Homo sapiens
gtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttcttcccctcaggtagcctctctccccctggccactcccgggggtgagggggttaccccttcccagtgttttttattcctgtggggctcaccccaaagtattaaaagtaagctttgtaattc

SEQ ID NO: 9895 - DNA, 314 bp, Homo sapiens
actagtggatccaaagaattcggcacgagctacggctgaccgttttttgtggtgtactccgtgccatcatgtccgtcctgacgccgctgctgctgcggggcttgacaggctcggccggcggctcccagtgccgcgcgccaagatccattcgttgccgcggaggggaagcttgggatcatggaattggcgttgggcttacctcctgcttcgtgaccttcctcctgccagcgggctggatcctgtcacacctggagacctacaggaggcagagtgaaggggtccgttctgtccctacactgtgacctgaccagccc

SEQ ID NO: 9896 - DNA, 248 bp, Homo sapiens
  misc_feature 31, 39, 49, 51, 61, 62, 86, 114, 115: n = A,T,C or G
actagtggatccaaagaattcggcacgagcnggcgtganctatttttcntncacttgccgnntcagaatctaaacgtggtgccttngagtagagaggcccgccgcccaccgtgnncagtgccacccgcagatgacacgcgctctccaccacccaacccaaaccatgagaatttgcaacaggggaggaaaaaagaaccaaaacttccaaggcctgctttttttcttaaaagtactttaaaaaggaaatt

SEQ ID NO: 9897 - DNA, 355 bp, Homo sapiens
  misc_feature 7, 288, 309, 342: n = A,T,C or G
atccttnagcactcggtcatgtacccggtggactcggtgaagacacgaatgcagagtttgagtccagatcccaaagcccagtacacaagtgtctacggagccctcaagaaaatcatgcggaccgaaggcttctggaggcccttgcgaggcgtcaacgtcatgatcatgggtgcagggcagcccatgccatgtattttgctgctatgaaaacatgaaaaggactttaaatgacgttttccaccaccaaggaaacagcacctagccaacggtatttttgaaagcgtttgnctggaagttagaaaagttctnttcttcaacacgtccttcccaagggtgttcctncttgtgacccagc

SEQ ID NO: 9898 - DNA, 318 bp, Homo sapiens
  misc_feature 2, 4: n = A,T,C or G
tnanggtccccactagtggatccaaagaattcggcacgaggtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaat

SEQ ID NO: 9899 - DNA, 261 bp, Homo sapiens
  misc_feature 45, 48, 80: n = A,T,C or G
actagtggatccaaagaattcggcacgagccgaaaggaaagaagnttnagggaaagaaggtggctccggccccagctgtngtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctg

SEQ ID NO: 9900 - DNA, 139 bp, Homo sapiens
  misc_feature 4, 131: n = A,T,C or G
tggncggcccgggagcccagaggctgaggagtggggcatgcccccatggaggcctgcaggaggtgggaggcactgtcagggtctgtccacagtgggtctgtgccaggtctcccgccggtggaaactgttgncttccatg

SEQ ID NO: 9901 - DNA, 399 bp, Homo sapiens
  misc_feature 45, 47, 56, 80, 297, 322, 379, 392: n = A,T,C or G
actagtggatccaaagaattcggcacgaggtttctcggttccatntnatccatttncttttcaatggagactacagcgtnagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgccctgcaaagagtgactgtgcttgaagcagagcactcacacataaatggctgngtgtggaattgcttgccaaagaagnttctagcctttccctttccctaactgcatcagggaagaatcttatctctagcttggnttccacatgaggntttctga

SEQ ID NO: 9902 - DNA, 265 bp, Homo sapiens
  misc_feature 48, 80, 191, 219, 248, 257, 263: n = A,T,C or G
cactagtggatccaaagaattcggcacgagtcttaatgaattgacttntctaggtaccttggatacgtagaaggattttntttttcttttggagacagagtttcggtcttattgcccgggctggagtgcaatggcgcgatctcggcctactgcaaactccgcctcctgggtttaagcgattctcctgcctnagcctcctgaatagctgggattacaggngaccgccaccatgcccggtaattttttgnatttttagnagagangg

SEQ ID NO: 9903 - DNA, 109 bp, Homo sapiens
actagtggatccaaagaattcggcacgagcttgaatatctgtaattcagtttcaaaaactttaactgccagcgagaattgacaagattttcttgattatgtttctatgc

SEQ ID NO: 9904 - DNA, 321 bp, Homo sapiens
  misc_feature 33: n = A,T,C or G
actagtggatccaaagaattcggcacgagcagnagcccactgcgtttttgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcggctgcggcatatatgaaaacttgctccgcgcggcccctttgcgggatgtttccattgcttcatgttcaataaacaaaagg

SEQ ID NO: 9905 - DNA, 309 bp, Homo sapiens
  misc_feature 70: n = A,T,C or G
actagtggatccaaagaattcggcacgagattttcaaaaagttatttctgtgaagaaagctgagaagtanatcatagcttaaaggaaatgctgggactaaggagtcttcttgttattgtttcagttgtggtttctaacttggaaaccttatggcaagcctatggactgatatatacagaggtgtatattcaatatgcagaagagaaaaaggaatacttgaaaaaaacaaagtctttaaaaatgtgggatggcatccaaacccagaaggtgttccagcttattcacttgaaaaggaggggactagatagg

SEQ ID NO: 9906 - DNA, 304 bp, Homo sapiens
actagtggatccaaagaattcggcacgagcgcgcggtgaggttgttttagtccacgctcggagccatgccgtccaagggcccgctgcagtctgtgcaggtcttcggacgcaagaagacagcgacagctgtggcgcactgcaaacgcggcaatggtctcatcaaggtgaacgggcggccctggagatgattgagccgcgcacgctacagtacaagctgctggagccagttctgcttctcggcaaggagcgatttgctggtgtagacatccgtgtccgtgtaaagggggggggcacgtggcccaga

SEQ ID NO: 9907 - DNA, 259 bp, Homo sapiens
  misc_feature 4, 29, 54, 58, 65, 72: n = A,T,C or G
tgtntgcctggaaagcaaggtagcaacangtaaaatgggagaggagtggggggnactnacttgcntactctnttgcctgatttaaccagcatttttcaaccctgggaaaatttgcaggaatctaagttgattgtaatgattttgagctgcagcagctttaactcttaccctttttcccatagttatggtgtttgagttggaaagaaacaactataggtagctcacgacataattatctctttattccaaagggtatagt

SEQ ID NO: 9908 - DNA, 231 bp, Homo sapiens
actagtggatccaaagaattcggcacgagctgccctgaaggatgtttgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttg

SEQ ID NO: 9909 - DNA, 271 bp, Homo sapiens
  misc_feature 45, 46: n = A,T,C or G
actagtggatccaaagaattcggcacgagggcggatcgtccccannttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtg

SEQ ID NO: 9910 - DNA, 242 bp, Homo sapiens
  misc_feature 47: n = A,T,C or G
actagtggatccaaagaattcggcacgagggcatctacggctcattnttttttgtagccacaggcttccacggacttcacgtcattattggctcaactttcctcactatctgcttcatccgccaactaatatttcactttacatccaaacatcactttggcttcgaagccgccgctgatactggcattttgtagatgtggtttgactatttctgtatgtctccatctattgatgagggtctt

SEQ ID NO: 9911 - DNA, 249 bp, Homo sapiens
gctgtactggagccacccgcgaaaattcggccagggttctcgctcttgtcgtgtctgttcaaaccggcacggtctgatccggaaatatggcctcaatatgtgccgcagtgtttccgtcagtacgcgaaggatatcggtttcattaagttggactaaatgctcttccttcagaggattatccggggcatctactcaatgaaaaaccatgataattctttgtatataaaataaacatttgaaaaaaccctt

SEQ ID NO: 9912 - DNA, 280 bp, Homo sapiens
  misc_feature 33, 48: n = A,T,C or G
actagtggatccaaagaattcggcacgaggcancagcaggaggccgtntgatgcctggagttactgtaaaagacgtgaaccagcaggagttcgtcagagctctggcagccttcctcaaaaagtccgggaagctgaaagtccccgaatgggtggataccgtcaagctgccaagcacaaagagcttgcccctacgatgagaactggttctacacgcgagctgcttccacagcgcggcacctgtacctccggggtggcgctggggttggctccatgaccaaga

SEQ ID NO: 9913 - DNA, 244 bp, Homo sapiens
  misc_feature 32, 45, 65, 78, 79, 244: n = A,T,C or G
cactagtggatccaaagaattcggcacgagcntaggaggcaccantttggcagatgcccactggngccatgacctttnngtcttcaccatatagcttcatcttctccatggttggtctgtactacatcaacaagatctcctccaccctgtaccaggcagcagctccagtcctcacaccagccaaggtcacaggcaagagcaagaagagaaactgccctgaatgtcaataaagttgattctttgn

SEQ ID NO: 9914 - DNA, 226 bp, Homo sapiens
  misc_feature 45, 47, 79, 80: n = A,T,C or G
actagtggatccaaagaattcggcacgaggtttttggtgccctgntnggagctgtggatggaggcttgtctatccctgnnagtaccaaacgattccctggttatgattctgaaagcaaggaatttaatgcagaagtacatcggaagcacatcatgggccagaatgttgcagattacatgcgctacttaatggaagaagatgaagatgcttacaagaaacagtctct

SEQ ID NO: 9915 - DNA, 199 bp, Homo sapiens
  misc_feature 32, 34, 35, 55: n = A,T,C or G
tgaggtcccagctccatcccctagttgcaggngnnatcaccatggttaccatagngacttgcttcattgccatggttacatactaattgctgcagctctgtggcccagcccactgcttcagctgtgggccatctgagggtacgtgccatcatctctccagcccaggcccctggcatctcatgctggggggaagggactg

SEQ ID NO: 9916 - DNA, 224 bp, Homo sapiens
  misc_feature 54, 81, 87, 219: n = A,T,C or G
taaaggtcccactagtggatccaaagaattcggcacgagcggcacgagtgacanttggtgcgcctgcccgggaacatcctnctgganggagtcatggcttgtggctggcgccagcaacctgaatctcaaacctggagaagtgccttcgagtgcgaggcgaggtggctcctgacgctaagagcttcgtgctgaacctgggcaaagacagcaacaacctgngcctg

SEQ ID NO: 9917 - DNA, 341 bp, Homo sapiens
  misc_feature 44, 45, 78, 80: n = A,T,C or G
cactagtggatccaaagaattcggcacgaggaaacccttaagannttcgaaggaatttcgcagagctgaagatcaagngnctgagaaagaagtttgcccaaaagatgctttcgaaaggcaaggaggaagcttatctatgaaaaagcaaagcactatcacaaggaatataggcagatgtacagaactgaaattcgaatggcgaggatggcaagaaaagctgcaacttctatgtacctgcagaacccaaattggcgtttgcatcagaatcaagaggtatcaatggagtgagcccaaaggttcgaaaggtgttgcagcttcttcgcttcgcaaatcttcaatgg

SEQ ID NO: 9918 - DNA, 197 bp, Homo sapiens
  misc_feature 130, 139: n = A,T,C or G
atggcacagagccgtggtcattgttgctggggcaaagaagaaaaccatctgagttctaactccttggttgcttaaaagtagttcccaagagtctgagaagctatttctatttttaagagtcattttttgnaatttttgnaaaacaaaagtaccaatctgttttgtaaataaaaatcatcctaaaatttgaaggtttt

SEQ ID NO: 9919 - DNA, 105 bp, Homo sapiens
  misc_feature 30, 33: n = A,T,C or G
tgtaagtacttataacatggtgtatctttnggnttatgaatattctgtattataaccattgtttctgtagtttaattaaaacattttcttggtgttagcttttct

SEQ ID NO: 9920 - DNA, 370 bp, Homo sapiens
  misc_feature 45, 48, 78, 79, 82, 240, 325: n = A,T,C or G
cactagtggatccaaagaattcggcacgagaaaacatgtgggcanttnaattatatataaaaatgaaatatttgatannggntggaccacagattaaaggagagggaaaatgttttgcaatatatgggctaatggaaaaaaaaaatcagcttttacactcattatgtacataaaatacattatgcaaactaaaaccttaggaagctaacgagactttattttataggcttaaaacattgnaacaaaattgcaaagggacagtaaaatagatttgattatattaaacacttgattagttaaaacaacaatgtaacaagcaaagggnggcctatgtgcaattgcaattatttgacctaataacaaagagttg

SEQ ID NO: 9921 - DNA, 229 bp, Homo sapiens
  misc_feature 45, 71: n = A,T,C or G
cactagtggatccaaagaattcggcacgagatttgaaggacctantttcgtagcaaattctgtggcagttntaaaaagggggagctgctatagtaagttactgggcattctcaatacttgaatatggaacatatgcacaggggaaggaaataacattgcactttataaacactgtattgtaagtggaaaatgcaatgtcttaaataaaactatttaaaattggcaccat

SEQ ID NO: 9922 - DNA, 297 bp, Homo sapiens
  misc_feature 48, 78, 197, 258, 261: n = A,T,C or G
cactagtggatccaaagaattcggcacgagccagactagtgccttttntctgaaagcgctgacacacaatggcacgcngggaaacgccatctagtctgaatcccagcgtcggggctctgtgccagcttactcttcactccagggtcggatgccacgtgctacaggacatgggagctgctgcttggggggaatctggngcctgtccactagagacaaggggtagaggttctcatttggatgaaaaccccttcaactggnggnggacaactgaagctactatatctttttgaaaatggc

SEQ ID NO: 9923 - DNA, 198 bp, Homo sapiens
  misc_feature 45, 78, 81, 188: n = A,T,C or G
actagtggatccaaagaattcggcacgagcggcaccgagtatttnttcttttttttttagctatttactgtactttanggntaaaacaaagtcacttttctccaagttgtatttgctatttttcccctatgagaagatattttgatctccccaatacattgattttggtataataaatgtgaggctgntttgcaaact

SEQ ID NO: 9924 - DNA, 227 bp, Homo sapiens
  misc_feature 45, 79, 80: n = A,T,C or G
cactagtggatccaaagaattcggcacgagcctgtattggattgnttcacggctcacattgcatgcaagtttgctgagnngaaggaaaagattgatcgccgtctggtaaaaagctggaagatggcctaaattcttgaagctggtgatgctgcattgttgatatggtcctggcaagcccatgtgtgttgagagcttctcagactatccacctttgggtcgctttgctg

SEQ ID NO: 9925 - DNA, 400 bp, Homo sapiens
  misc_feature 45, 48, 79: n = A,T,C or G
cactagtggatccaaagaattcggcacgagccagactgaggaagnttnggaaacttaggggccacgtgagccacggccnggggtcgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgccaactgtcaaccttgacaaattgtggactttggtcagtgaacagacacgggtgaatgctgctaaaaacaagactggggctgctccatcattgatgtggtgcgatcggggctactacaaagtctgggaaagggaaagctccaaagcagcctgtcatcgtgaaggcca

SEQ ID NO: 9926 - DNA, 109 bp, Homo sapiens
cactagtggatccaaagaattcggcacgagctgttggcccgggccgtagaagaaggctgctggcaaaggggacgtcccagcgaagagaccacctgtccttcgagcagga

SEQ ID NO: 9927 - DNA, 123 bp, Homo sapiens
  misc_feature 4, 5, 56, 57, 58, 92: n = A,T,C or G
ctgnnggtccccactagtggatccaaagaattcggcacgaggttgggggccgtccnnntcctaaggcaggaagatggtgggcccgcaaagangacgaaaaagtcgctggagtcgatcaactct

SEQ ID NO: 9928 - DNA, 400 bp, Homo sapiens
  misc_feature 47, 55, 79, 80, 122, 171, 179, 210, 379: n = A,T,C or G
cactagtggatccaaagaattcggcacgagcgagccttgtatgtatnttatgganacataaaatgcacgcaagccatgnnctctccatgggaagctaagttataaaaataggtgcttggggnacaaaactttttatatcaaaaggctttgcacatttctatatgagtgggnttactggnaaattatggtattttttacaactaattttgnactctcagaatggttgcatatgcttcttgcaatgcatattttttaatctcaaacgttcaataaaaccatttttcagatataaagagaaatacttcaaattgaggaattcagaaaaactcaagaattaagttaaaaagggggttggacttgggaacaggctttatacctntttactggacaagactcatta

SEQ ID NO: 9929 - DNA, 165 bp, Homo sapiens
  misc_feature 45, 48, 78, 82: n = A,T,C or G
cactagtggatccaaagaattcggcacgagggattgtaatatganttnatttaaaagggcttcgctcatatataggangggncgcatatgggtcctagtattaaattcttattgcttactgatttttttgagttaagagttgttatatgctagaatatgaggatg

SEQ ID NO: 9930 - DNA, 110 bp, Homo sapiens
  misc_feature 30, 32: n = A,T,C or G
tggattttgtttatttttttagctcatttngnggggtgggaatttttttttaatatgtgtcatgaataaagttgtttttgaaaataaaaattgtttgccttttgggtgta

SEQ ID NO: 9931 - DNA, 198 bp, Homo sapiens
  misc_feature 77, 79: n = A,T,C or G
actagtggatccaaagaattcggcacgagcggacctggagcttttttgcggtggcttcactctcctgtaaaacgctngngcggcgagttgttacctgcgtcctctgacctgagagcgaaggggaaagcggcgagatgactgaccgctacaccatccatagccagctggagcacctgcagtccaagtacatcggcacgg

SEQ ID NO: 9932 - DNA, 153 bp, Homo sapiens
  misc_feature 30, 33, 34, 45, 73, 76, 153: n = A,T,C or G
tacatagcagcggttcctgtcatgtgttcnggnnagaatattttnggttttaaactttcttattgcctttggntgnggattaagtacagtacaagtgcgatttcaaaaagatcttgaaagtaatatatttaatcaattaaaatgtttatctgn

SEQ ID NO: 9933 - DNA, 386 bp, Homo sapiens
  misc_feature 46, 47, 79, 259, 268, 311, 375: n = A,T,C or G
cactagtggatccaaagaattcggcacgagctcgtgccgaattcgnnacgagagaatattatgactatggacatggggngggttcaagattcttatgaagcttatggccaggacgactggaatgggaccaggccgcgctgaaggcccctcctgctaggccagtgaagggagcatacagagagcacccatatggacgttattaaaaacaaacatgaggggaaaatatcagttatgagcaaagttggtactgatttcttgnatctcccangattcctggtgctttacccacaacagacaagtaattgctaagngttttcttcggggccccttcttctcccaccttattccattcttactctgcattctggcttctgnatgtagtattt

SEQ ID NO: 9934 - DNA, 328 bp, Homo sapiens
  misc_feature 48, 81, 301: n = A,T,C or G
cactagtggatccaaagaattcggcacgagggcagtgggggtggtttnttcggggacaatctggtcacccgctcctacgtnctgggcaactccagcccccgaacccagagcccccagaactgcagcatcatgtaatctgggacctgccaggcaggggtgggggtggaggcttctgcgtcctcctcacctcatgcccaccccctgcctgcacgtcatgggagggggcttgaagccaaagaaaaataaccctttgtttttttcttctggatttttttttctaagaaaagttattttctacagngggtttatctgaaggaaaaacacaagc

SEQ ID NO: 9935 - DNA, 322 bp, Homo sapiens
  misc_feature 20, 33, 45, 46, 49, 60, 75, 77, 82, 84, 101, 125, 134, 173,287, 292: n = A,T,C or G
cactagtggatccaaagaantcggcacgagcgnggacaaaatccnnttnaagaaatgaanccaggcatttacagnanggggngntgaaatgatctttaatnacaatttgggagcaaaaataatgngactgcagncaaaccctcccctcacaagcctgtccctgacagctttgntactgcctgcagtgctgacagggctccgcaccctgtctttcaccctccttagcagcaatggtcttctggctcaacttacctaactgagaaatgggacaggccccactgaagggncctgnaagtactggacacaggagctgcttggagat

SEQ ID NO: 9936 - DNA, 265 bp, Homo sapiens
  misc_feature 30, 32, 33, 203, 206, 228: n = A,T,C or G
atttgaaggtacgagtagaggtttaaagangnntcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgnagncttatgaatagacataaattgnaatttgggaccataaaaactctgaataaatcatgtgg

SEQ ID NO: 9937 - DNA, 272 bp, Homo sapiens
  misc_feature 47, 77, 80: n = A,T,C or G
actagtggatccaaagaattcggcacgagaagaactgaaactgtttncccagctgaccggaccggtcatgcccgtcnggnacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcaagtcggc

SEQ ID NO: 9938 - DNA, 221 bp, Homo sapiens
  misc_feature 51, 79, 82, 209: n = A,T,C or G
actagtggatccaaagaattcggcacgagctcgtgccgcgcgattttgggngctggcggctgcagcccggagttcaaanggnagcagctggaaggaaccatggccaactgtgagcgtaccttcattgcgatcaaaccagatggggtccagcggggtcttgggggagagattatcaagcggtttgagcagaaaggattccgcttggtggnctgaaattcatg

SEQ ID NO: 9939 - DNA, 157 bp, Homo sapiens
  misc_feature 45, 48, 80, 81: n = A,T,C or G
cactagtggatccaaagaattcggcacgagggcgtacccggggcnttntggcgccggcggcgggtactacccaggcgggnntggaggggctcccggagggcctgcgtttcccggacaaactcaggatccgctgtatggttactttgctgctgtagct

SEQ ID NO: 9940 - DNA, 158 bp, Homo sapiens
  misc_feature 40, 44, 50, 51, 55, 57, 69, 77, 79, 114, 115, 118: n = A,T,C or G
actagtggatccaaagaattcggcacgagccggctcggancacnttgcgnnccgngntagactcaactnagctgctngnacgctaatatttccggcaaaaatcccatgcttggnnttngtctttaaccttgtaacgcttgcaatcccaataaagcatt

SEQ ID NO: 9941 - DNA, 141 bp, Homo sapiens
  misc_feature 70, 73, 75, 140: n = A,T,C or G
cactagtggatccaaagaattcggcacgagcaagattggagagatttgggaccgtcagggagaaaatggnccngngaggggctgcacatgtcttgggaacggaaaaggagaattcaagtgtgaccctcatgaggcaacgng

SEQ ID NO: 9942 - DNA, 174 bp, Homo sapiens
  misc_feature 45, 46, 148, 158: n = A,T,C or G
actagtggatccaaagaattcggcacgaggccatcttagcggctnntgttggttgggggcccgtcccgctcctaagggggggaagatgggtggccgcaaagaagacgaaaaagtcgctggagtcgatcaactctaggctccaactcgntatgaaaagngggaagtacgtcctgg

SEQ ID NO: 9943 - DNA, 258 bp, Homo sapiens
  misc_feature 42, 45, 46, 47, 78, 92, 165, 203, 231, 251: n = A,T,C or G
cactagtggatccaaagaattcggcacgagccgtgacgtctncannnagaggaagttctccagagttcacctttcccnggggcttgagttgngctgaatgccccaccccagctctctttcccttctgggtgtctttgctgggagggggctcactgcttgcactgngcttagggtagggatgggaaatatcctccctgcatggntttatcctcctctcatcccaaagcaggnatcttctgggtgcacagagnttcattg

SEQ ID NO: 9944 - DNA, 168 bp, Homo sapiens
  misc_feature 78, 80: n = A,T,C or G
actagtggatccaaagaattcggcacgagaagaaatttgaaaaatttttctctttgccatttcttcttcttctttttngnctgaaagctgaatccttccatttcttctgcacatctacttgcttaaattgtgggcaaaagagaaaaagaaggattgatcagagcattg

SEQ ID NO: 9945 - DNA, 400 bp, Homo sapiens
  misc_feature 351, 355: n = A,T,C or G
cactagtggatccaaagaattcggcacgagaaaaccgtgaagaatttggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagnctgnccaaccttcaggcactcagcctacaggtgggatgaatttcaaaac

SEQ ID NO: 9946 - DNA, 189 bp, Homo sapiens
  misc_feature 44, 77: n = A,T,C or G
cactagtggatccaaagaattcggcacgagggaaaaccgatggntttctggcccccaaggctggtcccccagggaangggcagcccttcaagaggagcttagtgacgtcctcatctacctggtggcattagcagcccgctgccgtgtggatctgccgctagcagtgctccccaaaatggacatcaaccg

SEQ ID NO: 9947 - DNA, 237 bp, Homo sapiens
  misc_feature 43, 78, 229: n = A,T,C or G
ctagtggatccaaagaattcggcacgagggtgggtacatgacnttgggcattggtcaaaacccatagcatgtacaggncaaagcgtttgctctaatgtgagctatggactttagttaatagtaacgtgtcaatattggttcatcagttgtatcaaatgtaccacactgatgccagatgttaataatcggggaaactgtgtgtgctgaagagtacgtgggagctctctgngctatctg

SEQ ID NO: 9948 - DNA, 293 bp, Homo sapiens
  misc_feature 30, 77, 98, 104, 125, 137, 140, 254, 256, 259: n = A,T,C or G
actagtggatccaaagaattcggcacgagntcgtgccggtctctatttccttcagttctgctctgatcttagttatnggttgctttctgctagctttngaatgngtttgctcttgcttctctagntcttttaattgnganattagggtttcaattttagatctttcgtgctttctcttgtgggcgtttagtactataaatttccctctacacactgctttaaatgtgcccagagattctgctatgttgggctgngntcncattggtttcaaagaacatctttatttctgcctg

SEQ ID NO: 9949 - DNA, 326 bp, Homo sapiens
  misc_feature 46, 258, 308, 325: n = A,T,C or G
cactagtggatccaaagaattcggcacgagcttgggatgaagctgnttatcaaggaagacttgtccaggttcctcagttggattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgntattttgtagatgaaaaaactttctggggacctcttgaattacatgctgnaacatatgaagtgatgng

SEQ ID NO: 9950 - DNA, 222 bp, Homo sapiens
  misc_feature 36, 39, 42, 45, 81: n = A,T,C or G
cactagtggatccaaagaattcggcacgagggaagnctnaanatnttttgtaggaaaattgtaaataattgttaggggggnaggtaatggagcaagtttaagcccattgtctaatttcttttaaagcacagactctctaaacattgaattttaattgaattcgggaggcagaaggaaaaaatacattctatgatgtaaaaaaaaaattctgggctgtttaga

SEQ ID NO: 9951 - DNA, 315 bp, Homo sapiens
  misc_feature 77, 78, 217, 311: n = A,T,C or G
cactagtggatccaaagaattcggcacgaggaaagcatatgaatgttccgctgtggaaaagcctataggcatgattnntgctttaaaaaacatcagagacatcacactggagaaaaaccttacgaatgtaacgaatgtggaaaagccttcagctataactcttcacttagtcgacatcatgaaatacacaggaggaacgccttccgaaataaggtgnaaaaacagatatttgacttgagaacaaaagccaagtgtaaattggtgatttagagtgctttaaaatttcaggctcagatatgaggaattgatgnaatg

SEQ ID NO: 9952 - DNA, 327 bp, Homo sapiens
  misc_feature 47: n = A,T,C or G
cactagtggatccaaagaattcggcacgagctcacatcgtgcggttntcgacaggccgggatccaaggtgaacaagagggaggtggtggaggctgtgaccattgtagagacaccacccatggtggttgtgggcattgtgggctacgtggaaacccctcgaggcctccggaccttcaagactgtctttgctgacacatcagtgatgaatgcaagaggcgtttctataagaatggcataaatctaagaagaaggctttaccaagtactgcaagaaatggcaggatgaaggatgcaagaagcagctggagaaggcttcagcagcatgaag

SEQ ID NO: 9953 - DNA, 294 bp, Homo sapiens
  misc_feature 45, 48, 78, 79, 81: n = A,T,C or G
cactagtggatccaaagaattcggcacgagcggcacgagggaagnttnattttctaaccaagcagatggagaaaatcnngncagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcag

SEQ ID NO: 9954 - DNA, 273 bp, Homo sapiens
  misc_feature 32, 35, 47, 77: n = A,T,C or G
actagtggatccaaagaattcggcacgagaanaangaaatggttttnagaatctagtaaaaagaaaaagattgagcnggctcctgaatttgcaattttgaatgctttatctccaccttctatcaactgctttgagtaaataaaatttggaagtccacatttcttccctaactttctgaaagccagcatagcatggtggccagagctcagatttggagccagggtgccagtgctcttggtcccagctccatcactttctagttgaatgatcttg

SEQ ID NO: 9955 - DNA, 256 bp, Homo sapiens
  misc_feature 77, 79: n = A,T,C or G
actagtggatccaaagaattcggcacgagctcgtgccgaattcttttcgagggtgggtgagtgagcacagcttcatngngtatttacagctgctccccagagcttgcattactgcctgagctctacctcccgtcaggtcagcagcagcattagagtctcatgggagtgcgaaccctgttgtgaactgcacatgcgagggatctaggttgtgcactccttatgagaatctaatgcctgatgaatctaatgcctcatg

SEQ ID NO: 9956 - DNA, 105 bp, Homo sapiens
cactgtggaggaggtggatgcagctatgaggggcaaggccacacaaggtggatggaagagttgtggaaccaaagagagctgtctccagagaagattctcaaagac

SEQ ID NO: 9957 - DNA, 377 bp, Homo sapiens
  misc_feature 45, 48, 77, 78, 289: n = A,T,C or G
cactagtggatccaaagaattcggcacgaggctgccgaaatgggnttnttcatgaaacctgggaaggtggtgcttgnngtggctggacgctactccggacgcaaagctgtcatcgtgaagaacattgatgatggcacctcagatcgccctacagccatgctctggtggctggaattgaccgctacccccgcaaagtgacagctgcatggcaagaagaagatcgccaagagatcaaagataaaatcttttgtgaaagtgtataactacaatcacctaatgcccacaaggnactctgtggatatccccttgacaaaactgcgtcaataaggatgcttcagagatcctgctcttaaacgcaaggcccgcgggaggccaag

SEQ ID NO: 9958 - DNA, 247 bp, Homo sapiens
  misc_feature 35, 233: n = A,T,C or G
tagcagacaatgtgggctccaagcagatgcggggngatccgcatgtcccttcgcgggaaggctgtggtgctgatgggcaagaacaccatgatgcgcaaggccatccgagggcacctggaaaacaacccagctctggagaaactgctgctcatatccgggggaatgtgggctttgtgttcaccaaggaggacctcactgagatcagggacatgttgctggcaataaggtgccanctgctgccgtgctg

SEQ ID NO: 9959 - DNA, 209 bp, Homo sapiens
  misc_feature 28, 32, 192: n = A,T,C or G
cttcactgatcacccaggtgatgggacngggngtctaggctctttgtatgggggctttgtgacatagctctgcactgaacacacaggtgatgtaacacttgactaggctctgctatggggcataatgacatatcactgcattgatcaccgaggtgatataactcttgccaggctctgctatagaggccttgngacatacctctgcactg

SEQ ID NO: 9960 - DNA, 309 bp, Homo sapiens
  misc_feature 51, 71, 78: n = A,T,C or G
actagtggatccaaagaattcggcacgagctaaatcacaaatactttactnaatttagtttttaaaatagnaaactgngtatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgcaacagttttg

SEQ ID NO: 9961 - DNA, 327 bp, Homo sapiens
  misc_feature 78, 80: n = A,T,C or G
cactagtggatccaaagaattcggcacgagaaatgtttgagctttttaaatactttgttaaaacatgaatccattttngnaattgtataaatactcataactaattttgaatgctactgattgtgtaactgaatttttgtatccaaaaatacattcttgagtactacttttcctaccttgaaaatctatttcatttactaaatattgttttctttatgctaacttaactttaaaaggaatgttgcaagctgtctctcctcccccatcacaattgttagttttttttgctttctttcttcaataaatgatagcattatgatctttaat

SEQ ID NO: 9962 - DNA, 289 bp, Homo sapiens
  misc_feature 9, 48, 49, 79, 82, 219, 280: n = A,T,C or G
cccactagnggatccaaagaattcggcacgagcgccatcctgcgtctnnacctggctggccgggacctgaccgactacnggntgaagatcctcactgagcgaggctacagcttcaccaccacggccgagcgggaaatcgtgcgcgacatcaaggagaagctgtgctacgtcgccctggacttcgagcaggagatggcaccgccgcatcctcctcttctntggagaagagctacgagctgccgatggcaggtcatcaccattggcaatgagcggttccggngtccggagg

SEQ ID NO: 9963 - DNA, 201 bp, Homo sapiens
  misc_feature 44, 48, 50, 79: n = A,T,C or G
cactagtggatccaaagaattcggcacgaggaacaaatggcacntttngntcgcgcacctaaggaagcctttggcaccngggtccattggtcggcccggtccagctggcccccctgggcccccaggacccccaggctccattggtcaccctggcgctcgaggaccccccggataccgcggtcccactggggagctgggaga

SEQ ID NO: 9964 - DNA, 225 bp, Homo sapiens
  misc_feature 45, 79, 80: n = A,T,C or G
cactagtggatccaaagaattcggcacgagagataataaagtttnttaggaaaaatgggcaagatgaatgtttgatacnnttaccaaaaatttatatttcatttacttgctgatttccctgaaaactcaatttgttgaagaagcaacatgctgtactaattactgtgtattactattcacacacaagtgtttaatgaattttacttgtaattctttaaatttttg

SEQ ID NO: 9965 - DNA, 233 bp, Homo sapiens
  misc_feature 77: n = A,T,C or G
actagtggatccaaagaattcggcacgagctgacttgaaactttttcctaaatagagtcttgatttgcacttatttnggttaatatagcaaaagaatttgggaagtatttaaaaggtataaacttgtaagaagtttgaattttattggaactatttgggcaggatgtgcttgtttgagaaatctagatttaaatcagtgctatactagtatcctccaggggttttataaaatg

SEQ ID NO: 9966 - DNA, 243 bp, Homo sapiens
  misc_feature 44, 230: n = A,T,C or G
actagtggatccaaagaattcggcacgagagcccctttcaagcntttcactcgcaaaagtgttgggcatcgcatggggggaggcaaaggtgctattgaccactacgtgacacctgtgaaggctgccgcttgttgtagagatgggtgggcgttgtgaatttgaagaagtgcaaggtttccttgaccaggttgccacaagttgccttcgcagcaaaggctgtgagccgcggnactctagagaaga

SEQ ID NO: 9967 - DNA, 253 bp, Homo sapiens
  misc_feature 77, 80: n = A,T,C or G
actagtggatccaaagaattcggcacgagctcgtgccgaattcttttcgagggaaaagattgatcgccgttctggtnggnaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggggggtgcatcaaagcagggacaaga

SEQ ID NO: 9968 - DNA, 296 bp, Homo sapiens
  misc_feature 81, 243: n = A,T,C or G
cactagtggatccaaagaattcggcacgagccaaacctcatatgttttaatggccaaagcacatgcaggctcctggttggncctctcaaacctgtgctgaccaaagattagtaaccagttatacccagtattttgaggttttattgtttttttaataactaaaaagaaaaaaggaacagtgtaaatttgtaatcaagagtttgtgaggaaaaacttatggtttttggttttgtttgtttttgnaggtctgtgtatcaaatatgacacttttcttgcaataaagcttattttggggt

SEQ ID NO: 9969 - DNA, 258 bp, Homo sapiens
  misc_feature 39, 47, 48, 78, 80, 81: n = A,T,C or G
cactagtggatccaaagaattcggcacgagcgaggttgnggtgtttnngaaactccgaggacagagggctaaatccangnngtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggcctaagaagcccctgctgaccacgtgagcattg

SEQ ID NO: 9970 - DNA, 143 bp, Homo sapiens
  misc_feature 44: n = A,T,C or G
ctagtggatccaaagaattcggcacgagctcagctggcatcatntaccatgaagaagcaagacgaaaacacacaggagggaaaatcctgggattctttttctagggatgtaatacatatatttacaaataaaatgcctcatgg

SEQ ID NO: 9971 - DNA, 235 bp, Homo sapiens
  misc_feature 45: n = A,T,C or G
cactagtggatccaaagaattcggcacgaggaacttccggctganttgggaaggacatggtggtggacatccagcggcgggcctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttg

SEQ ID NO: 9972 - DNA, 216 bp, Homo sapiens
  misc_feature 175, 205: n = A,T,C or G
tcgcgctgtgcccattctactaactgagtgagacatgacgctgtgcgtggatggaatagtctggacacctggtgggggatgcatgggaaagccaggagggccctgacctcccactgcccaggaggcagtggcggctccccgatgggacataaaacctcaccgaagatggatgctnaccccttgaggcctgagaaggcaggatcanaagggaccttg

SEQ ID NO: 9973 - DNA, 166 bp, Homo sapiens
  misc_feature 48, 80: n = A,T,C or G
cactagtggatccaaagaattcggcacgagattcaagctcgcatgttnaataagtagttgagttggagtttgagcactgnagtctggttccagacctctgctcttaaccttatctttgtactgcctctattacatttgattttgagacagagcaagactccgtctc

SEQ ID NO: 9974 - DNA, 199 bp, Homo sapiens
  misc_feature 77, 81: n = A,T,C or G
cactagtggatccaaagaattcggcacgagaaaacctcgagcccttttcagtagtggtgctgtattgtacaaagcgngggntgtaatatttcctctaatttactcagaaatgaagtatatggttcattaagcttaaaggggaaccatttgtgaatgaatatttggaacttaccaagtcctaagagacttttggaagagg

SEQ ID NO: 9975 - DNA, 354 bp, Homo sapiens
  misc_feature 77, 312: n = A,T,C or G
actagtggatccaaagaattcggcacgaggaggaacagtgacatttacacctgtgacagagagaggacagttagtgnggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgtctagaaacagtgcctttttcatcagttgcattttccaggctgagagctgtataaaacattttggactgngaccatgaccttcctttttaagaaaaataactgctttatggg

SEQ ID NO: 9976 - DNA, 347 bp, Homo sapiens
  misc_feature 33, 44, 77, 290: n = A,T,C or G
actagtggatccaaagaattcggcacgagctcntgccgaattcntttcgaggcgaaaccggccctgctggtcctccnggaaatcctggaccccctggtcctccaggtccccctggccctggcatcgacatgtccgcctttgctggcttaggcccgagagagaagggccccgaccccctgcagtacatgcgggccgaccaggcagccggtggctgagacaagcatgacgccgaggtggatgccacactcaagtccctcaacaaccagattgagaagcatccgaaccccganggctcccgcaagaaccctgctcgacctgagaaacctgaaactctgcaccctgagtgg

SEQ ID NO: 9977 - DNA, 159 bp, Homo sapiens
  misc_feature 47, 50, 59, 78, 80: n = A,T,C or G
actagtggatccaaagaattcggcacgagaatgatggcgcgatgttncangagaaagcncataccaaggccaccacangncacctgtccaaaaaggccttcgatacgggataatcctatttattacctcagaaatttttttcttcgcaggatttttctg

SEQ ID NO: 9978 - DNA, 306 bp, Homo sapiens
  misc_feature 2, 12, 50, 272: n = A,T,C or G
gngcccactagnggatccaaagaattcggcacgaggttctttaaatgaanttcaagaaattggccactggtaaaactctgcagggcaactgtacttcatttaatgccattaatgcaaatatacttcctcttctttttgcatggttttgcccacctctgcaatagtgataatctgatgctgaagatcaaataaccaatataaagcatatttcttggcttgctccacaggacataggcaagccttgatcatagttcatacatataaatggtggngaaataaagaaataaaacacaatacttttacttg

SEQ ID NO: 9979 - DNA, 170 bp, Homo sapiens
atcgagcagagcatcagggagctgtgtggggggatgatcagcgaacaaattgcacagttagccgcgcacctaaggaagcctttggcacccgggtccattggtcggcccggtccagctggcccccctggcccccaggacccccaggctccattggtcaccctggcgctcga

SEQ ID NO: 9980 - DNA, 281 bp, Homo sapiens
  misc_feature 38, 45, 77: n = A,T,C or G
ctagtggatccaaagaattcggcacgagctcgtgccgnttgtttnccaaggcaggtggatcgcctgaggtcaggggntcaagactaccctgaccaacatggagaaaccccatctctactaaaaatacaaaataggccgggcatggtggcacatgcctgtaatcccagctactcgggaggctgaggcaggagaatcgcttgaacccagcaggcagaagttgtggtgagccgagatcatgccactgcactccagcctgggcaataagagtcaaactccatctc

SEQ ID NO: 9981 - DNA, 312 bp, Homo sapiens
  misc_feature 31, 52, 75, 76: n = A,T,C or G
actagtggatccaaagaattcggcacgagcnacttttgactatttttttatngaaggcattttggaaactggggnngggtgtcccacctaggcttgctttgttactgccacaaatacctccagttcttaccagtgatgttattatgcattcaacctaattcattcatctggaaagaaacagttttttaaaaagggaaacctcacacgtaaatggctcagggcagcctgccttggtggaatgagcatgagactggaagctgaaagaagcaagttttaatcttgcactaaatgagtgttgtttgacacatcata

SEQ ID NO: 9982 - DNA, 245 bp, Homo sapiens
  misc_feature 30, 32: n = A,T,C or G
accgtggaattccatctcagctccaggaangngcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttg

SEQ ID NO: 9983 - DNA, 293 bp, Homo sapiens
  misc_feature 7, 8, 131, 172, 176, 230, 269, 281: n = A,T,C or G
tgtgcgnnactagtggatccaaagaattcggcacgaggggcaactcctcccccagcgccaaggacatcaagaagatcttggacagcgtgggtatcgaggcggacgacgaccggctcaacaaggttatcagngagctgaatggaaaaaacattgaagacgtcattgcccaggntatnggcaagcttgccagtgtacctgctggtggggctgtagccgtctctgctgccccnggctctgcagcccctgctgctggttctgcccctgctgcncctgaggagaanaaagatgagaag

SEQ ID NO: 9984 - DNA, 245 bp, Homo sapiens
  misc_feature 4, 89, 125, 202, 222: n = A,T,C or G
gtgngagactagtggatccaaagaattcggcacgagtatccagtatctccgtgattaccttcatctgcccccggagattgtgcctgccnccctacgccgtatccgtccagagactggcaggcctnggcctaaaggtctggagggtgagcgacctgcgagactcacaagaggggaagctgacagagatacctacagacggagngctgtgccacctggtgccgncaagaaagccgaggctggggctg

SEQ ID NO: 9985 - DNA, 400 bp, Homo sapiens
  misc_feature 11, 16, 91, 95, 162, 273, 322: n = A,T,C or G
agtctgtgtgnccctncagtgcgacgctagtggatccaaagaattcggcacgagtacaagatgaggtctgtgtatgctcacttccccatcnacgntgttatccaggagaatgggtctcttgttgaaatccgaaatttcttgggtgaaaaatatatccgcagngttcggatgagaccaggtgttgcttgttcagtatctcaagcccagaaagatgaattaatccttgaaggaaatgacattgagcttgtttcaaattcagcggctttgattcancaagccacaacagttaaaaacaaggatatcaggaaatttttggatggtntctatgtctctgaaaaaggaactgttcagcaggctgatgaataagatctaagagttacctggctacagaaagaagatg

SEQ ID NO: 9986 - DNA, 187 bp, Homo sapiens
acactagtggatccaaagcaattcggcacgaggttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaatt

SEQ ID NO: 9987 - DNA, 296 bp, Homo sapiens
  misc_feature 206: n = A,T,C or G
gacactagtggatccaaagcaattcggcacgagcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgngtcctacacaatggtgctattctgtgtcaaacacctctgtattttttaaaacatcaattgatattaaaaatgaaaagattattggaaagt

SEQ ID NO: 9988 - DNA, 277 bp, Homo sapiens
  misc_feature 169, 236: n = A,T,C or G
cggcacgaggctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggnccgaatcagtggtgggaacgacaaacaaggtttccccatgaagcagggtgtcttgacccatggccgngtccgcctgctactgagtaaggggcattcctgttacagacc

SEQ ID NO: 9989 - DNA, 115 bp, Homo sapiens
  misc_feature 6, 55, 75, 85, 104: n = A,T,C or G
cgagantagtggatccaaagaattcggcacgagctcgtgcagatttcggcacganctgaacccaatcccctgcanatactgaganaaaactagctttttggaancctagcttaat

SEQ ID NO: 9990 - DNA, 139 bp, Homo sapiens
  misc_feature 2, 12, 80, 81, 88: n = A,T,C or G
gntagtggatcnaaagaattcggcacgagtaaaacccaaacttccaaaggtttaaactacctcaaaacactttcccatgnntgtgatncacattgttaggtgctgacctagacagagatgaactgaggtacttgttttg

SEQ ID NO: 9991 - DNA, 248 bp, Homo sapiens
  misc_feature 2, 24, 38, 119, 121, 152, 172, 188, 231, 245: n = A,T,C or G
gnggcatctaaagaattcggcacncatatgggcatctntcgggtacaactggcacaagcgccgcaaaaccgggggcaaagagaaagccctaccacaagaagcggaagaatgagttgggncncccagctgccaacaccaagattggcccccgncgcatccacacagtccgtgngcggggaggtaacaanaaataccgtgccctgaggttggacgtggggaatttctcctggngctcatagtgttgnact

SEQ ID NO: 9992 - DNA, 107 bp, Homo sapiens
  misc_feature 5, 16: n = A,T,C or G
ctcgngcgcctgcagntcgacactagtggatccaaagaattcggcacgaggagtacttctagagcggccgcgggcccatcgattttccacccgggtggggtaccagg

SEQ ID NO: 9993 - DNA, 256 bp, Homo sapiens
  misc_feature 146, 182, 224: n = A,T,C or G
acactagtggatccaaagaattcggcacgaggcctggtgcgccctcacaagaagcggaagaagctgtcttcctcttgtaggaaggccaagagagcaaagtcccagaacccactgcgcagcttcaagcacaaaggaaagaaattcanacccacagccaagccctcctgaggttgttgggcctntctggagctgagcacattgtggagcacaggcttacacccttngtggacaggcgaggctctggtgcttactgcac

SEQ ID NO: 9994 - DNA, 296 bp, Homo sapiens
  misc_feature 3, 4: n = A,T,C or G
canngggacactagtggatccaaagcaattcggcacgaggccagatcctcttggttatttgtttaccacttgtattattaatgccattatccctgaattccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgg

SEQ ID NO: 9995 - DNA, 296 bp, Homo sapiens
  misc_feature 14, 22, 35, 54, 74, 82, 89, 200, 210, 213: n = A,T,C or G
gcgactagcggttnccaaggantgtcggcacgagnatcacatgagcagcaaagnactaaatatgtcaaaattgnggagaagngggcttnagatttaaggctgacagggaagactgatgttcatgggtaaaataatactgattttactacagggagacagaaacaacctcaaggagtacttgattcttcagaaaacctccnaagtagatgnggnctcaagtggaaagaaatgcaaagagaaaatgattagtgtactgtttgaaacaaaagtacagacagaacacaaaaggtttctgg

SEQ ID NO: 9996 - DNA, 274 bp, Homo sapiens
  misc_feature 4, 18, 58, 64, 73, 78, 102, 142, 149, 166: n = A,T,C or G
gcgncgactagtggctcnaaagaattcggcacgagtacatatttgatatttgaccccngttccngacacaganctccnaagatcacttggaagatcctgggngatggggaacatcctttgttctaatgaggcgagacttggngggcttntcctgcttgttcaccanaaacaccaagccaagactagaagctacaaactttcagccccgagcctctggggaaggaaggagggctccagattgagttaataatcaaccatgcctacataaggaagc

SEQ ID NO: 9997 - DNA, 338 bp, Homo sapiens
  misc_feature 1, 66, 73, 89, 167, 183, 184, 202, 234, 254, 275, 279, 329: n = A,T,C or G
nctggccataaaaggtgacagtggtcttccagggcctcctgggcctccaggtccacctggtgaagncattcancctttaccaatcttgncctccaaaaaaacgagaagacatactgaaggcatgcaagcagatgcagatgataatattcttgattactcggatggantggaagaaatatttgnntccctcaattccctgaancaagacatcgagcatatgaaatttccaatggntactcagaccaatccagccngaacttgtaaagacctgcaantcanccatcctgactttccagatggtgaatattggattgatcctaaccaaggcntgctcagga

SEQ ID NO: 9998 - DNA, 100 bp, Homo sapiens
  misc_feature 9, 15, 41, 51, 62, 78, 85, 97, 99: n = A,T,C or G
cactgctgngcgtanactagtggctccaaagaattccggcncgagtggatngccaaaaaagnctatacacttttaatnacctgtnttaaatgtttantnt

SEQ ID NO: 9999 - DNA, 400 bp, Homo sapiens
  misc_feature 5, 23, 27, 32, 44, 45, 49: n = A,T,C or G
tgggncactaaggcaccttttantggntctgngtgaccatgcanngggngactagtggatccaaggcaattcggcacgaggtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggata

SEQ ID NO: 10000 - DNA, 122 bp, Homo sapiens
  misc_feature 3, 13, 40, 45, 50, 51, 61, 78, 84, 97, 99, 105, 110: n = A,T,C or G
cgnctagtggttnccaaagcaattcggcacgagcgctggncgaantggcnngcaaggaganagtaggataagctggcngcacanggccccatgggancntcaggnccagntggagcccgggg

SEQ ID NO: 10001 - DNA, 100 bp, Homo sapiens
  misc_feature 9, 10, 32, 49, 53, 59, 65, 76, 77, 80, 94, 95: n = A,T,C or G
cgcctgcanngggacactagtggtatccaaanaattcggcacgagcttncttngtcacngtgatngctcttttgcnntancacctttggtttcnnctctt

SEQ ID NO: 10002 - DNA, 396 bp, Homo sapiens
  misc_feature 2, 33, 75, 148, 157, 170, 188, 278, 351: n = A,T,C or G
anactagtggatccaaagaattcggcacgaggngacccaggccctgccagctatggcagaaatggccgagacggngagcgaggccccccaggggtggcatggaattcctggagtgcctggacccccgggacctcctgggcttcccggnttctgtganccagcctcctgcnccatgcaggctggtcagngagcatttaacaaagggcctgacccttgaaaggcttactgctgcatggctgtctgcatgaaccacgcctggcgaaggagccttgggtganaaacaccatccaaagctggggcaaagatgattaccttcagcatgattacaatgtattaccttcagtatgattncagaagtcctacttgacaatcacatatagaagaacggggctattc

SEQ ID NO: 10003 - DNA, 161 bp, Homo sapiens
  misc_feature 7, 11, 32, 37, 80, 87, 90, 95, 97, 98, 100, 116, 130, 150: n = A,T,C or G
gactagngggnctaaagaattcggcacgagcngcagncttcgccaccatgcgcgccctacaccgtgtactatttcccagntcgaggncgntgagngnncntgcgcatgctgctggnagatcatgggccanagctggaaggaggaggtggngaccgtggaga

SEQ ID NO: 10004 - DNA, 400 bp, Homo sapiens
  misc_feature 2, 15, 56, 113, 160, 162, 239, 278, 340, 382, 387: n = A,T,C or G
gngactagtggatcnaaagaattcggcacgagggaagctgaaagtccccgaatggntggataccgtcaagctggccaagcacaaagagcttgctccctacgatgagaactggntctacacgcgagctgcttccacagcgcggaacctgtacctccggggngncgctggggttggctccatgaccaagatctatgggggacgtcagagaaacggcgtcatgcccagccacttcagccgangctccaagagtgtggcccgccgggtcctccaagccctgnaggggctgaaaatggtggaaaaggaccaagatggcggccgcaaactgacacctctgggacanagagatctggacagaatcgccggacaggtggcagcttgccancaagnaagcattagaaca

SEQ ID NO: 10005 - DNA, 101 bp, Homo sapiens
  misc_feature 34, 35, 52, 67, 71: n = A,T,C or G
agactagtggatccaaagaattcggcacgagcgnntgtgtgccttccttctnaagcttggagtccgnattnataccacatcaaacgctgtccaccttgcgg

SEQ ID NO: 10006 - DNA, 398 bp, Homo sapiens
  misc_feature 7, 14, 29, 56, 259: n = A,T,C or G
atccaangaattcngcacgagctcgtgcngaattcggcacgagctggaactgatgnagggcaggaagcagtttgatgagctctgcatccgatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgnggctacctggctaccatggctggactggcagctggggccgatgctgcctacatttttgaggagcccttcaccattcgagacctgcaggcaaatgttgaacatctggtgcaaaagatgaaaacaactgtgaaaaggggct

SEQ ID NO: 10007 - DNA, 376 bp, Homo sapiens
  misc_feature 2, 3, 105, 241, 273, 302: n = A,T,C or G
anngggagactagtggtattccaaacaattcggcacgagtctgacagagccatatgtaccctaccctgcacattgttatgcacttttccccaattcatgtttggnggggccatccacaccctctccttgtcacagaatctccatttctgctcagattccccccatctccattgcattcatgtactaccctcagtctacactcacaatcatcttctcccaagactgctcccttttgttttgngtttttttgaggggaattaaggaaaaataagngggggcaggtttggagagctgcttccagnggatagttgatgagaatcctgaccaaaggaaggcacccttgactgttgggatagacagatggacctatggggtg

SEQ ID NO: 10008 - DNA, 100 bp, Homo sapiens
  misc_feature 3, 87: n = A,T,C or G
ganactagtggatccaaagcaattcggcacgaggttacattgtgtacattcaaaaggaagagagaaaatatatatgataatgatttncacttaactaatt

SEQ ID NO: 10009 - DNA, 400 bp, Homo sapiens
  misc_feature 13, 19, 102, 108, 204, 250, 260, 277, 290, 305, 322: n = A,T,C or G
acaattctctggncgaatnggggcgtccaaagaattcggcacgagcaccgacccgctgcagggcaggcagaggcccaggccgccgcccatactgcacctganccggcncaaggatgacgtcagctacgtgctgtcggtgtatcgctccaacccctgcgaaagtttttcccagcaggagcggatcatcctgcaagacttctcctncctgctgttgctgatggttgaaaaacctcgtgccgctcgtgccganttggcacganaactggtggagcagcangagcaaggagaanaaacacatctggctnggagaaaccatcaatgncggcttccattttcagctatggagatgacaatctggctcccaacactgccaacgttcagatgaccttcctacgcctgc

SEQ ID NO: 10010 - DNA, 399 bp, Homo sapiens
  misc_feature 12, 36, 43, 54, 138, 151, 157, 182, 203, 389: n = A,T,C or G
gctagtggatcnaaagaattcggcacgaggttcagntaagggnactacttaagnataataactgtacttgcgagtggaaaagcctacattatttgatgagctgcttgactcccacattcacgacagcatagagccaanagccagggtgagngagggnactgtgagaaggaagcctgtggaancctgctagactgctggagggntcctctcttcttagggccaagggcacacaggctgccatctcttgagatttccatcgtgaacacactgagcacatctaatgatcatgttgctataaaccagctcacaagtaggattctaaaagatccctctctcatgcaactttttctttcgttcgcaccttgtttgcctgggaaacttgtcactgnccctctccac

SEQ ID NO: 10011 - DNA, 216 bp, Homo sapiens
  misc_feature 19, 27, 31, 33, 39, 43, 93, 122, 196, 201: n = A,T,C or G
cacctgatgagtagcagtntgtgtgancctncngtgcgncgantagtggatccaaagaattcggcacgagaaaaattagctgggtgtggtggngcatgcctgtagtcccagctacttgggangctgaggtaggagaattgcttgaacctgggaggcggaggttgcggtgagctgagatcacgccactacactccancctgntgacagagcaagact

SEQ ID NO: 10012 - DNA, 379 bp, Homo sapiens
  misc_feature 3, 6, 48, 130, 186, 211, 238, 259, 269: n = A,T,C or G
ctntgngacgactagtggcatccaaagaattcggcacgagctcgtgcngcttattaataaaataataacctctgcctgactccctaaacagttataaatgtcacagctgtttcttataatgcttacattnatatttctaaataacatgtttataatgcatctaacttccttccatggaaaaagagnatttggctttttaaaccaatcgagncacatgcatgctttcccccctccacgntggactacatcaatatttagngtttgtattnttataaatagataaatattgttcgcaaattttatttgctgtctattgctgcctattgtgaagcacacagagttttaaacactgaaaggcaggccctccatcgttctggtg

SEQ ID NO: 10013 - DNA, 376 bp, Homo sapiens
  misc_feature 10, 21, 30, 35, 37, 39, 42, 43, 53: n = A,T,C or G
tgggccctanggagcctattngtgagtcgngtgancntncanngggagactantggatccaaagcaattcggcacgaggatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattt

SEQ ID NO: 10014 - DNA, 396 bp, Homo sapiens
  misc_feature 8: n = A,T,C or G
cgactagnggatccaaagaattcggcacgagctcgtgccgaattcggcacgaggacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattc

SEQ ID NO: 10015 - DNA, 246 bp, Homo sapiens
  misc_feature 11, 19, 43, 131, 152, 201, 204, 239: n = A,T,C or G
cactaaaagcncattaatntggagatctcgtgcgcctgcaggncgacactagtggtatccaaagaattcggcacgagctcgtgccgaattcggcacgagtatgccgtggagacatatacataccatgttgnggaatttgggcttttttctgngggaaatagggagccaaagaaggatttataagaagtggattgatgtggncanatttgtgttttaaaaatcttcctttggcaacagtnttgagag

SEQ ID NO: 10016 - DNA, 348 bp, Homo sapiens
  misc_feature 2, 22: n = A,T,C or G
anaccttcactgggacgactantggatccaaagaattcggcacgagcagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttat

SEQ ID NO: 10017 - DNA, 168 bp, Homo sapiens
  misc_feature 10, 13, 44, 83, 104, 108, 143: n = A,T,C or G
aaagaattcngcncgaggtctgatgaccctcttaatagcattgntattgtattgaatcacataatgattcataagtaactagngaaccaactgattttgctaancagncttccccttataacaccacaggcccttctgacacncaaaaaaatgaaagttaatcctggg

SEQ ID NO: 10018 - DNA, 294 bp, Homo sapiens
  misc_feature 12, 31, 38, 60, 63, 136, 220, 243, 272, 284: n = A,T,C or G
gtgtgcaccatncagtgggcgactagtggcnccaaagnaattccggcacgagctcgtgcnganttcggcacgagttcatttcctctgtggtacagaagcataaaagttttaaatttttatgaagtccaattttttngtattgtttggtttgtttctcaagtttttggattatatgtaagaaacttgccaaattcaagctcatttacctctgttttcttcngagagttttatagctttagtttntagatattttatcgattttgaggtttttntgtatatgttgngagggtaagg

SEQ ID NO: 10019 - DNA, 400 bp, Homo sapiens
  misc_feature 8, 11, 82, 83, 84, 95, 236, 367, 398: n = A,T,C or G
gtggttcnaangaattcggcacgagaccagtacagcccttgctgcagtaatggggtctatgtttgccgtcattagccttgcnnncattgctgtgnactttgccaaaagatttaagagaaaaaactaccaccactcattaaaaaagtatatgcaaaacctcttcaatcccactaaatgagctgtacccaccactcattaacctctgggaaggtgacagcgagaaagacaaagatggntctgcagacaccaagccaacccaggtcgacacatccagaagctattacatgtggtaactcagaggatattttgcttctggtagtaaggagcacaaagacgtttttgctttattctgcaaaagtgaacaagntgaagacttttgaatttttgactttgctagntt

SEQ ID NO: 10020 - DNA, 319 bp, Homo sapiens
  misc_feature 16, 23, 143, 203: n = A,T,C or G
tgggacgactagtggntccaagncaattcggcacgagtctgcccaactgtcaaccttgacaaattgtggactttggtcagtgaacagacacgggtgaatgctgctaaaaacaagactggggctgctcccatcattgatgtggngcgatcgggctactataaagttctgggaaagggaaagctcccaaagcagcctgtcatcgngaaggccaaattcttcagcagaagagctgaggagaagattaagagtgttgggggggcctgtgtcctggtggcttgaagccacatggagggagtttcattaaatgctaactactttt

SEQ ID NO: 10021 - DNA, 241 bp, Homo sapiens
  misc_feature 15, 23: n = A,T,C or G
tggaggtctcgtgcncctgcagngggacgactagtggatccaaagcaattcggcacgagagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 10022 - DNA, 203 bp, Homo sapiens
  misc_feature 8, 14: n = A,T,C or G
atagcagnggcganactagtggatccaaagcaattcggcacgagcctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaac

SEQ ID NO: 10023 - DNA, 245 bp, Homo sapiens
  misc_feature 5, 12, 79, 88: n = A,T,C or G
ccaangaatgcngcacgagctcgtgccgaattcggcacgaggccatatttctgggagcactttgataaggacggctggnccctgtggnactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctg

SEQ ID NO: 10024 - DNA, 394 bp, Homo sapiens
  misc_feature 3, 19, 27, 40, 48, 52, 126, 127, 247, 325, 331, 367, 389: n = A,T,C or G
ggncacctatgagtgagtntgtgtgancacttctgtgggncgactagnggcntccaaagaattcggcgcgagaaaaaaagaaagaaatctacttctagtcccatatagagtaaaactgcccctaannaagacagagagaaatctcaaaagcagccagagaaagaagacacattgcctcacaatagacttctcaacagcattggcgtaatactatctcatgtactaaaagaaataactgccaaccttntatattttccaagatctcttctggaaaacaaaaactttaagaatctgccttcattgaaaattcttaatgatgtacttnaagcanaaagaaaatttcctaggtaaaaggtctaagatgcangaaagaaagacatgcaaagganactta

SEQ ID NO: 10025 - DNA, 106 bp, Homo sapiens
  misc_feature 8, 11, 67, 73, 101: n = A,T,C or G
tagtggcntcnaaagaattcggcgcgagctcgtgcagatttcggcacgagtacccactccaccttantaccanacaaccttagccaaaccatttacccaantaaag

SEQ ID NO: 10026 - DNA, 400 bp, Homo sapiens
  misc_feature 5, 7, 178, 255, 284, 369: n = A,T,C or G
tgtgngncgactagtggatccaaagaattcggcacgaggccgttcctcgttttatcctgatggtggagatcaggaaactgcaaagactgggaagttcttaaaaaggttcacagatgaagagtctagagtattcctgcttgataggggtaataccagggataaagaggcttcaaaaganaaaggatcagaagaaagggagggcagagggagaatgggaagatcaggaagctctagattacttcagtgataaagagnctggaaaacaaaagtttaatgattcaganggggatgacacagaggagacagaggattatagacagttcaggaagtcagtcctcgcagatcagggtaaaaagttttgctactgcntctcaccggaatactgaggaggaaggactca

SEQ ID NO: 10027 - DNA, 131 bp, Homo sapiens
  misc_feature 1, 3, 54, 56, 94, 99, 126: n = A,T,C or G
ntntgggcgctagtggctccaaagaattcggcacgaggcttgaacctgggaggngnaggttgcagtgagccgagatcgcgccactgcactccancctgngcaacacagcgagactccgtctcatanaaaat

SEQ ID NO: 10028 - DNA, 301 bp, Homo sapiens
  misc_feature 7, 15, 27, 35, 36, 37, 42, 44, 47, 50, 56, 60, 64, 70, 86,87, 88, 90, 101, 120: n = A,T,C or G
acaattnttgggcgnataacgattccntggaagtnnncacananctngtncagagntcgncacngggttnttcaaaacgattgcannntntaaagatggcntcttctctcccaccgggcntacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttg

SEQ ID NO: 10029 - DNA, 396 bp, Homo sapiens
  misc_feature 19: n = A,T,C or G
agactagtggatccaaagnaattcggcacgagccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctac

SEQ ID NO: 10030 - DNA, 306 bp, Homo sapiens
  misc_feature 7, 21, 42, 74, 188: n = A,T,C or G
ataacgnttccaaggaagtcngcacgagccgccgccgaggantcagcagcctcccccttgagccccctcgcttnccgacgttccgttcccccctgcccgccttctcccgccaccgccgccgccgccttccgcaggccgtttccaccgaggaaaaggaatcgtatcgtatgtccgctatccagaacctncactctttcgacccctttgctgatgcaagtaagggtgatgacctgcttcctgctggcactgaggattatatccatataagaattcaacagagaaacggcaggaagacccttactactg

SEQ ID NO: 10031 - DNA, 396 bp, Homo sapiens
  misc_feature 4, 249: n = A,T,C or G
acgnctagtggatccaaagaattcggcacgagccaccattttactctttctgtgagttcatctttttaaaatttgacatgtaagtaagatgatatagtatttgtctttctccgtctgatatatttcacttagcatcatgccttaaaggtttatacttggcgattatgaataatgttgttgcaaatagcagggttttctttttgtggctgagtaatagtctatcacgtctctgtatgtacatgtgtgcgngtgtatatgtgtatgtgtatatatataacaatgtatccattcgtctaccaatggacacttaggttgtttccatgtcttggctattgtgaataatgctgccaatgaacatgggagtgcagatgcctctttgacatactgatttcattt

SEQ ID NO: 10032 - DNA, 260 bp, Homo sapiens
  misc_feature 3, 22, 58, 65, 96, 103, 117, 138, 143, 214, 216: n = A,T,C or G
tcnaaagaattcggcacgaggngtcgatcaaatctagtactcactcccactttttagnctcactnctacttttgtccaccacccctgcctcctggntcttctnccactttttttttnagctttaggacctggggagancctgngagtcaaggcagacacccaatcctgcccccacactcggggtcctccaagaggttggggggcagagtcccanancagccctttaccccaggtccaggccctggaatcctgagactcgc

SEQ ID NO: 10033 - DNA, 400 bp, Homo sapiens
  misc_feature 22, 24, 27, 29, 44, 87, 89, 127, 129, 159, 171, 192, 272,294, 295: n = A,T,C or G
ccctatagtgagtctgtgtgancnttntntgggcgctagtggcntccaaagaattcggcgcgagctgatatttcattaagtcactgngnatttttaagtgttgatacattaaaagccgctttatggnanatgagtaaattttttaaatacttggaaatnttatttccttgntaacttctacagatcagggcntgcaaccaaaagcagcttaaatgaaatattttaaaataaaatatcaggaagctatttttagatttcttctggcttatgtntctactttaggaccctcattgnnctcttattaaaaaaaattatttcctgtgcatctcatggactgcagggtaaattatttgggcataaataatttaaatagttttctttcattttgactatctccagt

SEQ ID NO: 10034 - DNA, 110 bp, Homo sapiens
  misc_feature 3, 7, 102: n = A,T,C or G
tgngtgngcctgcgtgcgacactagtggatccaaagaattcggcacgaggcggactcaggctccagctgtggctacatacatagggtttttatacaagaaanataaagtg

SEQ ID NO: 10035 - DNA, 398 bp, Homo sapiens
  misc_feature 5, 21, 31, 33, 42, 49, 50, 53, 54: n = A,T,C or G
tgggnccctatggaccctatngtgagtcgtntnacacattantgggcgnntannggatccaaagaattcggcacgagcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtag

SEQ ID NO: 10036 - DNA, 399 bp, Homo sapiens
  misc_feature 2: n = A,T,C or G
antgggagactagtggatccaaagaattcggcacgagtaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccgggcttgtcaagcagttccacgactccaagatcaagttccccgctgccccaccgggtcctgcgccgtcagcacaagccacgcttcaccaccaagaggcccaaca

SEQ ID NO: 10037 - DNA, 351 bp, Homo sapiens
  misc_feature 2: n = A,T,C or G
anactagtggatccaaagaattcggcacgaggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagta

SEQ ID NO: 10038 - DNA, 204 bp, Homo sapiens
  misc_feature 1, 2, 45, 48, 65, 68, 80, 85, 114, 137, 163, 169: n = A,T,C or G
nngatatggactaaatctaccagcggccgcagccgcggcagaaangtncaattcgccctatatcngantctttgttacantgaantgtgcgcgactgccccttcaccactttgnccactgccttctcttctggagtnttcggggtcatgagggcgctcatcantggcangctaggcagctctatgtcaggagaggcttggggac

SEQ ID NO: 10039 - DNA, 400 bp, Homo sapiens
  misc_feature 18, 21, 39, 73, 79, 196: n = A,T,C or G
tggccgtattggggctcnaangaatgtcggcacgagganttaagatgaaattatcctggattatctggatagnccctanatccaatgacaagtgtccttataacaaacaactaaagacagtaaaggagaagaccatgtgaatttgaagagtgttatcgtttcaagccgaggaacacctggagcaaccagaagctgnaagatgcaagggaggattctccccagagccttcagagaggcacaactctgctgacaccttgattttggacttctggctgctagaactgtgaaataataagttactgctatttgaagccactaagtttgtggtaatttgttacagcagcctttggaaacttatacacagacacagacacacacacacacagaaacacacacacac

SEQ ID NO: 10040 - DNA, 400 bp, Homo sapiens
  misc_feature 7, 25, 27, 44, 81, 82, 129, 130, 268, 279, 289, 304, 332,376: n = A,T,C or G
ctatagngagtctgtgtgaccattntntgggcgctagtggctcnaaagaattcggcacgaggtttttccctggttttctgnnactggcacaggagggtacagttgggagagtgcgttcctggagctcanncctgcatttgttcacgtgcctcacagcaggcctttgtgcccttgaatctcaaacatggggatctgcttggtacccagagctctggtcattgtgtccaaccacacaccccaccccatccgtgtcctccatctcacccanaaccacagggngcccactagngtcagggcccaaagngccagccttctcttctgccttacctagnctacctatttatttcctccactttttatcttaaaagtagctaanccatgctggtgcccatactccaag

SEQ ID NO: 10041 - DNA, 400 bp, Homo sapiens
  misc_feature 11, 23, 31, 33, 36: n = A,T,C or G
tatggaccctntgagtgagtctntgtgaccntncantgggacgctagtggatccaaagcaattcggcacgagggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttc

SEQ ID NO: 10042 - DNA, 158 bp, Homo sapiens
  misc_feature 11, 30, 31, 34, 36, 38, 46, 52, 65, 76, 90, 99, 119, 151: n = A,T,C or G
accatatacgncgagtactgtgtgagcctnntgngngncgtctagnggatcnaaagaattcggcncgagcagcagncacctcaacgtcgntaccgccgnaacttcaattaccgacgcanacgcccagaaaaccctaaaccacacgatggcnaagagac

SEQ ID NO: 10043 - DNA, 139 bp, Homo sapiens
  misc_feature 3, 18, 67, 86: n = A,T,C or G
tgngagactagtggatcnaaagaattcggcacgagagatgacgccactacacggcctgcgggagctncggcttctcgtcctccggnctccaccctgagggagcaccgacccggtgccgccggagctggccctgtgcgca

SEQ ID NO: 10044 - DNA, 322 bp, Homo sapiens
  misc_feature 9, 19, 61, 62, 82, 115, 121, 135, 170, 190, 220, 254, 293: n = A,T,C or G
gtgggagantagtggatcnaaagaattcggcacgaggtccagccccagccctgggcctggnntgccgacacctgggccagancccctgctgtgattggtgctccctgggcctccngggtgnatgaagccaggcgncgccccctccgggagccctggggtgagccgccggngcccccctgctgccagtctnccccgtccccaacatgcatctcactctggntgttttggtcttttattttttgtaagtgtcattngtataactctaaacgcccatgatagtagcttcaaactgnaaatagcgaaataaaataactcagtctgc

SEQ ID NO: 10045 - DNA, 361 bp, Homo sapiens
  misc_feature 7, 8: n = A,T,C or G
cctgcanngggacactagtggatccaaagcaattcggcacgaggagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagt

SEQ ID NO: 10046 - DNA, 396 bp, Homo sapiens
  misc_feature 7, 168: n = A,T,C or G
acactantggatccaaagaattcggcacgagcttcaatatttgttctaaaactgttttgtatgagagtataagcataaccataaaaacctggttgggtaatataataaaaataatgtggcaacaataagagggaacaagattttggcgttcctttaaaagtttctgtntattttacttaagtataaagaaaattgttatgaatgataggaggaaggatttttgtccacctattaaaaaaaaactgctgtgaagcataggaagtttcaagcataaaatcaagcagtagataaatgttctttgaacttacgaatttcaaattataaatttcaaccatgctattaaagatattcaacacagcggatattccttttgctttcaaatttatctaaatatat

SEQ ID NO: 10047 - DNA, 400 bp, Homo sapiens
  misc_feature 3, 4: n = A,T,C or G
canngggagactagtggatccaaagaattcggcacgaggaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtc

SEQ ID NO: 10048 - DNA, 396 bp, Homo sapiens
  misc_feature 2: n = A,T,C or G
anactagtggatccaaagaattcggcacgaggtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttg

SEQ ID NO: 10049 - DNA, 322 bp, Homo sapiens
  misc_feature 2, 9, 30, 37, 40, 41, 42, 69, 108, 163, 166, 186, 224, 304,317: n = A,T,C or G
tnaccattntctggccgtattggggcgtcnaaggaantcnnngcgaggattgaaggtggattaaatggnactctcaccatccggctacttatgcatggaaaggaagtnggcagtatcatcggaaagaaaggagaatcaagttaagaagatgcgcgaggagagnggngcacagtatcaacatctcanaagggaattgtcctgagagaattatcactttggctggncccactaatgccatcttcaaagcctttgctatgatcattgacaaactggaagaggacataagcagctctatgaccaatancacagctgccagnagacc

SEQ ID NO: 10050 - DNA, 400 bp, Homo sapiens
  misc_feature 9, 22, 28, 30, 41, 47, 83, 192, 218, 239, 244, 263, 273,299, 315, 377: n = A,T,C or G
ccctatagngagtatgtgtgancacttntntgggcgctagnggctcnaaagaattcggcacgagcgggacaggaggatccggngcagcgggagattcaccaggactgggctaaccgggagtacattgagataatcaccagcagcatcaagaaaatcgcagactttctcaactcgttcgatatgtcttgtcgntcaagacttgcaacactaaacgaganattgacagcccttgaacgganaatanagtacattgaagctcgggngacaaaaggngagacactcacctagaacagtgccgngctgctgctgggaagntgctttacacaacacaggccacatgggaaaggccccagcagccttcagctccttcctttctncttaaagagcaacagggcttatt

SEQ ID NO: 10051 - DNA, 400 bp, Homo sapiens
  misc_feature 3, 22, 47, 122, 142, 157, 169, 298, 318, 339: n = A,T,C or G
tgngcgacgactagtggcatcnaaagaattcggcacgaggaggtggnggccacggcctctcgctgtatgctgtgtggaaggtcgaatcatcatcatcataaaacttaatattgcccttatgngccaggaactactatctcancaatggagatgtggngcttggccgcantcgtgaatcggccctggaggggacacaggaaggggctgcctgcgactcatgacctcctgcgtgcctgcctgctgacctatgacccttcaagttcccacccctcagccacgcctgtgaggagggtcttgntttgtcgcctacgctggagngcagtggtgtgatcacagctnactgcagcctcaacttcctggactcaagcgattttcctgcctcaacctcccaagaactagg

SEQ ID NO: 10052 - DNA, 398 bp, Homo sapiens
  misc_feature 2, 9, 146, 376: n = A,T,C or G
gnggcgtcnaaagaattcggcacgaggaagccaacaggagcagtaagcgcagcagccggagtgtggaagatgacaaggagggtcacctggtgtgccggatcggcgattggctccaagagcgatatgagattgtggggaacctgggngaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctggncaagaacacctttgagttcctg

SEQ ID NO: 10053 - DNA, 397 bp, Homo sapiens
  misc_feature 15, 23, 27, 28, 36: n = A,T,C or G
tatggacacctatantgagtctngtgnncctgcagngggacactagtggatccaaagaattcggcacgagccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagctttggatgtgaatcaggactcggagctcaagttcaatgagtactggagattgattggggagctggccaagg

SEQ ID NO: 10054 - DNA, 287 bp, Homo sapiens
gacactagtggatccaaagaattcggcacgagggataacgcctgcaacgacatgggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 10055 - DNA, 116 bp, Homo sapiens
  misc_feature 7, 8, 63, 64, 65, 69, 70, 73, 76, 78, 80, 85, 86, 90, 93,94, 106, 108: n = A,T,C or G
cgtctannggttccaaggaattcggcacgagagagagagagagagagagagagagagagagannnagtnngcnctntngngagtnntatnacnntcccctgtgcgngnatagagtg

SEQ ID NO: 10056 - DNA, 340 bp, Homo sapiens
  misc_feature 13, 18, 31, 42, 51, 58: n = A,T,C or G
gaggtaatactantggtngttaaaaaataanaacattacaanaaattctancaagtanaaagataacaacaacaaaatactatctgaattatcacttgtgactgacgctgttgtttgaattcaccaggtaattcctcaattatccttttctatatagatatcactgttatgtatgagatcatagcagagaagctctggcaaggtaatttgcagaatgaagtatttcctattttgtaccaaacatgatgacatttaagctactcaagggaaatatatttttacactgtgcgagatactctgtgttaagaatttttatgtggtacactaggtaaattccatg

SEQ ID NO: 10057 - DNA, 100 bp, Homo sapiens
  misc_feature 4, 13, 27, 53, 58, 60, 61, 65, 72: n = A,T,C or G
gcgngactagtgnatctaaagaattcngcacagaggccagctaagccaggctncctgngnnctgngaggaanggtacccatcccccatgccccttatggg

SEQ ID NO: 10058 - DNA, 126 bp, Homo sapiens
  misc_feature 3, 16, 73: n = A,T,C or G
tcnaaagaattcggcncgagggtgaacagaactaggaaatgaatttttagctcttaaaagcatttgctttganaccgcacaggagtgtctttccttgtaaaacagtgatgataatttctgccttgg

SEQ ID NO: 10059 - DNA, 354 bp, Homo sapiens
  misc_feature 2, 6, 149, 311, 315: n = A,T,C or G
gnctantggatccaaagaattcggcacgaggaaaaatggacaaggattgtgaaatgaaacgcaccacactggacagccctttggggaagctggagctgtctggttgtgagcagggtctgcacgaaataaagctcctgggcaaggggacntctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagantcgntcaccagacaggtgttatggaagctgctgaaggttgtga

SEQ ID NO: 10060 - DNA, 245 bp, Homo sapiens
  misc_feature 16, 22, 28, 31, 38, 39, 40, 41: n = A,T,C or G
cacctaaggaacctanactgangctcgngcncctgcannnngacactagtggatccaaagcaattcggcacgagcggcacgagcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttt

SEQ ID NO: 10061 - DNA, 400 bp, Homo sapiens
  misc_feature 4, 9: n = A,T,C or G
cagnggganactagtggatccaaagaattcggcacgagaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaat

SEQ ID NO: 10062 - DNA, 249 bp, Homo sapiens
  misc_feature 8, 11, 27, 47, 58, 121, 134, 147, 184, 188, 189, 228, 229,230: n = A,T,C or G
tagtggcntcnaaagcaattcggcacnagtatcaaacttggtctggntattgatgaanatgaccctactgctgatgataccagtgctgctgtaactgaagaaatgccaccccttgaagganatgacgacacatnacgcatggaagangtagactaatctctggctgagggatgacttacctgtncagnnctctacaattcctctgataatatattttcaaggatgttnnnctttatttttggtaatatt

SEQ ID NO: 10063 - DNA, 218 bp, Homo sapiens
  misc_feature 7, 45, 48, 79, 106, 132, 151, 167, 209, 214: n = A,T,C or G
gtgacgngactagtggctccaaagaattcggcacgagctcgtgcnganttcggcacgaggtagactccatatcatggangctcagtataggggagcttccagcttntgccacactcttccagacggggcctntcctcactctgtgcaggtncacacgatgggaccanatctccagcccacatccctttttccttgtgtcactctcatgngaggncatg

SEQ ID NO: 10064 - DNA, 214 bp, Homo sapiens
  misc_feature 9, 72, 75, 136, 181, 196: n = A,T,C or G
acctgcagngacgagactagtggatccaaagaattcggcacgagaatcactgaggcatttttactactattntgntaaaatcaggattttagtgcttgccaccaccagatgagaagttaagcagcctttctgtggngagtgagaataattgtgtacaaagtagagaagtatccaattatgngacaacctttgtgtnataaaaatttgtttaaag

SEQ ID NO: 10065 - DNA, 111 bp, Homo sapiens
  misc_feature 2, 19: n = A,T,C or G
gngcgagactagtggctcnaaagaattcggcacgagattcctttattgtacataaagtaactggtatatgtgcacaagcatattgcattttttttttttttaactaaacag

SEQ ID NO: 10066 - DNA, 368 bp, Homo sapiens
  misc_feature 2, 11, 32, 206, 224: n = A,T,C or G
cncctgcaggnggacactagtggatccaaagnaattcggcacgagaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgncttcctgtgagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatg

SEQ ID NO: 10067 - DNA, 190 bp, Homo sapiens
  misc_feature 28, 39: n = A,T,C or G
ataaacgaacaataagtctggagctcgngcgcctgaggncgacactagtggatccaaagaattcggcacgagtcgagagtacttctagagcggccgcgggcccatcgattttccacccgggtggggtaccaggtaagtgtacccaattcgccctatagtgagtcgtattacaatttcactgggccggtca

SEQ ID NO: 10068 - DNA, 122 bp, Homo sapiens
  misc_feature 11, 19: n = A,T,C or G
cgactagtggntccaaagnaattcggcacgagcgcaggatttttctgagccttttaccactccagcctagcccctaccccccaattaggagggcactggcccccaacaggcatcaccccgct

SEQ ID NO: 10069 - DNA, 400 bp, Homo sapiens
  misc_feature 3, 12, 28, 37, 40, 41, 115: n = A,T,C or G
ctnaacgaaacnttataagtggagtctngtgcccctncanngggacactagtggatccaaagaattcggcacgagcagccatgagtatgctcaggcttcagaagaggctcgcctntagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcag

SEQ ID NO: 10070 - DNA, 238 bp, Homo sapiens
  misc_feature 4, 6, 68, 69, 81, 91, 104, 141, 203, 221: n = A,T,C or G
cctncngtgcgagactagtggcatccaaagaattcggcacgaggtggagaacattcaatacttgccgnnactattcatcantgaagattancactgagatccanagaggctggatgacttgctcaagttcaccagcatggnagtggcaaagagaggtccagagtcctggcccttgatgcccagctcagtgccacaaagctcantaggagggatgttccagnggatgagggccaccagg

SEQ ID NO: 10071 - DNA, 137 bp, Homo sapiens
  misc_feature 7, 21, 31, 57, 94, 121, 125, 132: n = A,T,C or G
aaactangagtggaagtctgngtgcgcctgnagggcgacgactagtggatccaaagnaattcggcacgagtatacagaacattctcatgacctnagactagcataataaatgactgagcantggnactgtanctgtg

SEQ ID NO: 10072 - DNA, 245 bp, Homo sapiens
  misc_feature 4, 9, 63, 85, 92, 97, 122, 154, 161, 183: n = A,T,C or G
cagngggtngactagtggctccaaagaattcggcacgaggctgctgaggccttgatgctgagngatcccctccagggcacacttncctgccnaggcnagcctaccacagccctccactggtntggccagatgcactgggaacagagccacgggncctgggncctagaccaggacttcctgtgngaccctggacaagtactaccttcctgggcctcaggtttctcgtctgtataatggaagcaaga

SEQ ID NO: 10073 - DNA, 218 bp, Homo sapiens
  misc_feature 2, 8, 31, 35, 51, 70, 116, 199: n = A,T,C or G
anaaatangagtggagtctgcgtgcgcctgnaggncgacactagtggatcnaaagaattcggcacgaggntagtataagtaacatgaaaacattctcctccgcataagcctgcgtnagattaaaacactgaactgacagttaacagcccaatatctacaatcaaccaacaagtcattattaccctcactgtcaacccancacaggcatgctcataagg

SEQ ID NO: 10074 - DNA, 109 bp, Homo sapiens
  misc_feature 7, 17: n = A,T,C or G
cgactancgaatccaangaattcggcacgagctcgtgccgaattcggcacgaggtgaaatagaaagggtgaatttaaaacagaactttttatctcattctttctttctg

SEQ ID NO: 10075 - DNA, 143 bp, Homo sapiens
  misc_feature 22, 115: n = A,T,C or G
gcgacactagtggatccaaagnaattcggcacgagcccaggtatcacctgcccttgcattggaccagtccctgtggaagaggggatgggggcctgtgatcttggccaggcctggnctatctatctgcactggcattgctaact

SEQ ID NO: 10076 - DNA, 260 bp, Homo sapiens
  misc_feature 1, 7, 256: n = A,T,C or G
ngactantgaatccaaagaattcggcacgagctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggncacc

SEQ ID NO: 10077 - DNA, 134 bp, Homo sapiens
  misc_feature 4, 13: n = A,T,C or G
gtgngcctgcagngcgacactagtggatccaaagaattcggcacgagaaatagtggtgcttctttctgatctctagtggagatctctttgactgctgtagtactaaagtgtacttaatgttactaagtttaatg

SEQ ID NO: 10078 - DNA, 100 bp, Homo sapiens
  misc_feature 3, 11, 40, 53, 67, 96, 97: n = A,T,C or G
tcnaggcgcgncacatagtggatctaaagaattcggcacnagccagtgctggngagctctctctttntgcaactaatctcatttcaccaggagctnncag

SEQ ID NO: 10079 - DNA, 112 bp, Homo sapiens
  misc_feature 5, 19, 40, 77, 90: n = A,T,C or G
cgtcnaaagaattccggcncgagcctctaacagcctgagnaaagtaggcacaaaggcggcactcagctttctaacancaccgacttgaanaaagtgtttgtatcactttgga

SEQ ID NO: 10080 - DNA, 400 bp, Homo sapiens
  misc_feature 2, 15, 37, 79, 99, 150, 180, 185, 196, 229, 243, 247, 330,389: n = A,T,C or G
tngggggtccaaggnaattcggcacacagcgtgaggncggcagcccagggccagccacgatttgaacgctctgccttgnagtctcttctggaccgaggngcccaaagccctaccctcaccattcaccaggtcctgtgggaagagcagcgngaaggtgggctgaggttacaaggtgcagancgtgnaagaagattgngagctgagtattggacatctgttcttgaatagnccctgggcctgccntagnaaaggaagttctccagggttacagttcttatccgcatgaatacacatggctctgttaccgaaaaattaatcaggtgctgctgntccttctgatcgtgaccctctgtgcgattctgtataagaaagttcataaggggacttgngccccaagaat

SEQ ID NO: 10081 - DNA, 339 bp, Homo sapiens
  misc_feature 9, 26, 27, 30, 32, 34, 75, 81, 146, 223, 260, 305, 337: n = A,T,C or G
catatgagngagtctgtgtgagcctnntgngngngactagtggatccaaagaattcggcacgagcttttcttgangacctnaagagttttgtcaagagccagtagagcagacagatgctgaaagccctagtttcatggcaggcttnggccagtgaacaaatcctactctgaagctagacatgtgctttgaaatgattatcatcctaatatcatgggggaaaanataccaaatttaaattatatgttttgtgtgctcattnattatcatttttttctgtacaaatctattatttctagatttttgnataacatgatagacataaaattggtttatctnct

SEQ ID NO: 10082 - DNA, 291 bp, Homo sapiens
cgacactagtggatccaaagcaattcggcacgagcggcacgagcaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgtt

SEQ ID NO: 10083 - DNA, 400 bp, Homo sapiens
  misc_feature 7, 8, 51, 52, 164, 182, 188, 206, 227, 330, 343, 371: n = A,T,C or G
tgggagnntagtggtatccaaagaattcggcacgagcgagccaggattccnnatccagagacaatggccccgatgggatggagcccgaaggcgtcatcgagagtaactggaatgagattgttgacagctttgatgacatgaacctctcggagtcccttctccgnggcatctacgcgtatggntttganaagccctctgccatccancagcgagccattctaccttgnatcaagggttatgatgtgattgctcaagcccaatctgggactgggaaaacggccacatttgccatatcgattctgcagcagattgaattagatctaaaagccncccaggccttggncctagcacccactcgagaattggctcancagatacagaaggtggtcatggcactagg

SEQ ID NO: 10084 - DNA, 221 bp, Homo sapiens
  misc_feature 3, 8, 32, 79, 105, 151, 189, 209: n = A,T,C or G
gantgcantctgcgtgcgcctgcaggcgcganactagtggatccaaagaattcggcacgagctaaaccgactgagtggngaaaagaagaagggaccccttgttgnccaaaataatccagacaaatcaaatcggccctttccagcatggagnggaacagcccaagggtggctagatcacatcttctgctnacaccaccactgagcaaccntctccaggactg

SEQ ID NO: 10085 - DNA, 105 bp, Homo sapiens
  misc_feature 27, 35, 54, 96: n = A,T,C or G
accatatgacgtgagtactgtgtgagncctgctgngcgacgactagtggcatcnaaagaattcggcacgagccttatgcccctcactcaccttaanatttaagtt

SEQ ID NO: 10086 - DNA, 172 bp, Homo sapiens
  misc_feature 4, 8, 82, 86, 131, 160: n = A,T,C or G
cgantagnggctctaaagaattcggcacgagcggcacgagccaaagagcccttcgagcaccacgcaagaagatccatcgcanagtnctaaagaagaacccactgaaaaacttgagaatcatgttgaagctnaacccatatgcaaagaccatgcgccggancaccattcttcg

SEQ ID NO: 10087 - DNA, 400 bp, Homo sapiens
  misc_feature 2, 7, 48, 71, 138, 143, 149, 202, 213, 238, 316, 318, 346,363, 369: n = A,T,C or G
cngtagngagactagtggatccaaagaattcggcacgaggcaagatgncctttttatgactgccatgcttnttttggactcagtgaatatttgtaatgttagaaaagtctcattatttttataaaatgcatgacattntaagnatgtgntgcataaaatggattatagcagttctcatggtttaggatttttaagaaatagnccatttaattncagcttaaccttttaaatgatctgnaaaatttctttgatagtttaggaatgttgtggggagggttcattaataaaagttcagcaattttttaactgaaatagntnatctcttttacctagtcacaaaaaaggnatgtaaacaaggccatnatatgngtttattgctctttatttccctatctagatt

SEQ ID NO: 10088 - DNA, 400 bp, Homo sapiens
  misc_feature 5, 8, 33, 43, 50, 56, 122: n = A,T,C or G
ccctnatnggaaccttatagtggagttcgtgtnacacattcantgggcgnataacngttccaaggcatgtcggcacgagcttgactactcgcatcgcgcactttttggatcggcatctagtntttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggat

SEQ ID NO: 10089 - DNA, 399 bp, Homo sapiens
  misc_feature 4: n = A,T,C or G
ctantggttccaaagaattcggcacgagcaggcctggccttctgcgaccctgagaagcagcacatctggcacatcccaggcctgtggcacggagcacctcccatggccgcagtgagcttggcctacagtgaagccatatttgaattgaagagatgcctactcgaaaacatcaggaacggcttgtcgaaccaaaacaaaaacatccagcagctcattgagctggtgagacggctgtgagtgtgcagagaaacccagttcaggtgtaggaggctgctgtgggcagccctgtctgatggggcacccgtgtggggctgtgctctggtgcctgagaatggctggtgcccaatcgacatgagaagacgagcaaaagacagagggtttggagtctcctcaacagtg

SEQ ID NO: 10090 - DNA, 400 bp, Homo sapiens
  misc_feature 7, 8, 30: n = A,T,C or G
actgcanngggacactagtggatccaaagnaattcggcacgaggccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccact

SEQ ID NO: 10091 - DNA, 398 bp, Homo sapiens
  misc_feature 5, 19, 29, 32, 38, 41, 45, 238: n = A,T,C or G
ccctnaaagcacccttatnagtaggagtncgngtgacnctncacngggagactaatggttccaaagcaattcggcacgagctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcntctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctgg

SEQ ID NO: 10092 - DNA, 303 bp, Homo sapiens
  misc_feature 8, 13, 55, 73, 108, 225, 250, 256, 273, 289: n = A,T,C or G
cctgctgngcganactagtggatccaaagaattcggcacgagctcacagatcctncctgtcctgcctcatttnactgattggaatgtggaaatggaaaaggaatttangatgtgcattttcacctgaggtttccctgcatccctgcagtgcctaagccccaccttcagggaccacctggaatgtgtgaggggctgacagcacagtaacgtgcatacatatctgcngggctggaatggaagctttaaaggnggtagngatttttattttggaanaatcatgttacctttntgttaaataaaatt

SEQ ID NO: 10093 - DNA, 399 bp, Homo sapiens
  misc_feature 11, 28, 29, 31, 47, 72, 92, 93, 125, 180, 317, 341, 373: n = A,T,C or G
cctatgagtgnagtatgtgtgagcctgnngngcgagctagtggctcnaaagaattcggcgcgaggaaggatncaacctcctacttacctggnntttccggtgaccaaccccatcctgaagctatntaagggttcaccctaagtcacctcagtagcataaactcagatgtgatcaataggngcttcattatgaataacaaaagacactactatcactcaggaaattctaagggctttagcggctctgtgctaggaaccagggacaaagaccaaatatatttctctaaatgtaccctatcatcctaatgggctcaaggnggtatcttattgtggtttccgatntgccctttccccagtgattactgacattcagnatctttggtgcttattagcaatttga

SEQ ID NO: 10094 - DNA, 245 bp, Homo sapiens
  misc_feature 8, 49, 51, 71, 72, 82, 123, 149, 172, 188, 213: n = A,T,C or G
cctgcagngcgacactagtggcatccaaagaattcggcacgaggcttgngnaagacaagtctgaggcttgnngagtctgtgnggccagcagcctctgatctgtgcagggtattaacgtgtcanggctgagtgttctgggatttctctanaggctggcaagaaccagttgttntgtcttgcgggtctgncagggttggaaagtccaagccgtangacccagtttcctttcttagctgatgtctttg

SEQ ID NO: 10095 - DNA, 208 bp, Homo sapiens
  misc_feature 7, 13, 33, 133, 134: n = A,T,C or G
tgtgtgngcctgnagggcgacactagtggatcnaaagaattcggcacgaggttcgatgcagcagatacctttacaccctggacatcactgacaaagagaaggcagagaaactgaagcagtccctgccccccgnnttggcagtgaaggaactgaaatgaaccagacacactgattggaactgtattatattaaaatactaaaaatccta

SEQ ID NO: 10096 - DNA, 380 bp, Homo sapiens
  misc_feature 4, 21, 29, 37, 39, 40: n = A,T,C or G
tatncgaacactattgtctgnagtctcgngcgcctgngnncgacactagtggatccaaagcaattcggcacgaggtagaagcggatgaaaaaccagcgtagggccaggcgcagtggctcacgcctgtaatccctgcactttgagaggctgaggcaggtggatcacgaggtcaagagatcgagaccgttctggccaacatggtgaaaccccgtgtctaataaaaatacaaaaattagctgggtgtggtggcgtgtgcctgtagtcccagctactcgggaggctgaggcaggagaatcacttgaacctgggaggcggaggtggcagtgagccgagatcgcaccactgcactccagcctgttgacaaagcgagactctgtctc

SEQ ID NO: 10097 - DNA, 398 bp, Homo sapiens
  misc_feature 5, 16, 29, 32, 33, 35, 38, 39, 60, 260: n = A,T,C or G
cactnaagcacctttngtgggtctgtgtnacnntncanngggagactagtggatccaaanaatcggcacgagcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgngtgccaaaggaagaagctcccagggctgcttccttcacctgcagaaagccccaagtgagccaccagcactcatggggcagtccctgtccaggctgcccagggcttctcatagacgtcctgagaaggacggtgtaatgc

SEQ ID NO: 10098 - DNA, 266 bp, Homo sapiens
acactagtggatccaaagcaattcggcacgaggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggca

SEQ ID NO: 10099 - DNA, 148 bp, Homo sapiens
  misc_feature 4, 22, 27, 51, 80, 141, 148: n = A,T,C or G
cctnaagtgcgagacatagtgncatcnaaagaattcggcagcgaggccggncagcttggagaaggcgcaatactctccancttcaccgttaccgctaatataagtaaagtttgtaaaattcatacttaataaacaatttangacaggn

SEQ ID NO: 10100 - DNA, 100 bp, Homo sapiens
  misc_feature 7, 13, 29, 33, 34, 67, 69: n = A,T,C or G
cacctancagcgngaatatgccaccatanacannaattgggatccggcgtagggagaactggccaananctcaaagaggcagcattggaaccatcgatgg

SEQ ID NO: 10101 - DNA, 400 bp, Homo sapiens
  misc_feature 9, 23, 27, 31, 77, 102, 116, 123, 160, 175, 197, 201: n = A,T,C or G
ccctatagngagtactgtgtgancctnctgngcgagactagtggcatccaaagaattcggcgcgagctcgtgccganttcggcacgagtttttctgtagctnaaaggtgagggagnttattanttaaccaaatatcgctgagaggaatttaaaatactgntactaccgaagattnttattaataaaggcttatattntggnaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtc

SEQ ID NO: 10102 - DNA, 400 bp, Homo sapiens
  misc_feature 9, 22, 34, 76, 117, 125, 144, 170, 172, 212, 213, 227, 277,367: n = A,T,C or G
ccctatagngagtctgtgtganccttctgtgggngactagtggcatccaaagaattcggcacgagctcgtgccganttcggcacgagttggattacagaatgacctcttctccttgnctcgagcnggaatcattagcactgtanaggttctaaaagtcatggaggctttngngaatgagcccaattatactgtatggagcgacctgagctgnnacctggggattctntcaactctcttgtcccacacagacttctatgaggaaatccaggagtttgngaaagatgtcttttcacctataggggagagactgggctgggaccccaaacctggagaaggtcatctcgatgcactccctgaggggcttgnttctgggaaaactaggaaaagcaggacataagg

SEQ ID NO: 10103 - DNA, 400 bp, Homo sapiens
  misc_feature 11, 21, 33, 34, 42, 372, 381: n = A,T,C or G
tgggccctaangaacctattntgaggctcgtgnncctgcagngggacactagtggatccaaagaattcggcacgagatttcctaaagtacctggcaaagaattctgcaactttgttcagtgccagcgattatgaagtggctcctcctgagtaccatcggaaagctgtgtgagaggcactctcactcacttatgtttggatctccgtaaacacatttttgttcttagtctatctcttgtacaaacgatgtgctttgaagatgttagtgtataacaattgatgtttgttttctgtttgattttaaacagagaaaaaataaaaggggggaatagctccttttttcttctttcttttttttttacattccaaaatngctgccagngttttcaatgatggacaac

SEQ ID NO: 10104 - DNA, 300 bp, Homo sapiens
  misc_feature 12, 13: n = A,T,C or G
gcgcctgcaggnngacactagtggatccaaagaattcggcacgagctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagt

SEQ ID NO: 10105 - DNA, 400 bp, Homo sapiens
  misc_feature 2, 3, 168, 380: n = A,T,C or G
cnngggacgactagtggatccaaagaattcggcacgaggtttgacttgttcttttcagaaggctaaagtcagaggaatgggggctgggccactcccttggagctctcagatctacagacaagctgtgtgaatgcatagatgtaatcttgtctcaaatactaatacagnggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaaggttttaaatcctcctccttcccttttttctggagncttgagggccagagtttttg

SEQ ID NO: 10106 - DNA, 391 bp, Homo sapiens
  misc_feature 7, 8, 330, 351, 354, 377: n = A,T,C or G
cccttcnngggacgactagtggatccaaagaattcggcacgagagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaaattattgacaaaactgaagcacatttacccagctcctgaaaaccnttgtcttatggccccaaaggntanaggttctgggtaaaaacctggangagggaagggtttt

SEQ ID NO: 10107 - DNA, 396 bp, Homo sapiens
  misc_feature 23, 27, 28, 29, 75, 147, 150, 210, 222, 251, 262, 305, 351,382: n = A,T,C or G
ccctatgagtgagtctgtgtgancctnnngtgggacgactagtggctccaaagaattcggcacgagtgtcagcgntggtatttcacattcaatggagctgaatgttcaggacctcttcccattgaagctataatttatttggaccanggnagccctgaaatgaattcaacaattaatattcatcgcacttcttctgtggaaggactttgngaaggaattggngctggattagcggatgttgctatctgggntggcacttgtncagattacccaaaaggagatgcttctactggatggaattcagnttctcgcatcattattgaagaactaccaaaataaatgctttaattntcatttgctacctctttttttattatgcctnggaatggttcactt

SEQ ID NO: 10108 - DNA, 399 bp, Homo sapiens
  misc_feature 4, 13, 50, 55, 138, 317, 342: n = A,T,C or G
gtgngcctgcagngcgacgactagtggctccaaagaattcggcacgaggntgggncctacaggcgcacacgaccacgcccagctaatttttttgtatttttagtagagttggggtttcaccatgttagccaggatggnctcgatctcctgacctcgtgatccactcacctcagcctcccaaaatcctggggttacagatgtgagctaccactcacggcccaaatcttcttgatcatatggttaaatatattttttaatatttggagcatgagttgccacttcttgtttgccttttttataaggaaatgttggagagntacatcattgctaatgtagaaatgntaagtggaaaaatatacagtttggtaaaataaactagattctacatttatttgtggg

SEQ ID NO: 10109 - DNA, 397 bp, Homo sapiens
  misc_feature 7, 38, 64, 374: n = A,T,C or G
atccaangaattcggcacgagcagtagacaaagatcgncggaacatgttgcagttcaacctgcngatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatnttccacactgtcaccaccacaga

SEQ ID NO: 10110 - DNA, 336 bp, Homo sapiens
  misc_feature 3, 4: n = A,T,C or G
tgnngctcgtgcgcctgcagggggacactagtggatccaaagaattcggcacgaggattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatg

SEQ ID NO: 10111 - DNA, 262 bp, Homo sapiens
  misc_feature 2, 18, 71, 108, 129, 144, 210, 257: n = A,T,C or G
gngacgactagtggatcnaaagaattcggcacgagggctgacctgacctgatgtccattcatcccaccctntcacagttcggacttttctcccctctctttctaaganacctgaactgggcagactgcnaaataaaatctcggngttctatttatttattgtcttcctggaagaccttcgggacaaggcagaggcaggaaactaactggngtgagtcaaatgccccctgagtgactgcccccagcccaggccagaanacctc

SEQ ID NO: 10112 - DNA, 380 bp, Homo sapiens
  misc_feature 5, 15, 38, 42, 48, 165, 170, 187, 208, 280: n = A,T,C or G
gacantagtggatcnaaagaattcggcacgagaggagntggnacgcanggatctctgcagcgccctgacctccacgccctcctaggaaagaccacgctgatcaaggcactgacgggcgatgccgccatccagccacgggaccagctgtttgccacgctggacgtnacggnccacgcgggcacgctgncctcacgcatgaccgtcctgnacgtggacaccatcggcttcctctcccagctgtcgcacgggctcatcgagtccttctacgccaccctggaanacgtggaccactcggatctcatcttgcacgtgagggacgtcaagccaccccgagcggacctccagaaatgcagcgttctgtccacgctgcgtggcctgca

SEQ ID NO: 10113 - DNA, 400 bp, Homo sapiens
  misc_feature 6, 9, 32, 33, 55, 101, 166, 167, 200, 311: n = A,T,C or G
tctggncgnattggggcgtctaaggaagtacnncgcgcagtcaatagtagaaatncattgatcaggtaagaactaaacaagaccaagcctatttggaccanaaaccctgatgacatcagcccaagaggagtatggagaattctacaagagcctcactaatgactgnnaagaccacttggcagtcaagcacttttctgtanaaggtcagttggaattcagggcattgctatttattcctcgtcgggctccctttgacctttttgagaacaagaagaaaaagaacaacatcaaactctatgtccgccgtgtgntcatcatggacagctgtgatgagttgataccagagtatctcaattttatccgtggtgtggttgactctgaggatctgcccctgaacatc

SEQ ID NO: 10114 - DNA, 340 bp, Homo sapiens
  misc_feature 22, 28, 30, 32, 37, 48, 144, 198, 205, 229, 263: n = A,T,C or G
catatacgtgagtctgtgtgancctgcngngngacgnctagtggatcnaaagaattcggcacgagccgattgaagcccccattcgtataataattacatcacaagacgtcttgcactcatgagctgtccccacattaggcttanaaacagatgcaattcccggacgtctaaaccaaaccactttcaccgctacacgancgggggnatactacggtcaatgctctgaaanctgtggagcaaaccacagtttcatgcccatcgtnctagaattaattcccctaaaaatctttgaaatagggcccgtatttaccctatagcaccccctctaccccctctagag

SEQ ID NO: 10115 - DNA, 376 bp, Homo sapiens
  misc_feature 2, 3: n = A,T,C or G
anngggacactagtggatccaaagcaattcggcacgaggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattg

SEQ ID NO: 10116 - DNA, 370 bp, Homo sapiens
  misc_feature 8, 18, 344, 354: n = A,T,C or G
gctcgtgngcctgcaggnggacactagtggatccaaagaattcggcacgagacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacggggggaggacaatggatactcagttttttgngtttttttgngtgttttttttttttt

SEQ ID NO: 10117 - DNA, 276 bp, Homo sapiens
  misc_feature 43, 60, 79, 91, 163, 201, 220, 237: n = A,T,C or G
caagatgaagctgaacatctccttcccagccactggctgccanaaactcattgaagtggncgatgaacgcaaacttcgnactttctatganaagcgtatggccacagaagttgctgctgacgctctgggtgaagaatggaagggttatgtggtccgaatcagnggtgggaacgacaaacaaggtttccccatgaagcaggntgtcttgacccatggccgngtccgcctgctactgantaaggggcattcctgttacagaccaaggagacctgggga

SEQ ID NO: 10118 - DNA, 400 bp, Homo sapiens
  misc_feature 16, 24, 27, 31, 38, 42, 53, 87, 102, 113, 140, 153, 166,218, 257: n = A,T,C or G
cgcctatagtagagtntgtgtgancanttantgtgggncgantagtggcatcnaaagaattcggcacgagccgctctggaccgtctnaaggtgtttgacggnatcccaccgcnctacgacaagaaaaagcggatggtggntcctgctgccctnaaggtcgtgcgtntgaagcctacaagaaagtttgcctatctggggcgcctggctcacgaggttgnctggaagtaccaggcagtgacagccaccctggaggagangaggaaagagaaagccaagatccactaccggaagaagaaacagctcatgaggctacggaaacaggccgagaagaacgtggagaagaaaattgacaaatacacagaggtcctcaagacccacggactcctggtctgagcccaat

SEQ ID NO: 10119 - DNA, 400 bp, Homo sapiens
  misc_feature 8, 11, 35, 70, 99, 129, 169, 363, 397: n = A,T,C or G
tagtggcntcnaaagaattcggcacgagccgcatnttcttttgcgtcgccagccgagccacatcgctcanacaccatgggagaaggtgaaggtcggagncaacggatttggtcgtattgggcgcctggncaccagggctgcttttaactctggtaaagtggatattgtngccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgnggagtccactggcgtcttcaccaccatggagaangct

SEQ ID NO: 10120 - DNA, 307 bp, Homo sapiens
  misc_feature 8, 13: n = A,T,C or G
cctgcagnggganactagtggatccaaagaattcggcacgagcacagccggaagcaggctgaccacaagtgctaaggttctggttcaaaagaagaggctgttctaagaaagactaccgagtaatcaatcacctcctcagagaaagtctgctcaggaaactctcctcccaccagcccctgcacttggttccctgcgttgcctctggctggaagctgttgtccccaacttcagaaagtgtctgcagatttcacaggctctctcttgggtcaagggaccagctctgtgaacacggcaagtaacaacagag

SEQ ID NO: 10121 - DNA, 397 bp, Homo sapiens
  misc_feature 2, 17: n = A,T,C or G
antggaggtctcgtgcncctgcagggggacactagtggatccaaagaattcggcacgagctcgtgccgaattcggcacgagctgtctttccttttttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtg

SEQ ID NO: 10122 - DNA, 255 bp, Homo sapiens
  misc_feature 8, 9: n = A,T,C or G
cctgcagnnggacactagtggatccaaagaattcggcacgagagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtgg

SEQ ID NO: 10123 - DNA, 399 bp, Homo sapiens
  misc_feature 17, 27, 29, 30, 36, 37, 44, 48, 49, 58, 398: n = A,T,C or G
ccctatggaccctatgngtgagtcgtntnnccattnntgggcgnctannggatccaangaatgtcggcacgagcggcacgaggcttgaaaaggctttgcagacctcccctgcccccaagactgggtgactttatatgtacttgattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgcctttttttttttna

SEQ ID NO: 10124 - DNA, 395 bp, Homo sapiens
  misc_feature 9, 11, 28, 39, 44, 46, 54, 60, 63, 98, 164, 199, 222, 261,286: n = A,T,C or G
gcttcatananccaacgcgctggaagcnctggtcctaanccacntnttcatgangttccnatncctcctgtcattacagaaacaagaactgaagtggntcatgttatcaggagctatgatccctcagctggggatgttccccagacccaaccagaggagcctgngtcacctaaaccttcacctacttttatggaattgnaaccaaagcccaccacctctagnattaaagaaaaggttaaagcatttcaaatgaaagccagnagtgaagaagatgaccacaatcggnttttaagcaaaggcatgccgtgttaaagaagagactcacataaccacaaccaccagaatggtttatcattctccaccaggcggagaaggtgcatctgaaagaattgaag

SEQ ID NO: 10125 - DNA, 400 bp, Homo sapiens
  misc_feature 2, 3, 90, 97, 104, 246, 258, 283: n = A,T,C or G
tnngtgggcgctagtggatccaaagaattcggcacgagatgaaagatgatactcagttttcttactcaagagccctcaaactcctctggngaatggngggatgntaggaaaggagatgagaaatagcagtggccatgagaacatgcctcctcctttcatgagcctgagattcctggctgtcaaccctgtttatcttttctcttgggagcaaaggagggttcaaagctgagtggggcctgaagctgncaattaacatgngcatttctcttctctgtttcttgtncatctggcgatctggcaccacaggggaagtgacagcctcatcaagggtaagaaatgagcctagtcaccaagaactccacccccagaggaagtggatctgcttctccagtttttgagg

SEQ ID NO: 10126 - DNA, 394 bp, Homo sapiens
  misc_feature 2, 3, 31, 32, 40, 88, 284, 321: n = A,T,C or G
gnnccctatgagtggagtttgtgtgaccttnngtgggacnctagtggctccaaagaattcggcacgaggcacaagaagcagtgatggntgcgtttacatttcctgggtgcacaagaaaaaaattctcaaaaagcaaggacttacgctttttgcaaagcctttgagaagttactggatcataggaagcttataacaagaatggaagattcttaaataactcactttctttggtatccaggaacagtagatgttcaaaatatgtagctgattaataccagcattgngaacgctgtacaaccttgtggttattactaagcaagntactactaggcttctgaaaagtagcttcataattaatgttatttatacactgccttccatgacttttactttg

SEQ ID NO: 10127 - DNA, 227 bp, Homo sapiens
  misc_feature 8, 10: n = A,T,C or G
cctgcagngngacactagtggatccaaagcaattcggcacgagccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctgggga

SEQ ID NO: 10128 - DNA, 160 bp, Homo sapiens
  misc_feature 2, 8: n = A,T,C or G
cntgaagngggacactagtggatccaaagcaattcggcacgagaccacattaacaacataaaaccctcattcacacgagaaaacaccctcatgttcatacacctatcccccattctcctcctatccctcaaccccgacatcattaccgggttttcctctt

SEQ ID NO: 10129 - DNA, 110 bp, Homo sapiens
  misc_feature 7, 56, 62, 66, 70, 72, 85: n = A,T,C or G
atccaangaatgtcggcacgagtcgagttttttttttttaaggccccataattagnaagagncccntcgntnaggcccttgtttnttccctatctagggcaaagccacga

SEQ ID NO: 10130 - DNA, 180 bp, Homo sapiens
  misc_feature 3, 4: n = A,T,C or G
canngggacactagtggatccaaagcaattcggcacgagccaccttggtctcccaaaatgttgggaccacgggtgtgagccaccgcgcccagctagctcctgtgttttgtttttgttttgtaactttggttgatgttaaggccctccattttggaaagcaggaaaacaggattttttttt

SEQ ID NO: 10131 - DNA, 127 bp, Homo sapiens
  misc_feature 5, 18, 78, 86, 123: n = A,T,C or G
tatgngtgagcctgcagngcgagactagtggatccaaagaattcggcacgaggtgcggggctgtgcagactggggtgncaggcatntcctccccacccggggtgtccccacatgcagtactgnatac

SEQ ID NO: 10132 - DNA, 398 bp, Homo sapiens
  misc_feature 2, 7, 87, 104, 133, 199, 329, 350: n = A,T,C or G
gngcganactagtggatccaaagaattcggcacgagggaagacctgtcacagttttatcatcaatgagaagatgaatgggaaagtgngggaccttttccccgangctgacaaagtccgcaccatgctggttangaagatccaggaagagtcactgaggacctacctcttcacctacagcagtgtctatgactccatcancatggagacgctgtcagacatgtttgagctggatctgcccactgtgcactccatcatcagcaaaatgatcattaatgaggagctgatggcctccctggaccagccaacacagacagtggtgatgcaccgnactgagcccactgcccagcanaacctggctctgcagctggccgagaagctgggcagcctggtggagaac

SEQ ID NO: 10133 - DNA, 333 bp, Homo sapiens
  misc_feature 11, 19, 29, 33, 34, 42: n = A,T,C or G
cacctaaggancctatgantgaggtctgngtgnncctgcagngggagactagtggatccaaagcaattcggcacgagggaattcggcttcgacgttggccctgtctgcttcctgtaaactccctccatcccaacctggctccctcccacccaaccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattc

SEQ ID NO: 10134 - DNA, 400 bp, Homo sapiens
  misc_feature 14, 23, 31, 33: n = A,T,C or G
cctatgactggagntctcgtgcncctgcagngngacactagtggatccaaagaattcggcacgaggctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagc

SEQ ID NO: 10135 - DNA, 222 bp, Homo sapiens
  misc_feature 7, 132: n = A,T,C or G
cgactantggatccaaagcaattcggcacgagctatttctctatggtgctacagcatgccagtaaataatatgtaggaccaataataaattatcaattacacatttttgtgttaactaattaaaagcatagngtataagtgagtacactctaattaacttgcttctgttgcactttagttttctacctgcatatggactgcatttttttttttaacacagtc

SEQ ID NO: 10136 - DNA, 100 bp, Homo sapiens
  misc_feature 10, 27, 28, 31, 35, 41, 43, 60, 73, 76, 78, 82, 83, 92: n = A,T,C or G
ccatatacgngagtatgtgtgagcctnntgngcgngctagngnctctaaagaattcggcncgaggggcacgangcngnacanncacacgaanggcaggag

SEQ ID NO: 10137 - DNA, 144 bp, Homo sapiens
  misc_feature 17, 32, 33, 34, 35, 37, 48, 52, 55, 72, 82, 89, 135: n = A,T,C or G
ccctatagagcctatgngtgaagtctgtgtgnnnntnacttgggacgnctantgnatccaaagcaattcggnacgagattgnaatgagnccactttaaatcctttaacgaggatccattggagggcaagtctggngccagcagc

SEQ ID NO: 10138 - DNA, 399 bp, Homo sapiens
  misc_feature 6, 52, 60, 129, 284, 398: n = A,T,C or G
gtgggncgactagtggctccaaagaattcggcacgagtcaagcacccacggnctcctggnctgagcccaataaagactgttaattcctcatgcgttgcctgcccttcctccattgttgccctggaatgnacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggangagcaaccagttactatgagtgaaagggagccagaagactgattggagggccctatcttgcgagtggggcatctgttggactttccacctggtcatatactctgcagctgttana

SEQ ID NO: 10139 - DNA, 286 bp, Homo sapiens
  misc_feature 4, 7, 101, 106, 118, 250, 254, 283: n = A,T,C or G
taangantggagctgcgtgcgcctgcagggcgacactagtggatccaaagaattcggcacgagtataaaataattagggttggtcttttttattttaggtngtttnatgtggaatgtnctatatcttattagttaatttgtatattttattagtattttggaaatagcatatctgagactgaagagaaattgacaattcacttatttgtggtttttttctcagctattctgagcttatttatttatttgnatgntctaatggctaaacatttacattaaatgnttt

SEQ ID NO: 10140 - DNA, 395 bp, Homo sapiens
  misc_feature 3, 4: n = A,T,C or G
canngggacactagtggatccaaagaattcggcacgagctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccag

SEQ ID NO: 10141 - DNA, 147 bp, Homo sapiens
  misc_feature 4, 15, 17, 22, 29, 30, 31, 32, 37, 38, 44, 51, 52, 64, 65,68, 79, 83, 84, 136: n = A,T,C or G
gtanaacaattccangnaatgncatcacnnnnttgtnnagcggncgccaanntggggaagatcnnatngagccctatangganncgtataacaatgcactgactcctctctgggaaagcctactgtcctcgaaggnaaatcatccat

SEQ ID NO: 10142 - DNA, 396 bp, Homo sapiens
  misc_feature 2: n = A,T,C or G
anactagtggatccaaagaattcggcacgagcgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgt

SEQ ID NO: 10143 - DNA, 102 bp, Homo sapiens
  misc_feature 9, 11: n = A,T,C or G
aatacaatncnctggccgatatcgactagttctagagcggccgccaccgcggtggagctccaattcgccctatagtgagtcgtattacaattcactggccgt

SEQ ID NO: 10144 - DNA, 100 bp, Homo sapiens
  misc_feature 19, 25, 27, 48, 95, 97: n = A,T,C or G
aaagattcggcacgagctngggccngnttcggctcgagtggaagtgcncgactttaaaaacggatacactggcatctacttcgtgggcgcttcananttg

SEQ ID NO: 10145 - DNA, 276 bp, Homo sapiens
  misc_feature 18, 205, 209, 221, 243: n = A,T,C or G
aagaattcggcacgaggnggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaangatnctgctggccctntgcgagtgggtttcttgtgcanctggcaccaagtgcgggtccggcagcttctgcc

SEQ ID NO: 10146 - DNA, 139 bp, Homo sapiens
  misc_feature 23, 127: n = A,T,C or G
aagaattcggcacgaggctaggngctgagacaggtgtgcaaagttctgaccttcagtggatgagaaatgtcatcagaatgatgcccctgataaccttgcccataaccatgcgtttccccacggcagngtttatgtcctg

SEQ ID NO: 10147 - DNA, 342 bp, Homo sapiens
  misc_feature 17, 171, 191, 214, 222, 224, 261, 264, 274, 306: n = A,T,C or G
aagaattcggcacgagnaggttttgcaacattttggattttcaggttatggatgtcagcctttatacactatgttttttcctatacttacatacctatgataaagtttaatttataagttaggcatagtaagagattaacaacaataactaataataaaatacagcagttntactataataaaagttaagngaatgtggtctttttttcaaaanatcttatngngctgtacttacccttcttgtgatgatatagcacagcngcngttgactgtntgtgccctaaaactgaagaaagcaaatctgcngataaaggaggactgacatattttctggaagagact

SEQ ID NO: 10148 - DNA, 126 bp, Homo sapiens
  misc_feature 81, 104, 107, 115: n = A,T,C or G
gaattcggcacgaggcgaaactctcctcccctcggccccaccgcgtgggacggcgtgaacgtggtgtcggagggatgtcangccttctctgaggcggcgctggngangacgctgncggcgttgcgc

SEQ ID NO: 10149 - DNA, 244 bp, Homo sapiens
  misc_feature 45, 110, 118, 202, 235: n = A,T,C or G
aaggaattcggcacgagcaaaaagcaagcatttcaaataaaaagnacaacataagaacgaaaataagttggtcacattaacactggaagccatctttaagtgagtgctgncatattgngtcacagtaatttttagccaaatatggcgtttgtaaatttaaactttctctcatggaaagggggctggcacctgtcaaagtgtnattttatgccccactatagccactttttatttnggcaattag

SEQ ID NO: 10150 - DNA, 140 bp, Homo sapiens
  misc_feature 123: n = A,T,C or G
aagaattcggcacgaggaatggcctcggcttcgatttggacaagatcagctacttcttgctacagggttgaacactgggcgtatcaaaatatgggatgtctatacgggaaaactcctccttancttggtcgatcatactg

SEQ ID NO: 10151 - DNA, 177 bp, Homo sapiens
  misc_feature 47, 100, 107, 146: n = A,T,C or G
aagaattcggcacgagcagcagcgcgaggtgctgcggcgctgcgtanaagtatcaatcagccggttgcttttgtgagaagaattccttggactgcggcgncgagtcngctgaaagaacactttgcacagttcggccctgtcagcanggtgcattttttaccttttgacaaggagact

SEQ ID NO: 10152 - DNA, 144 bp, Homo sapiens
  misc_feature 8, 42, 121, 124, 138: n = A,T,C or G
cagcaatnacaacaagaccttcgactcttcctgccacttctntgccacaaagggcaccctggagggcaccaagaagggccacaagctccacctggactacatccgggccttgcaaatacanccncccttgcctgcacnctgagc

SEQ ID NO: 10153 - DNA, 198 bp, Homo sapiens
  misc_feature 25, 55, 193: n = A,T,C or G
agaattcggcacgagggaaaacccngaaaaaattgaaaaggaacagagcaaacangcggtagagatgaagaatgataagtcagaagaggagcagagcggcagcctccgtgaagaaagatgagactaatgtgaagatggagtctgaggggggtgctgatgactctgctggggaggggggcctactggctgatgntgatt

SEQ ID NO: 10154 - DNA, 100 bp, Homo sapiens
  misc_feature 51: n = A,T,C or G
aagaattcggcacgaggccgtgccgggtcagtgttagcctccagccctggntgtggaaggcgacagaagtcatggcgatgtttgagccgatgagagccaa

SEQ ID NO: 10155 - DNA, 126 bp, Homo sapiens
caaagaattcggcacgagcctcaatggccttttgctacgtgcctcccgagaaatttgtctttttgtataaatgacaaagtgttgaaaatgtatttcctgaaataaatgtttcaaatgcagaaaccc

SEQ ID NO: 10156 - DNA, 196 bp, Homo sapiens
  misc_feature 3, 4, 29, 31, 99, 164: n = A,T,C or G
tannggttttaaagcaattcggcacgagngnggctcccacctaacaccaatgatgaagtagatgaggatcctacaggaaacaaagccctgtgggaccgnggcttgctcaatggggcctcccagaaggcagaggtgatcatgaactaccatgtcggggagacggngctgtccttgcagaagaccacgctgatccctg

SEQ ID NO: 10157 - DNA, 136 bp, Homo sapiens
  misc_feature 5, 19, 31, 38, 46, 47, 74, 97, 100, 107, 110, 120: n = A,T,C or G
ctggncgtaaaacagattntttggaatgacngcacgangtacttcnnggctaagcgcaaggaacgtgcttgtgnaatcacaactactgtggcttggngancctgtgnggncagcagcctntgatctgtgcagggta

SEQ ID NO: 10158 - DNA, 396 bp, Homo sapiens
  misc_feature 1, 45, 188, 193, 273, 343, 360, 364, 390: n = A,T,C or G
ngactagtggttttcaaagcaattcggcacgaggttaaaagaagngtattctatttatgttgttttaaaatgcctactgagagacaaacatcttgtcattttcactgtttgtaaaagataattcagattgtttgtctccttgtgaagaaccatcgaaacctgtttgttcccagcccacccccagtggntgggntgcataatgccagcaagttttgtttaacagcaaaaaaggaagattaatgcaggtgttatagaagccagaagagaaactgngccaccctaaagaagcatataatcatagcattaaaaatgcacacattactccaggtggaaggtggcaatngctttctgatatcagcntcgnttgatttaggcgcaaaaatgttttcnagacta

SEQ ID NO: 10159 - DNA, 400 bp, Homo sapiens
  misc_feature 2, 18: n = A,T,C or G
gngacactagtggatccnaagaattcggcacgaggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggtttctcaatacggtaccaaagatataatcacctaggtttacaaatatttttaggactcacgttaactcacatttat

SEQ ID NO: 10160 - DNA, 397 bp, Homo sapiens
  misc_feature 4, 5: n = A,T,C or G
ggannctagtggatccttagaattcggcacgagggaaaactgaaagctttttctctaagatcaggaacaaggcaaatatgcccactttcaccacttcaattcaacaaagtactagaagtcctagccagagcaacgtggcaagaaaaagaaataagaaatatccacatcgaaaaggaagaagtaaagttgtccctctttgtgagcaacatcttatgtatagaaaatcctttaaaaatgccataaaaaaactcttcgaactaataaatccagagagttgcaggatacaaaaccaacatatgaaaaattagttgcatttctatacactaaaaacaaactattctgttgtttaagccacccaatctatgatattccattatagcaccctgaactgactgag

SEQ ID NO: 10161 - DNA, 199 bp, Homo sapiens
  misc_feature 8, 11: n = A,T,C or G
ctagtggnttnaaagaattcggcacgagttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctaccccc

SEQ ID NO: 10162 - DNA, 144 bp, Homo sapiens
  misc_feature 19: n = A,T,C or G
aagaattcggcacgagagnacgcgaaggatatcggtttcattaagttggactaaatgctcttccttcagaggattatccggggcatctactcaatgaaaaaccatgataattctttgtatataaaataaacatttgaaaaaacc

SEQ ID NO: 10163 - DNA, 397 bp, Homo sapiens
  misc_feature 3, 15, 39: n = A,T,C or G
agnctagtggatttnagaattcggcacgagttgaattcnagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagatt

SEQ ID NO: 10164 - DNA, 223 bp, Homo sapiens
  misc_feature 4, 26, 44, 52: n = A,T,C or G
tcantgggagactagtggatccttanaattcggcacgagacgangatgaggngacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcccccagggg

SEQ ID NO: 10165 - DNA, 382 bp, Homo sapiens
  misc_feature 13, 16, 33, 213: n = A,T,C or G
acactagtggatnttnagaattcggcacgaggngcgatccctgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggnggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaag

SEQ ID NO: 10166 - DNA, 147 bp, Homo sapiens
  misc_feature 2, 19: n = A,T,C or G
gngacactagtggatccanagaattcggcacgagtgccagtctcattttcatcttcttccatggttccacagaagctttgtttcttgggcaagcagaaaaattaaattgtacctattttgtatatgtgagatgtttaaataaattgt

SEQ ID NO: 10167 - DNA, 346 bp, Homo sapiens
  misc_feature 3, 6, 32, 34, 35, 135, 293, 340: n = A,T,C or G
tancgntatcctttgaattcggcacgagccgngnngagggtaccctgaccagcattgtgcctacaagagatggcaccgcacccccaccccagtccccggggtccccaggcacggggcaggatgaggagtggtcangatgaagagagtccccggaaggctgccacccggggttcgggtgagggcacctctatgactacgctggccaggaagctgatgagctgagcttccgagcaggggaggagctgcttgaagatgagtgaggaggacgagcagggctgggtgccaaggccagnttgcagagtggcccgcatttggccctgtacccctgccaaactacgtnggagtg

SEQ ID NO: 10168 - DNA, 358 bp, Homo sapiens
  misc_feature 29, 63, 68, 173, 176, 229: n = A,T,C or G
aattcggcacgagtgatcgccgccctggnaaaaagctggaagatggccctaaattcttgaagnctggngatgctgccattgttgatatggttcctggcaagcccatgtgtgttgagagcttctcagactatccacctttgggtcgctttgctgttcgtgatatgagacagacnggngcggtgggtgtcatcaaagcagtggacaagaaggctgctggagctggcaaggncaccaagtctgcccagaaagctcagaaggctaaatgaatattatccctaatacctgccaccccactcttaatcagtgggggaagaacggtctcagaactgtttgtttcaattggccatttaagtttagt

SEQ ID NO: 10169 - DNA, 307 bp, Homo sapiens
  misc_feature 3, 12, 31, 32, 154, 208: n = A,T,C or G
tgnccccgcagngggacactagtggatccanngaattcggcacgagatggccaatatcaaactggcttatccttgttcactttgtattgaccaaggtttgggctcagcatggtgaattttaagtggggtggcatatttgttattatttattttnggctttaaggtaacacagatgaaaaagaaatcatattttacctacccagaaagntcctctttgatataaaattagacatttaatatgtatatcttaattttttggggtaaattagtaaagtaaaacaagtcagtccagcaaatgtgctccagt

SEQ ID NO: 10170 - DNA, 317 bp, Homo sapiens
  misc_feature 17, 22, 173, 178: n = A,T,C or G
aattcggcacgaggggngggcncccctcttgctgcctgttgattctctgcccctcagcataacagtgcatgttaaatttcaaatgtcaggctccaaaagatggaggaacaaaacgcagttagtactagttctgttgcccctgggatcccccacctcttctgtgcccagagagnggggngtctgcagtgcccatctgtgtatttggccccaaacccaccccttttgggtctttgtccctcttgtcacaacctgagtcttgggacccaagagcagggagtcaggtgaccctgaccctgcggaacactgtgttgtggtga

SEQ ID NO: 10171 - DNA, 250 bp, Homo sapiens
  misc_feature 5, 10, 28: n = A,T,C or G
cccgnagggngacactagtggatccttngaattcggcacgagacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactca

SEQ ID NO: 10172 - DNA, 400 bp, Homo sapiens
  misc_feature 6, 19: n = A,T,C or G
cctgcntgacacccgcagngggacgactagtggatcctttgaattcggcacgagtctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcagga

SEQ ID NO: 10173 - DNA, 400 bp, Homo sapiens
  misc_feature 11, 12, 48, 49, 51, 53, 54, 151, 210, 381: n = A,T,C or G
tgacccttcanngggcgactagtggatctttagaattcggcacgaganngncnntccaccttactaccagacaaccttagccaaaccatttacccaaataaagtataggcgatagaaattgaaacctggcgcaatagatatagtaccgcangggaaagatgaaaaattataaccaagcataatatagcaaggactaacccctataccttntgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggggatagctggntgtccaagatagaatctta

SEQ ID NO: 10174 - DNA, 314 bp, Homo sapiens
  misc_feature 4, 5, 49, 50, 301: n = A,T,C or G
gcanngggacactagtggatccttagaattcggcacgagcacgaacaannaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgntttgttggctaca

SEQ ID NO: 10175 - DNA, 400 bp, Homo sapiens
  misc_feature 8, 12, 207, 296, 366, 396: n = A,T,C or G
tgaccctncacngggcgactagtggatccaaagaattcggcacgaggaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagnggtatttggcatgatacataatgtttgattctatgccatttggacccaattctgattacttacagaagaaggactgatacaaagaaagngcatgaggcaatgtcagtattatctgacatctttcttttcaggtcatgtgtccctgaaaagttaaatgtnaaccagattttggtaaatcccatctttcanaagt

SEQ ID NO: 10176 - DNA, 377 bp, Homo sapiens
  misc_feature 2, 7, 41, 44, 46, 298, 364, 368, 370: n = A,T,C or G
cnggganctagtggatccttagaattcggcacgagaccggncgngngcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggnctgtcacagtctgctccttttttttgtccgccacacgtaactgagatgctcctttaaataaagcgnttgngnttcaagt

SEQ ID NO: 10177 - DNA, 370 bp, Homo sapiens
  misc_feature 18, 24, 214, 330: n = A,T,C or G
aagaattcggcacgaggntgagancttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggnggaagaacggtctcagaactgtttgtttcaattggccatttaagtttagtagtaaaagactggttaatgataacaatgcatcgtaaaaccttcagaaggaaaggagaatgttttgnggaccacctttggttttcttttttgcgtgtggcagtttta

SEQ ID NO: 10178 - DNA, 400 bp, Homo sapiens
  misc_feature 3, 4, 398: n = A,T,C or G
canngggagactagtggatcttagaattcggcacgaggggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgcttgagacagagctggagatgaggccagaccatggacactacacccagcaatagagacgggactgcggaggaaggaggacccaggacaggatccangg

SEQ ID NO: 10179 - DNA, 398 bp, Homo sapiens
  misc_feature 8, 10, 32, 34, 152: n = A,T,C or G
ctagtggntncaaagaattcggcacgaggggntntccagttacttgttgatatgtgtacataaaatgtatttccatatatttatgtgtctgtatgtgtatgatagaatctagactagagctagaggttaccgattatctgaaattgtgatangagtttgccaaattgccttccaaaaagactgtatccggttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgccctt

SEQ ID NO: 10180 - DNA, 396 bp, Homo sapiens
  misc_feature 7, 37, 41: n = A,T,C or G
agactantggatctttagaattcggcacgaggttagngcgncgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaacctggtcaagaagctggccaagaagtattgatgcgttttttggccctcag

SEQ ID NO: 10181 - DNA, 149 bp, Homo sapiens
  misc_feature 82, 84, 86, 120, 125, 130: n = A,T,C or G
tagtctcatctattcagtccccaagttagggatctcacattatctgaattaccaccatgttatttatgtatttagagccccngntnggtaattaattaaagagagacccattgctttttnaattnggggntgaactttgcctaaccaat

SEQ ID NO: 10182 - DNA, 156 bp, Homo sapiens
agccaggcctagctttgaactgagtttcaagggctgccaaagaggggcagtgggttggggtttgtttttactacaaaataagttacttagttttataaaagacaaaccgattgtagccaaatgacaccatatttaataaaatttagtctgaagggg

SEQ ID NO: 10183 - DNA, 155 bp, Homo sapiens
  misc_feature 6: n = A,T,C or G
tgcagngggacactagtggatccaaagaattcggcacgagcctgtatcctggaacctgtcctccctttctccccaactatgcatctgttgtctgctcctctgcaaaggccagccagcttgggagcagcagagaaataaacagcatttctgatgcc

SEQ ID NO: 10184 - DNA, 253 bp, Homo sapiens
  misc_feature 14, 16: n = A,T,C or G
acactagtggatcnanagaattcggcacgaggccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaata

SEQ ID NO: 10185 - DNA, 400 bp, Homo sapiens
  misc_feature 3, 6, 42: n = A,T,C or G
tcnccnctgcgccaccaggacccaccgttggctgccatctanttggaacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgcca

SEQ ID NO: 10186 - DNA, 400 bp, Homo sapiens
  misc_feature 3, 4, 140, 231, 242, 272, 281, 305, 332, 346, 353, 367, 396: n = A,T,C or G
cgnnttcggcacgaggaaggacctggaggagtggaaccagcgccagagtgaacaagtagagaagaacaagatcaacaaccgggcatccgaggaggctttcgtgaaggaatccaaggaggagaccccaggcacagagtggnaaaaggtggcccagctatgtgacttcaaccccaagagcagcaagcagtgcaaagatgtgtcccgcctgcgctcgggctcatgtccctgaancagacgccacntgtcccgctaggtgcctgctaggtgcatgnccacaagancatgggcttgggccttgggcacangaggagcagctgcttttggtcgggggntgaaaattcgcagnagtttgntaccccaaagcctntttcccattccctccccattttccaaggngctt

SEQ ID NO: 10187 - DNA, 400 bp, Homo sapiens
  misc_feature 21, 22, 49: n = A,T,C or G
gctgggacgctagtggatccnnagaattcggcacgaggtataccccagnttctgtgttttgccttttcttgcattattctttgtttaatgttttaggtgatgaagccaacccttgcaagtttcaggcctgtaatgaattttcagagtgtctggtcaacccctggagtggagaagcaaagtgcagatgcttccctggatacctgagtgtggaagaacggccctgtcagagtctctgtgacctacagcctgacttctgcttgaatgatggaaagtgtgacattatgcctgggcacggggccatttgtaggtatgttgtagttacagattttgactttagaggctatagatatttcctctaaagaaaaggggcctgcacctataattttaggatacttattat

SEQ ID NO: 10188 - DNA, 118 bp, Homo sapiens
  misc_feature 3, 41: n = A,T,C or G
gangcctgggcccccagggatcccaggactccctggccggnctggccaggcaatcaacggcaaggatggagatcgagggtccccaggggctccaggagaggcaggtcgacctggcctg

SEQ ID NO: 10189 - DNA, 292 bp, Homo sapiens
agaattcggcacgagctcgtgccgaattcggcacgaggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttt

SEQ ID NO: 10190 - DNA, 398 bp, Homo sapiens
  misc_feature 6, 22, 25: n = A,T,C or G
aattcngcacgaggaccctccnggntcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacaca

SEQ ID NO: 10191 - DNA, 400 bp, Homo sapiens
  misc_feature 17, 35, 37, 382: n = A,T,C or G
agtgagtcgtatgaccnttcctgggcgctagtggntncaaagaattcggcacgaggaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtanctgcttgtgtatcttgta

SEQ ID NO: 10192 - DNA, 396 bp, Homo sapiens
  misc_feature 13, 34, 36, 38, 41: n = A,T,C or G
acactagtggatncaaagaattcggcacgagcangngngcncgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatgggg

SEQ ID NO: 10193 - DNA, 342 bp, Homo sapiens
  misc_feature 8, 304: n = A,T,C or G
cctgcagngggacactagtggatccaaagaattcggcacgaggtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagngtgaaattttctatcaactttctcctggtttcatgact

SEQ ID NO: 10194 - DNA, 400 bp, Homo sapiens
  misc_feature 8, 10, 39, 58: n = A,T,C or G
caagccangngcgctatactatggtcagcctatcaccanctttgacactacctggaancttcatatgaactgcagaatctcaggctgctcaagatttgcagaatcagaatctctgggggcagctggggtccagaaatctgtgtttgaatgagcccccaggtgatcctgatgcaccccaaagtttgagaagcaccactataagtcactgattcagacccagttttcttcaacttttcagcataagtagcaggtgtatggttttataaaatatagacttcctctggcataagaagattttaatgtgtgtaccctattgttcaagatacttacaatgtttcgctgcaaacttacaatgggaaatgtaatttgtctcttactgtgctgcaatagcccccttcct

SEQ ID NO: 10195 - DNA, 317 bp, Homo sapiens
  misc_feature 3, 5, 300: n = A,T,C or G
tgngnggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtncgtgtgtgtatgtgtgc

SEQ ID NO: 10196 - DNA, 323 bp, Homo sapiens
  misc_feature 9, 11: n = A,T,C or G
gcacgagcngngggcagggcatgatttgcgggagggctcttgaaccacttctggctgcaccacaattctgtacttgagtatcacagtcattgtttttgagacaaacatttttataattctaatttgggttaataaagattttaaatatttcttggtttacttttggaattatatacacaacaaatgtattaataactaccttgttaaacaccttttaatagcacaaggtttttatatttgcaagctgttgatatctttctaaaactgtttaggttatagtctattgatactttttatatacaattttataaatataaatatta

SEQ ID NO: 10197 - DNA, 396 bp, Homo sapiens
  misc_feature 13, 166, 172, 315, 319: n = A,T,C or G
agactagtggatncaaagaattcggcacgagtctgcccagacagccgcagtgaggatgagcgtcctggcagagacgcagttgtctctgggcgcttgccagagccacgaaccccagacctgtttgtatcatccgggctccttccgggcagaaacaactgaaaatgcncttcanacccacttatttctgccacatctgagtcggcctgagatagacttttccctctaaactgggagaatatcacagtggtttttgttagcagaaaatgcactccagcctctgtactcatctaagctgcttatttttgatatttgggncagnctgtaaatggatacttcactttaataactgttgcttagtaattggctttgtagagaagctggaaaaaaatggttttg

SEQ ID NO: 10198 - DNA, 122 bp, Homo sapiens
  misc_feature 13: n = A,T,C or G
agactagtggatncaaagaattcggcacgaggctgcccctttgtacaccgcgccgcggaaagggggctccgagggggcgcagcctcaaaccctgcctttcctttacttttactttttttttt

SEQ ID NO: 10199 - DNA, 284 bp, Homo sapiens
  misc_feature 58, 278: n = A,T,C or G
agagggccattcagcgcatggagaaaggagaacattccatcgtgtacctcaagcccanctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcgggcacctgtgtaccttcaaggaaggtaaatacaagcaagctttactacagtataagaagatcgngtcttg

SEQ ID NO: 10200 - DNA, 398 bp, Homo sapiens
  misc_feature 7, 18, 34, 36, 57, 58, 65, 214: n = A,T,C or G
tgagtcntatgacccttnctgggacgctagtggntncaaagaattcggcacgagcanncggcggngttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagnacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactcc

SEQ ID NO: 10201 - DNA, 396 bp, Homo sapiens
  misc_feature 13, 38: n = A,T,C or G
agactagtggttncaaagaattcggcacgagggatccntttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattag

SEQ ID NO: 10202 - DNA, 400 bp, Homo sapiens
  misc_feature 5, 8, 52, 156, 162, 201, 204: n = A,T,C or G
ccctncantgggacactagtggtttcaaagaattcggcacgagggggggagntattggcataggtacttatttaaagattttcttccactggatgctatgctaccttgtgtgaacagttgcatttgtctgtttcactacttagcatagtgtgtggngcacangtaggcatggaataatgataataaatggattaaatggangcntgaaggtatacaggagactttaagctatcatagacggttccaggcaggagaatatgaagatgtaatttcaagtacagttgttattgtcagttttgctttccatggtttcagctacccatagtcaatcacaatataaaaatattaaatggaacattccagaaataatacataagttttaagttgctgaataatgtga

SEQ ID NO: 10203 - DNA, 397 bp, Homo sapiens
  misc_feature 3, 15: n = A,T,C or G
cgnctagtggatttnaagaattcggcacgagaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgaca

SEQ ID NO: 10204 - DNA, 321 bp, Homo sapiens
  misc_feature 2, 17, 40, 43, 278, 286, 311: n = A,T,C or G
gntgggacactagtggnttcaaagaattcggcacgagcgngcnttgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgngcattggnagccttccctggacgagcgctcggngttcacactt

SEQ ID NO: 10205 - DNA, 336 bp, Homo sapiens
cacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcatt

SEQ ID NO: 10206 - DNA, 150 bp, Homo sapiens
  misc_feature 2, 86, 104, 116, 119, 137: n = A,T,C or G
gngaagcagtattctggaaagtttttctaagactagtgaagaactgaaggagtcctgcatctttttttttttatctgcttctgttnaaaaagccaacattcctntgcttcataggngtnctgcatttgaggggtagngaaatctttgctg

SEQ ID NO: 10207 - DNA, 335 bp, Homo sapiens
acgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatggcttttggtcttttttgactaaacctcttttataacatgttcaataaaaagctgaccttt

SEQ ID NO: 10208 - DNA, 269 bp, Homo sapiens
  misc_feature 118, 172, 215, 253: n = A,T,C or G
ggggtgggagggggtgtgtctgggtgtgcctattgagagcgtgtaatggcgtttgggagctcgtgtgtgtatgtgtgcgtgtgtgtatgtgtgcatgtgtgtgtgtgtgtgtgtgtgngcaccgtgcgcctgagggtgggcatgagtcttgccagaatgtgagtgtgagagngataatgcaggggtgagtgtgagagggactgcgtttgcatttntataatcaaaagcttaatatattcccatcttttttagntaaccctttcttgact

SEQ ID NO: 10209 - DNA, 291 bp, Homo sapiens
ttcggcacgaggcctgtctgacctccgtgcctagtcgtggctctccatcttgtctcctccccgtgtccccaatgtcttcagtggggggcccccttcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggtttttgtctttaaccttgtaacgcttgcaatcccaataaagcatt

SEQ ID NO: 10210 - DNA, 222 bp, Homo sapiens
gctgaggttgagataaagacgggacctaaggggaaaattccttccctagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattattta

SEQ ID NO: 10211 - DNA, 333 bp, Homo sapiens
  misc_feature 25: n = A,T,C or G
ttgaatcctagcccatctgcagagnaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcatt

SEQ ID NO: 10212 - DNA, 335 bp, Homo sapiens
cgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgcttgacttgataagaggcgcaaaagaaaagaatctcaaagtgaaaggaccagttcgaatgccctaccaagactttgagaatcactacaagaaaaactccttgtggtgaaggttctaagacgtg

SEQ ID NO: 10213 - DNA, 216 bp, Homo sapiens
  misc_feature 4, 36, 69: n = A,T,C or G
ctcntcgccctcctgtctactggctccaaatagacnctgtcagctttcaccccctggcttttgtgtctnctgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaatt

SEQ ID NO: 10214 - DNA, 257 bp, Homo sapiens
  misc_feature 192, 194: n = A,T,C or G
ttcggcacgaggaaatggctgacctgacctgatgtccattcatcccaccctctcacagttcggacttttctcccctctctttctaagagacctgaactgggcagactgcaaaataaaatctcggggttctatttatttattgccttcctgaaagaccttcgggtcaaggcagaggcagggaaactaactggngngagtcaaatgccccctgagtgactgcccccagcccaggccagaagacctcccttcaggtgccg

SEQ ID NO: 10215 - DNA, 326 bp, Homo sapiens
agtaacttaggtgggatacaattcataaaatcttgtctctgggtcttctgaccctcaatgtacactttttttcattaggttaaggtgggtcttttgattcatctacatgcttctggcatcacagttcactgtctgcagtgatttaattctttgtagcataaaagaggaaaagagtcattaggtgtctttttattcctttattcctagctttcatacttagatgttgaaggaaattccatcaatatggtgcaaatgacattcctgaaacttctgactgcctctgctcggcaaaatttcacctaccactgtcatcagtcagcagcctg

SEQ ID NO: 10216 - DNA, 318 bp, Homo sapiens
ggcggtttctgaggttcttcactcgcgactgacggagctgcggtggcgtctccacacgcaaccatgaagttgaaggacacaaaatcaaggccaaagcagtcaagctgtggcaaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaaga

SEQ ID NO: 10217 - DNA, 334 bp, Homo sapiens
caagcttccgaaatccatggtggttgaagaacatcaaagaggagcaattatttcagtcattagggcagttccacctgttctaattgaacatttttaggatgtagaagatgcatcatacattggtatctattcagaaggtggggacatctgctgtctgtcatgtatctgggagatgtttatctcaacaggaggcaataataatatggtaaaccaaacctaatattatcatgatgcattaaaactgggttaattgaagcaataaaatcaaagtaacagtaaatgcttatacaacatgttaaagtaatatttacttcaatcttagaaatgaaatgat

SEQ ID NO: 10218 - DNA, 334 bp, Homo sapiens
atctttggcacagtggtatgtgagcaccttcctggttgagaccagaagctattcccaggcccctgaagctcctgaatagagaggaaatagatcacaagatgggagcagcttagatatgagtcaggtgattttattagttctatggggagtagatgaccttgaaaatcttttccagctctgaacctcattatgagatgtaagtcttgggagatgtccttccaaggggacctcttggaagttaaccttagatacattggccagtattaccatgttattccctgattttatgaaaatcctgtggttttaatagaagcttatggggcaaggagagtac

SEQ ID NO: 10219 - DNA, 330 bp, Homo sapiens
  misc_feature 233: n = A,T,C or G
gttttaagcatgcatgaggactgttggcacagccaacagaaatagtgcttagcaccctgggaatttactgatgcattttaataaccaaagctccaataaaattcccagaacctgcctgtgatctttgtttacatatccagctttcaacatgtttatattcttcttggatgttatttacaacattaaaataaactttaacttttcaaaaagataaaagataataagtgttgggngagcatcttaaggaaagggaacccttgcacactgctggtaggaatgtaaattcccacagccattatggaaaacagtacaaaggtccctcgagagtac

SEQ ID NO: 10220 - DNA, 325 bp, Homo sapiens
cagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcat

SEQ ID NO: 10221 - DNA, 214 bp, Homo sapiens
gagaaattaaaatactagtttcaactaaacaaaagccaaaacctcaaaattttgaaatgcattagttttagagcttagaaggaaatttatatacttaaatgcttataatagaaaagaagaaaagtttaaatcagtgatataagctttcaccttaagctaaaaaaaaactcgagagtacttctagagcggccgcgggcccatcgattttccaccc

SEQ ID NO: 10222 - DNA, 309 bp, Homo sapiens
ctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattat

SEQ ID NO: 10223 - DNA, 115 bp, Homo sapiens
gaaaagctcaaactaacctgatttggggaagccagcagcaggttccttcctgttgttgtctccctttctgcttaagctgaaagccccaataaactgccttgttcaagcccatttc

SEQ ID NO: 10224 - DNA, 338 bp, Homo sapiens
  misc_feature 45: n = A,T,C or G
ctggagctcgcgcgcctgcaggtcgacactagtggatccaaaganttggcacgagggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccg

SEQ ID NO: 10225 - DNA, 325 bp, Homo sapiens
  misc_feature 2: n = A,T,C or G
gngtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccgtcacacttgggcaggtgttcagtgactggtaggtgtagatacagcaggagtggccatgtggtccacggctttttaccccttcttgatcctgatttcttgggctgaatttagact

SEQ ID NO: 10226 - DNA, 206 bp, Homo sapiens
tttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgttt

SEQ ID NO: 10227 - DNA, 333 bp, Homo sapiens
atataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaac

SEQ ID NO: 10228 - DNA, 334 bp, Homo sapiens
cggtagcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtaggttatgtgacacatgaaaccaaacacttcatctacttctacctgggcca

SEQ ID NO: 10229 - DNA, 330 bp, Homo sapiens
ggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcaccttagatgtccccagcacccagttctgagccaggcacatca

SEQ ID NO: 10230 - DNA, 333 bp, Homo sapiens
ggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatatttttaagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgctttt

SEQ ID NO: 10231 - DNA, 337 bp, Homo sapiens
  misc_feature 2, 243: n = A,T,C or G
gngctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgngcaagtacttttatacataagataaacaaaaaccttaccaccaaacataccaaaatgcacctctttcataagtgagttactaagatttctatac

SEQ ID NO: 10232 - DNA, 326 bp, Homo sapiens
gccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgt

SEQ ID NO: 10233 - DNA, 326 bp, Homo sapiens
  misc_feature 262: n = A,T,C or G
ttcggcacgagatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggngctaatgggtctgtggaccctcgctctctgtctccaggcagttctctcgaatactttgaatgtt

SEQ ID NO: 10234 - DNA, 325 bp, Homo sapiens
  misc_feature 215: n = A,T,C or G
ttcggcacgaggaacaaaagagaattactgggatcattttttccttaaaaaagaaaaataatcactggagcagcagcctttcttgttagcatccataactgcacgcttcatttctcccactggtctgcacttgctgcggccagataaaaaagcccaggcctagtctactttgaatcactgcactctccagtcagtaaagctattttattccaggnggcaatggatatcttcctttaactgagtttccaaaagtaattaaagtgagtacctgaaatctggcagttaaaggcagtttttcaaaaagcaccatggcaaagcataatgt

SEQ ID NO: 10235 - DNA, 131 bp, Homo sapiens
  misc_feature 130: n = A,T,C or G
ctcagattgtgtagatatgctatttaaataatttatcaggaaatactgcctgtagagttagtatttctatttttatataatgtttgcacactgaattgaagaattgttggttttttcttttttttggttng

SEQ ID NO: 10236 - DNA, 349 bp, Homo sapiens
  misc_feature 10, 273: n = A,T,C or G
aaaatttgcnggctttttgtctttttagttttggatagaaaatctttctaaagattgctgcttaaatgggttaactcagctatatcaactagaagtcttaaaaaaagtacctgaaaactatatacataccccaagttcatctaaaaacatgatcatacgatgtttgttgcttttgatgaatggattgacaccttccatgtagggctcctgaaaaataaaatgcttctgttatatgcaccagaaacaaaccactgtttgatctattaggttggngcaaaagtaattacagttaacagcaaaaactgcaattactattgcaccaaattaatatagcaaaacccatacatgt

SEQ ID NO: 10237 - DNA, 337 bp, Homo sapiens
cggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtctttgtccatgaaactgggaggcgaccgtgttagctgccagttcctgacagccacctctcaccagtggcttcactctgtgtccctgacccagcacatggcacaagagtgcctgccatccgtcagtgttt

SEQ ID NO: 10238 - DNA, 338 bp, Homo sapiens
  misc_feature 254: n = A,T,C or G
taaatatgaacattcatccaattgaatttacaaaatctttccaaaattataagggagaaaaatcgggtttacttccatctttaaaaatctggcacctcttagtaactttcagtatttctaaattgctctaaaattttataataaaatagattagggttttgcaatagtcttaatttttaagccaaaggttttctgagaccttaggttttgtagtctaaccagcttgtgtggttatttaaaagaatattctttgngtttttaaattgctatttttaaaaaagctttttattacccattttataaaatgttatactcatatttgtctgaatttttccagt

SEQ ID NO: 10239 - DNA, 336 bp, Homo sapiens
agaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctt

SEQ ID NO: 10240 - DNA, 325 bp, Homo sapiens
ctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggaggtgtgggtagagccggggaaggacccagccctgccaggctgaaggagggcttcctcacggacacacaggccaggaggc

SEQ ID NO: 10241 - DNA, 207 bp, Homo sapiens
  misc_feature 20, 38, 44, 46, 48, 84, 92, 99, 101, 115, 135, 144, 147,154, 164, 168, 198, 204: n = A,T,C or G
tttttttttttatatttttnaactaatggctgagcctntgcatntnanctggcctgggaggaggcttcctgatctatggttgancaattggngggacananaggggaggacaggngaggagtcaggccgatccancatcacctntgngctgggngatcttgggngggngccatcccttccctgggccttagtctactnttcggncat

SEQ ID NO: 10242 - DNA, 324 bp, Homo sapiens
  misc_feature 146: n = A,T,C or G
ttcggcacgagccccacctcaccatctcccagaccctcttccctttgcccttctcctccaatacataaaggacacagacaaggaacttgctgaaaggccaaccatttcaggatcagtcaaaggcagcaagcagatagactcaaggngtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctga

SEQ ID NO: 10243 - DNA, 334 bp, Homo sapiens
ccagagagttccagtgggcagatgtctgtggctgcccttctcatttaaggacatgagttcactggagtattactcaaaaagtctgtggtccatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgtt

SEQ ID NO: 10244 - DNA, 327 bp, Homo sapiens
ttcggcacgagcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtgggggtctccaggcctgtcatcgc

SEQ ID NO: 10245 - DNA, 334 bp, Homo sapiens
gcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtctt

SEQ ID NO: 10246 - DNA, 335 bp, Homo sapiens
gaaaaatttatctgcatatattaatagtagataggttttataccccacctctccctgctatgagatgttaaaagtatgggaagaaattatactgacagaataaaatttagattgtatgtataggaaatgtcagcagaaaattttaacttgaaagccctgggtaattaacatttctctctccttcaaactgatattaagaaatccagccaggtgcagcggtacacactgtaatcccagcactttgggaggctgaggcaggaggattgctcaaactcaagagtttgaggctgcctgtaatggtacccctgcactctagcctgggtaacagatcaaca

SEQ ID NO: 10247 - DNA, 333 bp, Homo sapiens
ggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcaagatggtcagaacaaataaagttcagtg

SEQ ID NO: 10248 - DNA, 336 bp, Homo sapiens
ggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggcttgttgttccattgaagccgactctggccctggcccttacttg

SEQ ID NO: 10249 - DNA, 317 bp, Homo sapiens
  misc_feature 2, 13, 139, 237, 257, 268, 311: n = A,T,C or G
cntgtaccctcgntcgtctgagctgtgtgcagacaacatccccccaccacccaagagggagggtagctcttccgccaccaggggcaagcacaggtcctggtggccccacgccacatgttaagcccccctggaggggccncaagttggagacgggggctgggtgtcccttggcccactcccagtcccctgtgctttacctccttgcccttgtgtctcaggtgtggcccctgcctgctngatgaagttgctctgttcangcctttggggngatcatgtgtttgggggcttttaggggaccaagctgcactggncactgc

SEQ ID NO: 10250 - DNA, 325 bp, Homo sapiens
  misc_feature 33: n = A,T,C or G
cggaagttaagcttgctttcttaaccgcaaggnttagagcctttattatgctaattggcattatgaattttttagggactccttaacacacagctatcccaaacctgttttttaggacacctaagtgttactaattcagaaatgctgttcagggtctagggatggttgacaaagtatagccatatttttgtgtagcctgagagctaagaatgttctttacattttttaaatggttggaaaagaatcaaaagaattattttgtgacacgtgagaattatgtgaaattcaaatttcagtgtccataaataaaattttattggaacac

SEQ ID NO: 10251 - DNA, 322 bp, Homo sapiens
  misc_feature 142: n = A,T,C or G
ttcggcacgagggttgtgcctggaggtggaggggaagatggtcagtaggacagaaggtaacattgatgactcgctcattggtggaaatgcctccgctgaaggccccgagggcgaaggtaccgaaagcacagtaatcactggngtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttc

SEQ ID NO: 10252 - DNA, 336 bp, Homo sapiens
gaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttgggtgtgctattttttgaagcagatgtggtgatactgagattgtctgttcagtttccccatttgt

SEQ ID NO: 10253 - DNA, 336 bp, Homo sapiens
cagcatctttatcactctttccttggcacctaaaagataattctcctctgacgcaggttggaaatatttttttctatcacagaagtcatttgcaaagaattttgactgctctgcttttaatttaataccagttttcaggaacccctgaagttttaagttcattattctttataacatttgagagaatcagatgtagtgatatgacagggctggggcaagaacaggggcactagctgccttattagctaatttagtgccctccgtgttcagcttagcctttgaccctttccttttgatccacaaaatacattaaaactctgaattcacatacaatgc

SEQ ID NO: 10254 - DNA, 359 bp, Homo sapiens
  misc_feature 132: n = A,T,C or G
ggctttttctttttttaaaaaaagttagctgtggttttatattttaatacagaataagaacatactggagagagaaagtggttactggttgcatgtgcttttttgtttgtttaatccatcgtgacagatggngtggactagtttaatatactgaacagtgtttgtgcttgttagttgcagtttgtgcctccaagtccactttgccctagtctcttacctgtctgcccagggttgcagatctgtatgggccgccaccacaggccccctttccctctggcttctggtagagcccaggcaggaaattacaagaggaggagagtgagggcccagggctgcagcgctctgttggacttgcctca

SEQ ID NO: 10255 - DNA, 203 bp, Homo sapiens
tgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttaccttgatgttgataacatcacaataaattatgggagaaaaatac

SEQ ID NO: 10256 - DNA, 217 bp, Homo sapiens
gcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtg

SEQ ID NO: 10257 - DNA, 338 bp, Homo sapiens
acgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctg

SEQ ID NO: 10258 - DNA, 228 bp, Homo sapiens
ctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaag

SEQ ID NO: 10259 - DNA, 335 bp, Homo sapiens
aggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcac

SEQ ID NO: 10260 - DNA, 275 bp, Homo sapiens
  misc_feature 54: n = A,T,C or G
acaagcgtgaagaaaaggatcttaaagctttgagcacctgccattttgccttgnatccgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaaccttt

SEQ ID NO: 10261 - DNA, 335 bp, Homo sapiens
  misc_feature 307: n = A,T,C or G
gtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcacttttaatcctctatccagaaaacacggngggccaaaggatgaagagaggcatgttg

SEQ ID NO: 10262 - DNA, 329 bp, Homo sapiens
gagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtcttttt

SEQ ID NO: 10263 - DNA, 332 bp, Homo sapiens
gcgtcaggcaggtacccctctgagaccaagctttcataggaaagagcaggtagcaatctttgctgttctgcagcctcctctggtgatacccaggcaaacagggtctggagtggacttccactcaaactccaggagacctgcagaagatgggcctgactgttagaaggaaaacaaacaaacagaaatcaataacatcaacatcaacaaaaaagacagccacagaaaaaccccatccaaaggccataagcatgaaagatcaaaggtagataaatccacaaagatgagggaaaaccagcaggaaaatgctgaaaattccaaaaaccagaacgcct

SEQ ID NO: 10264 - DNA, 334 bp, Homo sapiens
atttgatgcctatgttcctcctgagggtgatgcacgcatatcatctctttcaaaggagatgatagagagaactgatagagagaactgaacgaatgaagaagactatggcatcacaagtgtcattttattggctgggtgcggtggctcacgtctgtaatcccagcactttgggaggctgaggtgggcagatcacctgaggtcaggaatcgaaaaccagcctgaccaacgtggagaaacctcgtctctactaaaaatgcaaagttggccgggcgtggtggcacattgcctgtaatcccagctactcaggaggctgaggcaggagaatcgcttgaac

SEQ ID NO: 10265 - DNA, 321 bp, Homo sapiens
aagctattcagttggatggattaaatgcctcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtagggaatgaccagagaagagttggtt

SEQ ID NO: 10266 - DNA, 331 bp, Homo sapiens
  misc_feature 291, 321: n = A,T,C or G
ccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggnggatttacatattaaattttttctgctggnggataaacat

SEQ ID NO: 10267 - DNA, 338 bp, Homo sapiens
  misc_feature 209, 299, 327: n = A,T,C or G
cggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctgggtcccggcacaggcctgggccttccccttccctcaagccagggctcctcctcctgtcgngggctcattgtgaccactggcctctctacagcacggcctgtggcctgttcaaggcagaaccacgacccttgactcccgggggggggaggnggccaaggatgcttggagcttgaatcanacgctgacagt

SEQ ID NO: 10268 - DNA, 334 bp, Homo sapiens
ggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgag

SEQ ID NO: 10269 - DNA, 338 bp, Homo sapiens
ctcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggcccgagttggaacccacgggggcactctctcttcctatattgtgaagaacattgctttggacaagaccgatgacagtaatcctcgggaagccattttgcgtcatgccaaagcagcagaagacagcccatattggggtttctccagcatattccaagactcagcccaaaaccatgtttgcccaagttgaat

SEQ ID NO: 10270 - DNA, 257 bp, Homo sapiens
acacgagatccacaaatagatgaatcatagtaaaatgctgaaaactaaagacaaggagaaagtcttgaaatcagcaagagaaaaagaacttgtcacttacatgagtttacctgtataacaaacctgtccctgaacctaaaataaaagttaaaaggaaaccaaaactcatcacttacagtgaacctcaataagattaacagctgacttcttagcagaaccaatagagactagtaggcaatggaatgacatacaaattg

SEQ ID NO: 10271 - DNA, 337 bp, Homo sapiens
gagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaag

SEQ ID NO: 10272 - DNA, 216 bp, Homo sapiens
ctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatg

SEQ ID NO: 10273 - DNA, 337 bp, Homo sapiens
  misc_feature 335: n = A,T,C or G
gcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatcttggcggatctcatgctgcggaccggctggcgcacaggcgccatcatccccgagctggagcgggagatccgcatcatcaacacggagcagtacatgcactcgctgacgtggcagcaggcgctcacggggcttgctggagcgcatgcagacctatcaggacgcggagncg

SEQ ID NO: 10274 - DNA, 215 bp, Homo sapiens
  misc_feature 4, 133: n = A,T,C or G
aagnaattcggcacgagcaaagaggaaggctgtttgggcctttggagcctttcccagacatgcatagagtatggagagaagaagtattcttcaagtgtgtttgagttatggacactaagtgtggtcggctatnccctgggaacacaggagtgaacagtgcagacatgacctgtgccctcaggaagctttactttttttttcaagactctgcctca

SEQ ID NO: 10275 - DNA, 400 bp, Homo sapiens
  misc_feature 11, 67: n = A,T,C or G
ctggagctcgngagccccgcaggtcgacactagtggatccttgaattcggcacgagctggaactgangctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataag

SEQ ID NO: 10276 - DNA, 400 bp, Homo sapiens
  misc_feature 2, 391: n = A,T,C or G
gnaggtcgacactagtggatccttgaattcggcacgagaagggttccagagttaaagaaaacatcagctaaaaagaaaggctataatgaaacaaaaataaggatgcccatacattcaaatatgaatatattaattactacaaagcacagtttttggttacaaaatgatacctaaaaacttgtctaagaggaaaatttcatctaacatgatacaagatttttcacataccagctattgagcagccaccgtggcaggagttgtgcagggtatgtggacattcagaaaggggaagagacatgggccttctctcagaacacaccgactggtacacctccattctttgtagtctgtgatgggctcccactgaaaatatcaaatgcaagatcaaagnaggttgtgt

SEQ ID NO: 10277 - DNA, 341 bp, Homo sapiens
  misc_feature 39, 40, 41, 45, 291: n = A,T,C or G
tctggagctcgcgcgcctgcaggtcgacactagtggatnnnaagnaattcggcacgaggatcaggccagtggaaatgtaaagaaggccctgaagctgatggggtcaaatgaaggtgaattcaaggctgaaggaaatagcaaattcacctacacagttctggaggatggttgacgaaacacactggggaatggagcaaaacagtctttgaatatcgaacacgcaaggctgtgagactacctattgtagatattgcaccctatgacattggtggtcctgatcaagaatttggngtggacgttggcccttgtttgctttttataaaccaaactctatctgaaat

SEQ ID NO: 10278 - DNA, 400 bp, Homo sapiens
  misc_feature 94, 102, 182, 365: n = A,T,C or G
aagaattcggcacgaggatgcagacaaaatggctcatgggaagaaggggcctccaattttcctttgccctcccgggctctgtgtctagccatgnaaggaagnggagacagattcctgtctctaatccagacctgagaatgcttgaattctcaaagtcctcctagctgggaccttgggagtgncacctgctgtaagacttgagtggcctgactgggtggttgtgaggatgcaaggagaaaaggtgcaccaaggtgcttcctaagtcggggagaccattcctgggagccacgtgactgacccccaccatggctctttccctccaactcgtgctgatagctggccgctgggaggccgtccccagtganatcctcagaccctgcacaagcccttgagaggcttc

SEQ ID NO: 10279 - DNA, 400 bp, Homo sapiens
  misc_feature 2, 39, 41, 177, 180, 183, 217, 357, 368, 375: n = A,T,C or G
tntggagctcgcgcgcctgcaggtcgacactagtggatntnaagaattcggcacgaggttcatgctaccctgaagtcactcagtagtcagattgaaaccatgcgcagccccgatggctcgaaaaagcacccagcccgcacgtgtgatgacctaaagctttgccattccgcaaagcanagnggngaatacctggattgatcctaaccaaggatctgtngaagatgcaatcaaagtttactgcaacatggaaacaggagaaacatgtatttcagcaaacccatccagtgtaccacgtaaaacctggggggccagtaaatctcctgacaataaacctgtttggtatggccttgatatgancagagggtctnagttcgnttatggagaccaccaatcacctaat

SEQ ID NO: 10280 - DNA, 400 bp, Homo sapiens
  misc_feature 3, 4, 45: n = A,T,C or G
atnnttctggagctcgcgcgcctgcaggtcgacactagtggatcnaaagaattcggcacgagttttcctctcaatattttattaagttgcttttgctttttcattctactcctctcgccttagtaaccctcctgttctccactttcacccttctcattgtaactaatagctagaatttgattcacatctccccacccacatgctgctgacatcataaattatttgaatccaaatggacaatattcattagctgtgcactttactgaaagagccttacacaagagtgctgcactctcccatttttattaaaagttaaaatgtttttgctgtcaggagggttggatgagttagccatgataaaggacagggctcagtgctaatatataaaaataataactat

SEQ ID NO: 10281 - DNA, 399 bp, Homo sapiens
  misc_feature 21, 40, 41, 61, 66, 69, 70, 200, 202, 364, 366, 375: n = A,T,C or G
ctggagctccgcgcgccccgngggtcgacactagtggatnntaagaattcggcacgagcgnggganggnngacacaaattctgtggctacagtagaaatagaaagaactgatgctgagttgttttcggcagatgtaaataactactgctgctgtctagatgctgaagctgaactggagacccttcaggagcctgataagncngtccggaggtcagagtaccatctgtgggagggacagaaagagagcctggtaaaattgccatggcccctgagccacttgagtatgttcatttgccacccccttgtccctccccttgggcaccccttacttttccctgatccttgcaattaaaagggttaatgngnggcaatatnggaagggactccccagggaccctt

SEQ ID NO: 10282 - DNA, 239 bp, Homo sapiens
  misc_feature 15, 40, 60, 64, 91, 201, 203, 215: n = A,T,C or G
gctggagctcgcgcncctgcaggtcgacactagtggattnaagaattcggcacgagggangacnagaccaagctcacgctgcacggcctgnagcagtactacgtcaaactcaaagacagtgagaagaaccgcaagctctttgatctcttggatgtgctggagtttaaccaggtgataatcttcgtcaagtcagtgcagcgntnattggccctggnccagctcctcgtggagcagaactt

SEQ ID NO: 10283 - DNA, 204 bp, Homo sapiens
  misc_feature 16, 41, 65, 198: n = A,T,C or G
gtctggagctcgcgcncctgcaggtcgacactagtggattnaaagaattcggcacgagagctggngggccaggcagagccggagagcgtgctgctggtgcatggcgaggccaagaagatggagttcctgaagcagaagatcgagcaggagctccgggtcaacttgctacatgccggccaaatggggagacggtgacgntgccca

SEQ ID NO: 10284 - DNA, 131 bp, Homo sapiens
  misc_feature 24, 46: n = A,T,C or G
tgcggtgcgacactagtggattcnaagaattcggcacgagaatggntgggaacatatgccaattatggaataggctatgtatttaatattaatctctgccattaggatatctactcactgtataaacctca

SEQ ID NO: 10285 - DNA, 400 bp, Homo sapiens
  misc_feature 3: n = A,T,C or G
acnttttgctggagctcgcgcgcctgcaggtcgacactagtggattcaaagaattcggcacgagctcgtgccgaattcggcacgagcgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaatt

SEQ ID NO: 10286 - DNA, 399 bp, Homo sapiens
  misc_feature 15, 59, 60, 61, 69: n = A,T,C or G
gctggagctcgcgcncctgcaggtcgacactagtggattcaaagaattcggcacgagannnaggaaggntacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagc

SEQ ID NO: 10287 - DNA, 400 bp, Homo sapiens
tgctggagctcgcgcccctgcaggtcgacactagtggtttcaaagaattcggcacgagctcgtgccgaattcggcacgagggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggac

SEQ ID NO: 10288 - DNA, 400 bp, Homo sapiens
  misc_feature 12, 51, 75: n = A,T,C or G
acccaacatttngctggagctcgcgcgcctgcaggtcgacactagtggatncaaagaattcggcacgagcttggnaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactct

SEQ ID NO: 10289 - DNA, 400 bp, Homo sapiens
  misc_feature 21, 23, 48, 305, 307, 327, 342, 381: n = A,T,C or G
ctcgcggtcgacactagtggntncaaagaattcggcacgaggtcatgngtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttcngntaaaaaagccaacattcctntgcttcataggggtnctgcatttgaggggtagggaaatctttgctgttcaccanatgtaatgttttagttcct

SEQ ID NO: 10290 - DNA, 398 bp, Homo sapiens
  misc_feature 5, 22, 42, 66, 70, 73, 313, 368, 377: n = A,T,C or G
ctggnagcttcgagccccctgnaggtcgacactagtggtttnaaagaattcggcacgaggagaggngcgnggntgtctcctctctccgccatggcgtgtgctcgccccactgatatcggtgtactccgaaaagggggagtcatctggcaaaaatgtcactttgcctgctgtattcaaggctcctattcgaccagatattgtgaactttgttcaccccaacttgcgcaaaaacaacagacagccctatgctgtcagtgaattagcaggtcatcagactagtgctgagtcttggggtactggcagagctgtgctncgaattcccagagttcgaggggggggactcaccgctctggcaagggtgcttttgnaacatgggncggggaggccgaatgtttcac

SEQ ID NO: 10291 - DNA, 314 bp, Homo sapiens
gctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacaga

SEQ ID NO: 10292 - DNA, 122 bp, Homo sapiens
  misc_feature 71, 81: n = A,T,C or G
caaaccacctcccttgaataaatttcaactcctgttcccaggatcttgagctttagtgtgctactacctantgtgtcttantcgtgggccacttgtgccaataaacaaaaaacaactgtttg

SEQ ID NO: 10293 - DNA, 303 bp, Homo sapiens
  misc_feature 94, 187, 287: n = A,T,C or G
atattgtaacttactactccggaaaaaaagaaccatttggatacataggtatggtctgagctatgatatcaattggcttcctagggtttatcgngtgagcacaccatatatttacagtaggaatagacgtagacacacgagcatatttcacctccgctaccataatcatcgctatccccaccggcgncaaagtatttagctgactcgccacactccacggaagcaatatgaaatgatctgctgcagtgctctgagccctaggattcatctttcttttcaccgtaggnggcctgactggcattg

SEQ ID NO: 10294 - DNA, 309 bp, Homo sapiens
  misc_feature 17: n = A,T,C or G
ggtcagccaccttctantcttagtcttactctcagtcttgcaagcgtcttgctcttcttgatgttgctgtcttcttctgcatataatgtttgttttgaatagaatattgtgacaggattaaaacctccctctttgaaaaatcaacattttggcagccccttgctgttctgtttctaaaggtgcccacatttgctgtcctcattcatctaaccacaggagatcattatccagtgacagagctctattccactaccattacctcataatgagaatgcctccttcaatgggggatggaagagatgagggttg

SEQ ID NO: 10295 - DNA, 326 bp, Homo sapiens
aagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttt

SEQ ID NO: 10296 - DNA, 224 bp, Homo sapiens
  misc_feature 182: n = A,T,C or G
ccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggngacttcacacgccataatggcactggtggcaagtccatctat

SEQ ID NO: 10297 - DNA, 333 bp, Homo sapiens
gcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctgga

SEQ ID NO: 10298 - DNA, 242 bp, Homo sapiens
ttcggcacgaggagaacagagagaaaaagtgatagtgaatttttagtacctaagtcaccgatcaagaagaatgatatggataataacagccatttgtaatagatattttataattacttataaatattggtttgttttatattccctgacttttgaatttaagccacatgaggcatctggaactgtaaagttttcttattccactctttgactgatttgacattaaaaaaatcttttattct

SEQ ID NO: 10299 - DNA, 333 bp, Homo sapiens
tccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaaatcttactgtgccgagatcgctcacaatgtttcctccaag

SEQ ID NO: 10300 - DNA, 331 bp, Homo sapiens
gtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactgggaagtacatccagatgagcataga

SEQ ID NO: 10301 - DNA, 338 bp, Homo sapiens
gggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagt

SEQ ID NO: 10302 - DNA, 113 bp, Homo sapiens
ttcggcacgagctcagattgtgtagatatgctatttaaataatttatcaggaaatactgcctgtagagttagtatttctatttttatataatgtttgcacactgaattgaaga

SEQ ID NO: 10303 - DNA, 336 bp, Homo sapiens
gtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaata

SEQ ID NO: 10304 - DNA, 109 bp, Homo sapiens
ctcgagttattttttatttgcattgctttgccataagtcttcccttgcttgtatcttccaaagctattttgaaataaacatgaaaatttacagtttgccaaaaatctca

SEQ ID NO: 10305 - DNA, 164 bp, Homo sapiens
  misc_feature 40: n = A,T,C or G
ggacctgcggcctaagaagacacgtgccatgcgccgccgnctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 10306 - DNA, 335 bp, Homo sapiens
catctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgaca

SEQ ID NO: 10307 - DNA, 323 bp, Homo sapiens
ttcggcacgaggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccacttttgaagaacccaatcctctggaatgtggctgatgtggtcatcaagttccctgag

SEQ ID NO: 10308 - DNA, 337 bp, Homo sapiens
gtcaggaaagacaatagagctgtgcagaaactccggcgcgaggtagaaaaggccaaacgggccctgtcttctcagcatcaagcaagaattgaaattgagtccttctatgaagggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaac

SEQ ID NO: 10309 - DNA, 335 bp, Homo sapiens
ggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgagggattatgttcgaaggacttcgggtggtttgacaaggaaggaaatggcaccgtca

SEQ ID NO: 10310 - DNA, 325 bp, Homo sapiens
ctgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttggg

SEQ ID NO: 10311 - DNA, 331 bp, Homo sapiens
  misc_feature 251, 254: n = A,T,C or G
cagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtaanaanagttgttggggaaggagggagctgaggagggggcatctcccaacttctcccttttggaccctgccgaagctccctgc

SEQ ID NO: 10312 - DNA, 400 bp, Homo sapiens
aaagaacaataagctggagctcgcgcgcctgcaggtcgacactagtggatccaaagaattcggcacgagctcgtgccgaattcggcacgagctaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaacctt

SEQ ID NO: 10313 - DNA, 398 bp, Homo sapiens
  misc_feature 398: n = A,T,C or G
acgaaaataagctggagctcgcgcgcctgcaggtcgacactagtggatccaaagaattcggcacgagctcgtgccgctttggctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaaccgttgcttggtgacagcaaaaatgacccaccaatggaagcagctggcttcactgctcaggtgattatcctgaaccatccaggccaaataagcgccggctatgcccctgtattggattgccacacggctcacattgcatgcaaggttttgctgagctgaaggaaaagaattgatcgccgttctggn

SEQ ID NO: 10314 - DNA, 400 bp, Homo sapiens
  misc_feature 29: n = A,T,C or G
gaacaataagctggagctcgcgcgcctgnaggtcgacactagtggatccaaagaattcggcacgagcggcacgagtccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttgggttttgttctatcctacatttgagatttctatttt

SEQ ID NO: 10315 - DNA, 139 bp, Homo sapiens
gacaataagctggagctcgcgcgccctgaggtcgacactagtggatccaaagaattcggcacgagcgggaccaccctcccgggttaggcataggccctcccggatcttccgcggtgcggtaacccagcgtgagcttcgc

SEQ ID NO: 10316 - DNA, 333 bp, Homo sapiens
  misc_feature 298, 320: n = A,T,C or G
gaaaaagctggagctcgcgcgcctgcggtcgacactagtggatccaaagaattcggcacgagcttagctcttcggtggttgtcacacgtccggaggcctagccgtcgcgtacctaggatgccgcgtggaagccgaagccgacctcccgcatggcccctccggccagccgggcccctcagatgagagctgcacccaggccagcaccagtcgctcagccaccagcagcggaccccccatctgcagttggttcttctgctgctgccccccgggaagccaggtctgatggcccaaaatggcnacccactgcagcttggcggggnttgggggcttttg

SEQ ID NO: 10317 - DNA, 396 bp, Homo sapiens
aacaataagctggagctcgcgcgcctgcaggtcgacactagtggatccaaagaattcggcacgagactgcagaaagaacagctttacatttttacggaagcaatgggaaatataccctgtaagccttgaaaaattcccgaagggattcctgttcattcctgtggatcctaatgggccagcatagacctgttagtcaaaagaggatttatctacattgcacactcattcaggcaggcagggaagtcaacgccactttcagatgtttgtagagcatgaactctgtccgttcccacgccctccaaaggctgttacacagggatgcccgcttctggacagaagtgattcatgcaggatgagaaccatgaccacagaagattttgtgcatgtggttatttc

SEQ ID NO: 10318 - DNA, 357 bp, Homo sapiens
  misc_feature 3, 53: n = A,T,C or G
ganaaaagctggagctcgcgcgcctgcaggtcgacactagtggatccaaaganttcggcacgagcatcagtacacagaagagacggatgtgaagacaccaagagagcaacgcttttcctagttggatactatttttttatgaattttttctaatttttgcttcttttgtgatacaaatttgtcctctttttataatagttggtgatttttcactgacatgtgagtaagataaatgtatacagttgtggatttaattgtgaaatgttctttcacttgtaagtttcagtcattttcttttacctcgttgtcagtgtacagaatgctaaaataattaaaaaaagacaaaatataaaaaat

SEQ ID NO: 10319 - DNA, 400 bp, Homo sapiens
  misc_feature 16, 290: n = A,T,C or G
ataagctggagctcgngcgcctgcaggtcgacactagtggatccaaagaattcggcacgaggtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtncttcattgtccgcctggattcccagaagcacatcgacttctctctgcgctctccctacgggggtggccgcccgggccgcgtgaagaggaagaatgccaagaagggccagg

SEQ ID NO: 10320 - DNA, 263 bp, Homo sapiens
gacaaaagctggagctcgcgcgcctgcaggtcgacactagtggatccaaagaattcggcacgagcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatgg

SEQ ID NO: 10321 - DNA, 291 bp, Homo sapiens
gacaataagctggagctcgcgcgcctgcaggtcgacactagtggatccaaagaattcggcacgagatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 10322 - DNA, 191 bp, Homo sapiens
  misc_feature 16, 32, 45, 106, 137, 178: n = A,T,C or G
gggaaaaagctggagntcgtgcgcctggaggncgacactagtggntccaaagaattcggcacgagtaaaagctcaggatttgagaatgaggaccccttcgccaggnaaacatgtatacactcaaaattttgcttgcngtgagccgagatcacaccattgcactccaccttgggcaacnaaagcaaaactct

SEQ ID NO: 10323 - DNA, 324 bp, Homo sapiens
gacaaaagctggagctcgcgcgcctgcaggtcgacactagtggatccaaagaattcggcacgagctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatag

SEQ ID NO: 10324 - DNA, 400 bp, Homo sapiens
gacaaaagctggagctcgcgcgcctgcaggtcgcactagtggatccaaagaattcggcacgagctaccactgtgaatatcacgtagtagattattttgttggatgaatggatgcttgctaaaataactgctgtgtaccgcgtgtgtatatttgtacctgtatacacactgctatggtttgaaggatcatgtctccttcaaaattcatgtcgaaaaataatccctaattaaatagtattaagaggtgtgggttttgggaagtgtaccagagctgctgattgttctagaaccaccccactattccaagtttattaggctcagagccactgagagccttgagttctgggcacttctgtcacccatctccttttgcagcaccagacaaagaattttccttttta

SEQ ID NO: 10325 - DNA, 104 bp, Homo sapiens
  misc_feature 22, 25, 38, 57: n = A,T,C or G
gcgcctgaaggccgacactagnggntcacaaagaattnggcacgaaaggccgcacgngggagacttctccgccgcaaacgccgccgcgatgcgctacgtcccct

SEQ ID NO: 10326 - DNA, 191 bp, Homo sapiens
  misc_feature 14, 44, 45, 68, 124: n = A,T,C or G
ctacgcgcgcctgnaggcccgacactagtggatccaaaaaattnngcacgaggctcattggtggaaangcctccgctgaaggccccgagggcgaaggtaccgaaagcacagtaatcactggtgncgatattgtcatgaaccatcacctgcaggaaacaagtttcacaaaagaagcctacaagaaagtacat

SEQ ID NO: 10327 - DNA, 218 bp, Homo sapiens
  misc_feature 28, 54, 72, 77, 80, 106, 133: n = A,T,C or G
aaaacctggatctcgcgcgcctgcaggnccgacactagtggatccaaagaattnggacgaggtccgtagtgnctcantgnagataatttttagcttagggcctggnggctaggtcggttctctcctttccagncggagacctctgccgcaaacatgctccgccagatcatcggtcaggccaagaagcatccgagcttgatccccctctttgtatttat

SEQ ID NO: 10328 - DNA, 348 bp, Homo sapiens
  misc_feature 2, 127, 214, 219, 274, 287, 328, 336: n = A,T,C or G
tngcgcgccctgcaggcccgacactagtggatccaaagattcggcacgagcggcacgagaataaagctttaggctttacttctgatacttggaaacttctttggaagggcagatgtagagtgaatanaaaaactctaactctcgtgtagctgcaaggaagtttatcctctttctactgtcctactttgttgagggctgactctttcagactgtnggggngatttaaattaatgacaattgtactgatctgctataactccagagtacattttgnttttaactaaaanggatttggttcctatcaatatgtagtatttatatgacaaancgataatnaaggcaaaggga

SEQ ID NO: 10329 - DNA, 185 bp, Homo sapiens
  misc_feature 8, 15, 31, 44, 53, 67, 69, 105, 134, 135, 142, 171: n = A,T,C or G
tcgcgcgncctgacngcccgacactagtggnatccaaatatttnggcacgagntctctcaccagggntnacaaacactctcagtgcaggtcaccacagggcaggngttcggctgatggctgctgggctcagtgnnaggtcanagtccccctgtcctaacaggtggctttgnctttcctccccaga

SEQ ID NO: 10330 - DNA, 400 bp, Homo sapiens
  misc_feature 43, 60, 217, 218, 220, 253: n = A,T,C or G
ctcgcgcgccctgaaggccgacactagtggatccaaataattnggcacgagccgcaaggnacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctnnangcctggcctctctgtccaccttccagcaaatgnggattagcaagcaagagtacgatgaggcaggcccatccattgtccaccgcaaatgcttctaagatgccttctctctccatctaccttccagtcaggatgacggtattatgcttcttggagtcttccaaaccaccttccctcatcttt

SEQ ID NO: 10331 - DNA, 237 bp, Homo sapiens
  misc_feature 2, 29, 32, 39, 42, 73, 77, 104, 180: n = A,T,C or G
gngcgcgacatgacagccccgacactagnggnaccaaantanttttggcacggagcaacagaaaagaagaaanggcntccagcaaagaatgccatcaggctttnggattccgtgccctcccactgccattagtcacttcaaacaatcagctgagaagctgatagaggagaagggagctgnggaagctctggcagcagcactggcccatatttcaggtgccacggggggggggaccag

SEQ ID NO: 10332 - DNA, 218 bp, Homo sapiens
  misc_feature 14, 66, 67, 70, 71, 133: n = A,T,C or G
ctcgcgcgccctgnagccccgacactagtgggatccaaaaaattcggcacgagtattgtcgttgtnngcnngaatgtatttttggaatgttaacctcttttcatacctgcatacttgaacttgtcttttgtgngggggccttaaaattcataataggaagtggaggcagtgaaaggaagtaagaaaaggaaattatgctaaaagatggtttgcaaatt

SEQ ID NO: 10333 - DNA, 207 bp, Homo sapiens
  misc_feature 18, 22, 34, 61, 82: n = A,T,C or G
ggaaaaaaaacctggttntcgngcgcctgcaggnccgacactagtggatccaaagaatttngcacgagatcctgagtgatgngcagctgatcaagactggagacaaagtgggagccagcgaagccacgctgctgaacatgctcaacatctcccccttctcctttgggctggtcatccagcaggtgttcgacaatggcagcatctaca

SEQ ID NO: 10334 - DNA, 132 bp, Homo sapiens
  misc_feature 5, 8, 23, 39, 40, 61, 66, 113: n = A,T,C or G
ccgcntgnaggtccgacactagnggatccaaagaaattnngcacgagggaattttgataangattncaaggaatctgcagattatttggggtagtaaggccaggtttgcaacnttaattcttccaatccatg

SEQ ID NO: 10335 - DNA, 398 bp, Homo sapiens
  misc_feature 221, 355: n = A,T,C or G
tcgcgcgcctgcaggtcgacactagtggatccaaagaattcggcacgagatgcactatagagatctgatgagaaacagttcttaccctaaatattttgttatattgtcgccattatgaatttataaagacaggaaaatatagttgcctatgttttagggaccactattaaagcttataaatatttgtgtattttcatttagaagtaccatctatgagaggngtttatactgcactgtgtacatgaatggctaatgaatctattttccaactttcccgtgttttatagatatttcttttcactttgagtatcctagagatgggaggatgcctaggaagagtttgttgagaagtggnaccatggggtagcatggagagcattggaatgcactaggtttga

SEQ ID NO: 10336 - DNA, 313 bp, Homo sapiens
  misc_feature 19, 45, 218, 219, 223, 305, 312: n = A,T,C or G
cgcgcgccctgcaggtccnacactagtggatccaaaaaattcttncacgagcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgnngagnagggcacaggcatcgcagcacagacagcaggcatagccgcagcgggcgagagctaaacaaaagggcgtgatccacatccganttgtggng

SEQ ID NO: 10337 - DNA, 287 bp, Homo sapiens
  misc_feature 20, 43, 62, 71, 220, 224, 251: n = A,T,C or G
tcgcgcgccctgcaggtccnacactagtggatccaaaaaattntttacgagaaaaaacacanggaaggaanaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagangggngcctgcgtgaaaaggccctgagatcantgaggaaggcccaagtgtccccacagtcttaggggg

SEQ ID NO: 10338 - DNA, 349 bp, Homo sapiens
  misc_feature 16, 60, 81, 234, 239, 329: n = A,T,C or G
aaacaaaaacctgganttcgcgcgccctgcaggtcgacactagtggatccaaagaattcngcacgagtccaaacgactgtntgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacanggggntctgctggacagataatgggccagtgttattgaggtgatcaagatctgttccacagggctaatgccaccatctcccctcaaaattttgtngaggttctaaaaagaaagtg

SEQ ID NO: 10339 - DNA, 196 bp, Homo sapiens
  misc_feature 4, 40, 134: n = A,T,C or G
aaanctggagctcgcgcgcctgcaggccgacactagtggntccaaagaattcggcacgagtcaacaccaccttcttcgaccccgccggaggaggagaccccattctataccaacacctattctgatttttcggncaccctgaagtttatattcttatcctaccaggcttcggaataatctcccatattgtaactta

SEQ ID NO: 10340 - DNA, 146 bp, Homo sapiens
  misc_feature 25, 56, 66, 71, 79, 99: n = A,T,C or G
gcacgaggctcagtatgacgcttcngagctaaaagcttccatgaaggggctggganccgacgaggnctctntcattganatcatctgctccaaaaccanccaggagctgcgggaaattaacagagtctacaaggaaatgtacaaga

SEQ ID NO: 10341 - DNA, 400 bp, Homo sapiens
  misc_feature 11, 229: n = A,T,C or G
aaaacctgganctcgcgcgcctgcaggtcgacactagtggatccaaagaattcggcacgagggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgantgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaag

SEQ ID NO: 10342 - DNA, 405 bp, Homo sapiens
  misc_feature 65, 69, 86, 89, 111, 112, 115, 146, 165, 191, 195, 197, 358,362, 393: n = A,T,C or G
gaaaaagctggagctcgcgcgcctgcaggtcgacactagtggatccaaagaattcggcacgagcncagngacacatgtttaacggncgnggtaccctaaccgtgcaaaggnngcntaatcacttgttccttaaatagggacctgtntgaatggctccacgagggntcagctgtctcttacttttaaccagngaantngacctgcccgtgaagaggcgggcatgacacagcaagacgagaagaccctatggagctttaatttattaatgcaaacagttacctaacaaacccacaggtcctaaactaccaaacctgcattaaaaatttgcggttgggggcgacctcggagcagaacccancctncgagcagtacatgctaagacttcaccagtcnaagcgaactact

SEQ ID NO: 10343 - DNA, 309 bp, Homo sapiens
  misc_feature 259: n = A,T,C or G
aaggaaaaaagctggagctcgcgcgcctgcaggtcgacactagtggatccaaagaattcggcacgagactgaggtgatggtaggatgaggaagaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagngctgtactttatttattgaactttatcattgaaagctgtttggaaaacct

SEQ ID NO: 10344 - DNA, 400 bp, Homo sapiens
  misc_feature 319, 399: n = A,T,C or G
gacaaaagctggagctcgcgcgcctgcaggtcgacactagtggatccaaagaattcggcacgaggacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggngaaattggcttggttcttcatgagcacatttgatatagctctttttctgtttttccttgctcatttcgtttttggggaana

SEQ ID NO: 10345 - DNA, 398 bp, Homo sapiens
aaggaacaaaaagctggagctcgcgcgcctgcaggtcgacactagtggatccaaagaattcggcacgagcggcacgaggacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatg

SEQ ID NO: 10346 - DNA, 231 bp, Homo sapiens
gacaataagctggagctcgcgcgcctgcaggtcgacactagtggatccaagaattcggcacgagcgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagc

SEQ ID NO: 10347 - DNA, 225 bp, Homo sapiens
  misc_feature 3, 10, 97, 169, 198, 209: n = A,T,C or G
aanctggagntcgcgcgcctgcaggtcgacactagtggatccaaagaattcggcacgagtatttcatgaggtaaaaaacattttaatgccgagaaanaaaagggacatgatctcataataaagagaaactctaatagaataaaataaacttatcctataccgcgttgtnctctttcatattttttcctgaggattgtngaaaactttgnctaaaggacatatggg

SEQ ID NO: 10348 - DNA, 400 bp, Homo sapiens
  misc_feature 17, 80, 90, 107, 122, 205, 344, 352: n = A,T,C or G
aataagctggagctcgngcgcctgcaggtcgacactagtggatccaaagaattcggcacgagcagattttgaatctgtgngcatatttgntactttacttttgctgnttatacttgagaccnacttttcaatgtgattcttctaaagcactggtttcaagaatatggaggctggaaggaaataaacattacggtacagacatggngatgtaaaatgagtttgtattattacaaatattgccatctttttctagagttatcttctttattattcctagtctttccagtcaacatcgtggatgtagtgattaaatatatctagaactatcatttttacactattgngaatattnggaattgaacgactgtatattgctaagagggcccaaagaattggaatc

SEQ ID NO: 10349 - DNA, 231 bp, Homo sapiens
aaggaacaataagctggagctcgcgcgcctgcaggtcgacactagtggatccaaagaattcggcacgaggtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtta

SEQ ID NO: 10350 - DNA, 355 bp, Homo sapiens
acgaacaaaagcctggagctcgcgcgcctgcaggtcgacactagtggatccaaagaattcggcacgaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcaccccatccccagtccaggaaaccatctcccccaggaccttctgtctgggactcaggagtcctaaggaaaaggaattctaaaacatgggggaaag

SEQ ID NO: 10351 - DNA, 203 bp, Homo sapiens
  misc_feature 16, 71: n = A,T,C or G
taatctggaagctcgngcgcctgcaggtcgacactagtggatccaaagaattcggcacgaggccaggcggnctccctgcaaaccaagggctgggggcaaaggggcatgatccagggtcccccagggtgggctcagctccagggagaggccacccacgtggcagccccacctcttgagagcccccagtgccggagcagaaagga

SEQ ID NO: 10352 - DNA, 398 bp, Homo sapiens
  misc_feature 11: n = A,T,C or G
gacacataagnctggagctcgcgcgcctgcaggtcgacactagtggatccaaagaattcggcacgagcggcacgagtggaaataggaccacaaggaaggtgctcaataaatgtataactccaggtggaaatacgactggatatttaaaatgtaagtttgactctagtagaaacaataagttttaatatatatttatgacatatatatgtatatgtatacatatatgtatacagagatagcaagagagagacagagtattgctctattgcctaggctggagtgcagtgatgtgatcacagttcactgtaacctcaagcttctgggctcaagtgatcctcctgcctcagcctcccaagtttgtagaaatggggtctcgttatgttgccctggctggtctc

SEQ ID NO: 10353 - DNA, 400 bp, Homo sapiens
  misc_feature 8: n = A,T,C or G
cgaacaanaagctggagctcgcgcgcctgcaggtcgacactagtggatccaaagaattcggcacgagccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccgggggattccaccagaacttcagattgcattcatggcttctctggcaacccacttcagcaatcagaacagtgggaattatcttcagcagtgttgagac

SEQ ID NO: 10354 - DNA, 277 bp, Homo sapiens
  misc_feature 68, 222, 230, 242, 261: n = A,T,C or G
gaaaataagctggagctcgcgcgcctgcaggtcgacactagtggatccaaagaattcggcacgagccntcaggtaagccaagatgggtgcatacaagtacatccaggagctatggagaaagaagcagtctgatgtcatgcgctttcttctgagggtccgctgctggcagtaccggccagctctctgctctcagcagggctccccgccccacccgggcctganaaagcgcnccgactgggccncaaagggccaagcaaaggntacgttatatttaagg

SEQ ID NO: 10355 - DNA, 400 bp, Homo sapiens
  misc_feature 68, 74, 78, 84, 89, 91, 92, 93, 94, 96, 97, 102: n = A,T,C or G
gaacaataagctggagcctcgcgcgcctgcaggtcgacactagtggatccaaagaattcggcacgagntagagncacntagacnaaganannnngnntaaanaagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtatgggaatgtgctttcaattgatggactactctattttttgcaaatttgtaaactttgcttctccaaatacaagtactaggttgtccatttatggtacctatttggtgc

SEQ ID NO: 10356 - DNA, 143 bp, Homo sapiens
  misc_feature 29, 76, 106, 110, 141: n = A,T,C or G
aataagctggagctcgcgcgcctgcaggncgacactagtggatccaaagaattcggcacgagctagactacttctncataatattcatccctgtagcattggtcgntacntgggccatcatagaattctcactgttcaaantg

SEQ ID NO: 10357 - DNA, 391 bp, Homo sapiens
  misc_feature 17, 273, 280, 283, 315, 353: n = A,T,C or G
aataagctggagctcgngcgcctgcaggtcgacactagtggatccaaagaattcggcacgagaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggngaaggcngtngttctggaaaagccactggggacgagacaggngctaaagttgaacgagctgatggatatgaaccaccagnccaagaatctgtttaaagttcagacttcaaatagtggc

SEQ ID NO: 10358 - DNA, 183 bp, Homo sapiens
  misc_feature 171, 182, 183: n = A,T,C or G
gaaaaagctggagctcgcgcgcctgcaggtcgacactagtggatccaaagaattcggcacgagcggcacgagagtacttctagagcggccgcgggcccatcgattttccacccgggtggggtaccaggtaagtgtacccaattcgccctatagtgagtcgtattacaattnctgggccccgnn

SEQ ID NO: 10359 - DNA, 388 bp, Homo sapiens
gacaaaagctggagctcgcgcgcctgcaggtcgacactagtggatccaaagaattcggcacgagtttgagatcaatgtcctttatgatgtgtgatttctcccaaagcaccgttgcttggtcagcaagcgtggggttgaatatatttcccataaagaagagtaccattcaatttgtcagtcaaacagtcaacaaataagcagtcattcatacatttatcttctcattaattcaacaaatgtttcttaagcatttattattttttcagacttcattctaaacactgaatatgcagcgaagaataagacaaagttactgtgcttatggagcctatattgtagtggcaaggagaccaattatcagatagatgaatagaattttaggataaag

SEQ ID NO: 10360 - DNA, 335 bp, Homo sapiens
gacaataagctggagctcgcgcgcctgcaggtcgacactagtggatccaaagaattcggcacgagattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtg

SEQ ID NO: 10361 - DNA, 107 bp, Homo sapiens
  misc_feature 2, 5, 28: n = A,T,C or G
tnggngctaggggatccaataggaattnggcacgagttctcttaggggtctcataggagctgatagaatagtaattatacccatgctttaaatctttttagatattt

SEQ ID NO: 10362 - DNA, 400 bp, Homo sapiens
gacaaaagctggagctcgcgcgcctgcaggtcgacactagtggatccaaagaattcggcacgaggcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgaagttaagaaaaaacaacttctcagatactggaaactttggttttgggatccaggaacacatcg

SEQ ID NO: 10363 - DNA, 297 bp, Homo sapiens
  misc_feature 19, 27, 31, 128, 185, 192, 197, 237, 247, 261: n = A,T,C or G
aaaagcgtggaagctgcgngcgcctgnaggncgacactagtggatccaaagaattcggcacgagcttttcaggacttttcagagaagtcgacgtgtcacacagttttacaactgaaaccttctaaggnaattctctgttataaaggatccagaaaatttcatttaacattaagatgtaaacagtnaacattncattncatctttagtaattaaatatcactctatttgaccttattnagaaagtttnatatgtaaaacatntttaaattatcccttctcagatttttatacgaaaac

SEQ ID NO: 10364 - DNA, 183 bp, Homo sapiens
  misc_feature 2, 17, 34, 63, 87, 98, 103, 113, 122, 144, 168: n = A,T,C or G
gncctggcggcgccganactagtggcaccaaagnaattccggcacgagcgtggcggggggccngtcccgctcctaaggcaggaagangggggccgcgnagaanacgaaaaagncgctggagncgatcaactctaggctccaacncgttatgaaaagtgggaagcacgncctgggggacaagca

SEQ ID NO: 10365 - DNA, 133 bp, Homo sapiens
  misc_feature 2, 3, 91: n = A,T,C or G
anngctggagctcgcgcgcctgcaggtcgacactagtggatcaaagaattcggcacgagcggcacgaggtgggatgaggccgagcaagaangaattggggaggaggtgctcaagatgtccacggaggagatca

SEQ ID NO: 10366 - DNA, 398 bp, Homo sapiens
  misc_feature 5: n = A,T,C or G
acaanaagctggagctcgcgcgcctgaggtcgcactagtggatccaaagaattcggcacgagacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcacttgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcag

SEQ ID NO: 10367 - DNA, 312 bp, Homo sapiens
gaaaaagctggagctcgcgcgcctgaggtcgacactagtggatccaaagaattcggcacgagcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttggggttttgtctttaaccttgtaacgcttgcaatcccaataaagcattaaaagtca

SEQ ID NO: 10368 - DNA, 400 bp, Homo sapiens
  misc_feature 346: n = A,T,C or G
gacaataagctggagctcgcgcgcctgcaggtcgacactagtggatccaaagaattcggcacgagcttttttagacattgataaagtcttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgngagttaccgttactgtatttgtttattggaaaggtggacatttagcgttcagtg

SEQ ID NO: 10369 - DNA, 183 bp, Homo sapiens
  misc_feature 3, 181: n = A,T,C or G
ganaaaagctggagctcgcgcgcctgcaggtcgacactagtggatccaaagaattcggcacgagcggcacgagagtacttctagagcggccgcgggcccatcgattttccacccgggtggggtaccaggtaagtgtacccaattcgccctatagtgagtcgtattacaattactggggccngt

SEQ ID NO: 10370 - DNA, 400 bp, Homo sapiens
  misc_feature 20, 208: n = A,T,C or G
gaacaataacgtctggagcntcgcgcgcctgcaggtcgacactagtggatccaaagaattcggcacgagcgccagaacacaggtgtcgtgaaaactacccctaaaagccaaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacaga

SEQ ID NO: 10371 - DNA, 324 bp, Homo sapiens
  misc_feature 14, 296: n = A,T,C or G
taccaaaggaattnggcgcgagctaatttgaagacttactagaaaacttcaaaatagtataatattgacaaaaaggtacgacaaatagaagagtgggagagaatggcaagcccagaaataaacccagccatagacagactactaattttgagaaaggtacaaagggaacgtaatgcagaaaggacagtctttttaagaaatgctgctggaacaattggataaccatatgcaaaaaagaacttcatacttgatatgatattttaaaaaattaactcaaaaaagaacatagacttgantgtaaaactgaaaatagaaaactcctag

SEQ ID NO: 10372 - DNA, 397 bp, Homo sapiens
  misc_feature 2, 16, 96, 111, 210, 239, 382: n = A,T,C or G
anaagctggagctcgngcgcctgcaggtcgacactagtggatccaaagaattcggcacgagccaagatgacaaagaaaagaaggaacaatggtcgngccaaaaagggccgnggccacgtgcagcctattcgctgcactaactgtgcccgatgcgtgcccaaggacaaggccattaagaaattcgtcattcgaaacatagtggaggccgcngcagtcagggacatttctgaagcgagcgncttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcggggngcttgccccacgtcc

SEQ ID NO: 10373 - DNA, 400 bp, Homo sapiens
gaacaataagctggagctcgcgcgcctgcaggtcgacactagtggatccaaagaattcggcacgagcccaggctgagaaggaacgtttccatcattcacagtgccctccccacagcactacctcaccccgacccccaccctcactcctaccccaccccgcgatcgtcaggggtgccacgggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagc

SEQ ID NO: 10374 - DNA, 302 bp, Homo sapiens
  misc_feature 203, 232, 280, 295: n = A,T,C or G
gaaaaagctggagctcgcgcgcctgcaggtcgacactagtggatccaagaattcggcacgagtaggtcgcggcgacatggccaaacgtaccaagaaagtcgggatcgtcggtaaatacgggacccgctatggggcctccctccggaaaatggtgaagaaaattgaaatcagccagcacgccaagtacactttgctctttctgnggcaaaaccaagatgaagagaccagctgnggggatctgggcactggggttcctggcatgaagacaggggctggcggngccctggacctacanaccactt

SEQ ID NO: 10375 - DNA, 294 bp, Homo sapiens
  misc_feature 66: n = A,T,C or G
gacaaaagctggagctcgcgcgcctgcaggtcgacactagtggatccaaagaattcggcacgaggngggctccaccttgcgaccttatttagctcaaggatgtcaaaaagaccacatttttattattttataggtgaggaagctgttcccttcttctgtgtttccttccttagggtctttgaagtatctttatttgtggtaatcataaattttatatacatttcagagtgtggtacaatcaagggtcagaagatccaggttttatatgctgacctgttaattgagtaaactggt

SEQ ID NO: 10376 - DNA, 400 bp, Homo sapiens
gaacaataagctggagctcgcgcgcctgcaggtcgacactagtggatccaaagaattcggcacgagtgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacaga

SEQ ID NO: 10377 - DNA, 400 bp, Homo sapiens
aaggaacaaaagctggagctcgcgcgcctgcaggtcgacactagtggatccaaagaattcggcacgaggtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatc

SEQ ID NO: 10378 - DNA, 100 bp, Homo sapiens
  misc_feature 67, 97: n = A,T,C or G
gaaaaaagctggagctcgcgcgcctgcaggtcgacactagtggatccaaagaattcggcacgagganagagagagagagagagagagagagagaganaga

SEQ ID NO: 10379 - DNA, 315 bp, Homo sapiens
  misc_feature 16, 32, 75, 121, 284, 291, 292: n = A,T,C or G
ataagctggagctcgngcgcctgcaggtcganactagtggatccaaagaattcggcacgaggcactttgggaggncaaggcaggtgaattacctgagctcaggagtacaagaccagcctgnacaacatgggaaaaccctctctctacaaaagtatatgtatatacgaaagttagccaggtgcagtggcatgccacctgtagtcccagctactcaggaggctcagacaggagaatctcttgagcctgggaggcagaagtgcagtgagccgagatcatgccactgntctgcannctgggcgacagacttagaccctg

SEQ ID NO: 10380 - DNA, 266 bp, Homo sapiens
  misc_feature 86, 235: n = A,T,C or G
aataagctggagctcgcgcgcctgcaggtcgacactagtggatccaaagaattcggcacgagcttccacatatgctggctgctgtntacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttntaatatattaaaattttgcaaagccctttga

SEQ ID NO: 10381 - DNA, 399 bp, Homo sapiens
aaaaagctggagctcgcgcgcctgcaggtcgacactagtggatccaagaattcggcacgagctcgtgccgaattcggcacgagcgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaaggatgttcgtcgtggcaacgttgctggtgacagcaaaaatg

SEQ ID NO: 10382 - DNA, 400 bp, Homo sapiens
gaacaaaagctggagctcgcgcgcctgcaggtcgacactagtggatccaaagaattcggcacgagggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatattaggatttcgtgttcgcccgtggtggccgaaaacgcccagttcctaagggtgcaacttacggcaagcctgtccatcatggtgttaaccagctaaagtttgctcgaagccttcagtccgttgcagaggagcgagctgga

SEQ ID NO: 10383 - DNA, 400 bp, Homo sapiens
gacaaaagctggagctcgcgcgcctgcaggtcgacactagtggatccaaagaattcggcacgagccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatggggtaggcctttgtaaaattgacagagaggggaaaccccgaaagtggtttggttgcagttgtgtagtagttaaagga

SEQ ID NO: 10384 - DNA, 400 bp, Homo sapiens
gaaaaagctggagctcgcgcgcctgcaggtcgacactagtggatccaagaattcggcacgaggcggccagggggtcacgaatgcggccgcacatattcaccctcagcgtgcctttcccgacccccttggaggcggaaatcgcccatgggtccctggcaccagatgccgagccccaccaaagggtggttggggaaggatctcacagtgagtggcaggatccttggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctcctttgtaggcagtgc

SEQ ID NO: 10385 - DNA, 400 bp, Homo sapiens
gacaaaagctggagctcgcgcgcctgcaggtcgacactagtggatccaaagaattcggcacgagatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtctttgttgtcattgctccagataccagccctcgtggctgcaatattaaaggtggaaagatgagagct

SEQ ID NO: 10386 - DNA, 400 bp, Homo sapiens
  misc_feature 2, 16, 63, 83, 144, 182, 399: n = A,T,C or G
anaagctggagctcgngcgcctgcaggtcgacactagtggatccaaagaattcggcacgaggntgattgggtccatcttgtgnaacacgtggctggcagagaagggaagatgaagccaccatcttgaaaatgtctagtccttantttctgctggcattcacccatgcaagctgccagcttgnctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagng

SEQ ID NO: 10387 - DNA, 396 bp, Homo sapiens
  misc_feature 16, 24, 82, 93, 105, 280, 356, 369: n = A,T,C or G
ataagctggagctcgngcgcctgnaggtcgacactagtggatccaaagaattcggcacgagctgaggcttctgggtcctggngacggggctgncatgaccccggnggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttagaggcaccccaaattacctgcccattcgncaggacacccacccacccagtgttatattctgcctcgccggagtggggtgttcccgggggcactttgccgaccagncccttgcgtcccnaggtttgcagctctcccctgggccact

SEQ ID NO: 10388 - DNA, 400 bp, Homo sapiens
gacaaaagctggagctcgcgcgcctgcaggtcgacactagtggatccaaagaattcggcacgaggaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatatttt

SEQ ID NO: 10389 - DNA, 280 bp, Homo sapiens
aggacaaaagctggagctcgcgcgcctgcaggtcgacactagtggatccaaagaattcggcacgaggtaaaactagaaatcaataataagaggaattttggaaactatacaaaaacatggaaattaaacaatatgttcctaaatgaccagtgggtcaatgaagaaattaaacaggaaactgaaaaatttcttcaaacaaatgataatggaaacatgataaaccaaaacctgtgggacacagtgaaagcagtactaggaggggaagtttatagctatacgt

SEQ ID NO: 10390 - DNA, 391 bp, Homo sapiens
gaaaaagctggagctcgcgcgcctgcaggtcgacactagtggatccaaagaattcggcacgagccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtaca

SEQ ID NO: 10391 - DNA, 400 bp, Homo sapiens
gacaaaagctggagctcgcgcgcctgcaggtcgacactagtggatccaaagaattcggcacgagcattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttatttggtgaaaacatgaatcccagatggcattggttgctctattggactaccgtga

SEQ ID NO: 10392 - DNA, 398 bp, Homo sapiens
  misc_feature 11, 17, 33, 151: n = A,T,C or G
tggggggggtnaacccntccgtggggggctagnggatccaaaggaattcggcacgagctcgtgccgaattcggcacgagggtttcttggggaaacgcatggggttttatagatgagaaggaactggtggccccaccctaatcttttattgngaagatgggttctctgtctggccacctccatgttgcctgttcctttaccgtacacgtggttgacaaagaaaagggaaaagggagcctcaatgttgaacatgcctggcccccaggtagccttatcctattggcacagctgccagcattcacccgtgcaagcatccagcttgccttatctacgtctgcagttcgattttacaggctgctctttgttagagaaggaatgatatgggggctgcgtttttgt

SEQ ID NO: 10393 - DNA, 141 bp, Homo sapiens
  misc_feature 3: n = A,T,C or G
ganaataagctggagctcgcgcgcctgcaggtcgacactagtggatccaaagaattcggcacgagaaaaagggaggggacagatggggagcttttcttacctattcaaggaatacgtgcctttttcttaaatgctttcatt

SEQ ID NO: 10394 - DNA, 398 bp, Homo sapiens
  misc_feature 16, 22, 29, 213, 357: n = A,T,C or G
aataagcgtggagctngtgcgnctggggncgacactagtggatccaaagaattcggcacgagcaacgatccctcccttaccatcaaatcattggccaccaatggtactgaacctacgagtacaccgactacggcggactaatcttcaactcctacatacttcccccattattcctagaaccaggcgacctgcgactccttgacgttgacaatngagtagtactcccgattgaagcccccattcgtataataattacatcacaagacgtcttgcactcatgagctgtccccacattaggcttaaaaacagatgcaattcccggacgtctaaaccaaaccactttcaccgctacacgancgggggtatacgtacggtcaatgctctgaaatctgtggagc

SEQ ID NO: 10395 - DNA, 193 bp, Homo sapiens
  misc_feature 3, 17, 83, 121, 167, 172: n = A,T,C or G
canaagctggagctcgngcgcctgcaggtcgacactagtggatccaaagaattcggcacgaggtaaaatccactgtgtgtggnaggcagaagctagcggttgtatcccaagcatcttttgnatttgtctttatactttgctgaattctctgaaatacctattactgnatgtngcttttctaaataaatgtatt

SEQ ID NO: 10396 - DNA, 400 bp, Homo sapiens
gaacaaaagctggagctcgcgcgcctgcaggtcgacactagtggatccaaagaattcggcacgagctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggccta

SEQ ID NO: 10397 - DNA, 398 bp, Homo sapiens
  misc_feature 4, 13: n = A,T,C or G
tggngcttgcgcncctgcaggtcgacactagtggatccaaaggaattcggcacgagttaaatacttacttcatttcttgtttttatggatttgtcttgtcttctgttttcttaaatatattaattactcttatgttaaagtccttgaactttaactccaacatctgaatcatttctacatctattgaatttcctatttctttctcctcttggtttccagttatttgatcatatctcttggtgtgcccagttactttttcctgccattatatatacaaagaaaattatagaggttgtatataatgttattttcctctgatcatatttacatttcttttggcaagcattggaatatgagcagatttccttgagatcaggaattgtcttaaagctgagttt

SEQ ID NO: 10398 - DNA, 168 bp, Homo sapiens
aaagacaaaagctggagctcgcgcgcctgcaggtcgacactagtggatccaaagaattcggcacgaggaagttggtttggggtggcctgtgttgccactctcagcaccccacatttgcatctgctggtggacctgccaccatcacaataaagtccccatctgattttt

SEQ ID NO: 10399 - DNA, 398 bp, Homo sapiens
gacaaaagctggagctcgcgcgcctgcaggtcgacactagtggatccaaagaattcggcacgagaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctatttgcggtcaagtctcattctgcttcaggggagctggt

SEQ ID NO: 10400 - DNA, 400 bp, Homo sapiens
  misc_feature 14, 22, 106, 173, 352: n = A,T,C or G
aagctggagctcgngcgcctgnaggtcgacactagtggatccaaagaattcggcacgaggcccttaatatgttttatccatttgataacttttacagtaagtaggnctcattcattttgacagttatcaaagatgtactttccacagttaaatttacattaatggcaattttngatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagattncttttaagattctgagttagcagagttcaaaactattttgtggaaaca

SEQ ID NO: 10401 - DNA, 400 bp, Homo sapiens
  misc_feature 13, 19, 98, 223, 243, 334: n = A,T,C or G
aggagcctcgtgngcctgnggttcgacactagtggatccaaagaattcggcacgagtcagtctcccaaagtgctgggattacaggcgtgagccaccgngcccggcctctcacttcctttcttagccagcttaaattccatggtcaatcattaagagaactcctttgtacttctccccctcacttcttcatatccacgtggtaaaatcacaactgcattaattncaactctccatttactctgngggcgccctcatacacaatcttgctgtctgggctccttcaactcatgaccacgaatctcaagtaggctctttatgttgcctagcaatattnccactaaacttccctagtccaacccttgcccactcttctaaagaactatctacttcccatcttctc

SEQ ID NO: 10402 - DNA, 399 bp, Homo sapiens
  misc_feature 308: n = A,T,C or G
gacaaaagctggagctcgcgcgcctgcaggtcgacactagtggatccaaagaattcggcacgaggccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgnactggtacacgggcgagggcatggacgagatggagttcaccgaggccgagagcaacatgaatgacctggtgtccgagtaccagcagtacca

SEQ ID NO: 10403 - DNA, 399 bp, Homo sapiens
gacaaaagctggagctcgcgcgcctgcaggtcgacactagtggatccaaagaattcggcacgaggttttttgaaacttttttcctgtatgtgactgtatgttctgagtcacagcataaagtgtaatttttactgtgggcaatacatatcggagaagttttaaaaaggatgctgaacaagatcatttcttcagcctcatgattctcagcatgtattgagtgcttaggggtatggaaaagtggggaaagtggagatgtgggttcaagtgccagctttgccattaacaggcgtaaggaagttgtgctgtctgctggcatctctacttcctcatctatgaaatggggcatgggatacatggttttaggtatggtaaggttccgttagcccttgattccagctt

SEQ ID NO: 10404 - DNA, 116 bp, Homo sapiens
acaaaagctggagctcgcgcgcctgcaggtcgacactagtggatccaaagaattcggcacgagctcttaagtcttttgtaattctgactttctctaataaaaaagccacttagttc

SEQ ID NO: 10405 - DNA, 400 bp, Homo sapiens
gacaaaagctggagctcgcgcgcctgcaggtcgacactagtggatccaaagtttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtg

SEQ ID NO: 10406 - DNA, 392 bp, Homo sapiens
  misc_feature 55, 85: n = A,T,C or G
gaccaaaaagctggagctcgcgcgcctgcaggtcgacactagtggatccaaaganttcggcacgagtaaaatcaacactctaacntcacaattaaagaaccagagaagaggttgggtgtggtggttcaggcctgtaatcccagcactttgggaggccgaggcaggcggatcctgaggtcaggagatcaagaccattctggctaacatggtgaaaccccatgtctactaaaaatacaaaaaaattagctgggcatggtggcatgcacctatagtcccagctccttgagaggctgaggcaggagaattgcttgaacccaggaggcaagaggttgcagtgagcccaggtcgtgccacagcactccagcctgggtgacagggcaagactccatctc

SEQ ID NO: 10407 - DNA, 399 bp, Homo sapiens
gacaaaagctggagctcgcgcgcctgcaggtcgacactagtggatccaaagattcggcacgagtaatttcttgtaaagtcgtagaatggaaagctgtaacacaatactgagaatgatgaaccgatgccgcatgcaaccaggttgaatctcagaagcataattgtaagggcaatgagctggatatagaaggatatatgcattatagttctatttatataaagctccagaaacagtagtgtttgggcatctatatttgagtggtaaagctataaaggaaagtaagaaagcaacagctaaaactgtcatgagagtgttttgttttgttttggagagaggaaagaggttgtgattgggcaaggacttatgggaatttctggagttctgatctgttctgtttct

SEQ ID NO: 10408 - DNA, 221 bp, Homo sapiens
  misc_feature 18, 30, 92, 95, 105: n = A,T,C or G
cagaagctggaagctcgngcgcctgcaggncgacactagtggatccaaagaattcggcacgagaccttcagaaggaaaggagaatgttttgnggnccactttggntttcttttttgcgtgtggcaggttttaagttattagtttttaaaatcagtactttttaatggaaacaacttgaccaaaaatttgtcacagaattttgagacccattaaaaaagtta

SEQ ID NO: 10409 - DNA, 328 bp, Homo sapiens
  misc_feature 22, 27, 53, 95, 158, 160, 199, 292, 300, 317: n = A,T,C or G
accgaagctggagctcgtgcgncctgnggtcgacacctagtggatccaatganttcggcacgagagattgaggatttagtgtcttaggaaatttntttaattttttttttttaaagaagaaaaaaaactacataatttctaccagggccatattagcngngaaacattttaaactgcagaaattggggttttggttcanaaacaagttgtatatttttcacccctgattatgggaaaaaaaatcagttctgtctttgggggttgctctactatggagatcaacagttactgngactgagncggcccattctgtttanaaatatatttt

SEQ ID NO: 10410 - DNA, 399 bp, Homo sapiens
gaacaaaagctggagctcgcgcgcctgcaggtcgacactagtggatccaaagaattcggcacgaggccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgcca

SEQ ID NO: 10411 - DNA, 400 bp, Homo sapiens
  misc_feature 343: n = A,T,C or G
gacaaaagctggagctcgcgcgcctgcaggtcgacactagtggatccaaagaattcggcacgagctcgtgccgaattcggcacgagcttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttgggagaagagagagggagataaaagggggagacaaaagatgtacagaaatgatttcctggctggccaactggtggccagtgggaggtgatggtggacctagactgngcttttctgtcttgttcagccttgacccaccttgagagagagccaccaggaaggcgc

SEQ ID NO: 10412 - DNA, 268 bp, Homo sapiens
gaacaataagctggagctcgcgcgcctgcaggtcgacactagtggatccaaagaattcggcacgagtggagggcaagtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagc

SEQ ID NO: 10413 - DNA, 399 bp, Homo sapiens
  misc_feature 382: n = A,T,C or G
gacaataagctggagctcgcgcgcctgcaggtcgacactagtggatccaaagaattcggcacgaggtactcaaggctgttagtggagggaatccagcaaagtcatgtgacaagagaggccttcaaaggaaacagggtgaccaacgggtttgttcttccactacaagcagaacaagaggaaattatacatccaaataagaaatgagttgcatgaaaattaatttttgatagtgggactgactgctacaaaaagagggatatctcccttagtaagagctctctaaataaactcagaaaataaagtcactattctcatcaacattacctaagggtgtagagtttgagtcacttagattttaatacctttcatttctcagtattgnatcttgttcctctccag

SEQ ID NO: 10414 - DNA, 399 bp, Homo sapiens
gacaataagctggagctcgcgcgcctgcaggtcgacactagtggatccaaagaattcggcacgaggtaagattttatttctctcctgtattcaagaagtccagaggtgatcagcccagggctagtgtggcccgtcacagtgtcagagacagatgccttctcctgtcctctctggcttccctaaccaaagtcactccatggcccaggatggctgttggctttccagtcatctagtcaaatttcaatcagcaggttggagaaagcaacaaagaaggacacatttccagcagaaattgcacacagaacttctgcttacatcccattccataagccagagcttagtcacattgccacacgcaactacaagggaagctggaaagttggccttcttccaggctca

SEQ ID NO: 10415 - DNA, 400 bp, Homo sapiens
  misc_feature 16, 24, 67, 69, 105, 149, 329, 352: n = A,T,C or G
ataagctggagctcgngcgcctgnaggtcgacactagtggatccaaagaattcggcacgagcagcgntnggcttaacagatgatcaggtttcagggccacccagngctcctgcagaagatcgttcaggaacacccgacagcattgcttnctcctcctcagcagctcacccaccaggcgttcagccacagcagccaccatatacaggagctcagactcaagcaggtcagattgaaggtcatgatgtaccaacagtaccagcaacaggccggctatggtgcacagcagccgcaggctccacctcagcagcctcaacagtatggtattcagnattcagcaagctatagtcagcanactggaccccaacaacctcagcagttccagggatatggccagcaacca

SEQ ID NO: 10416 - DNA, 400 bp, Homo sapiens
  misc_feature 17, 20, 44, 329: n = A,T,C or G
ctggaggtcgtgcgccngcnggtcgacactagtggatccaaagnaattcggcacgagctcgtgccgaattcggcacgagtacacaaatgagtaggcacatggctgatagaaatatcagtatacaatagcttatagcttctttcttttttaatacaaaatataaagggcattttcaccatcaaaaatttcctgaattcacctataaccaatttctacaatctcttttgccatttaagccaaagtgaggttttatctttatcattgatagacaacttgattgtgtctatatcaatgataaagatggctgaatttcagctttatactttagngagtgtaatatattgggattttatactacaaaacagactaagatacttgggagcagagaatggaggtggtt

SEQ ID NO: 10417 - DNA, 231 bp, Homo sapiens
gacaaaagctggagctcgcgcgcctgcaggtcgacactagtggatccaaagaattcggcacgaggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagct

SEQ ID NO: 10418 - DNA, 400 bp, Homo sapiens
  misc_feature 362: n = A,T,C or G
gaaaaaagctggagctcgcgcgcctgcaggtcgacactagtggatccaaagaattcggcacgagtctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgngggtggcgcctgcctggaggacgaggccagcgccctgc

SEQ ID NO: 10419 - DNA, 399 bp, Homo sapiens
gacaaaagctggagctcgcgcgcctgcaggtcgacactagtggatccaaagaattcggcacgagctcgtgccgctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacatatgcatctaaactgctgggcaatccagttgacttttaaatgtaagaatggaattccaaacacttaacacattcagctatatgacagaaagtaaatctatggatat

SEQ ID NO: 10420 - DNA, 400 bp, Homo sapiens
gacaaaagctggagctcgcgcgcctgcaggtcgacactagtggatccaaagaattcggcacgaggcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggc

SEQ ID NO: 10421 - DNA, 400 bp, Homo sapiens
  misc_feature 16, 67, 220: n = A,T,C or G
aaaagctggagctcgngcgcctgcaggtcgacactagtggatccaaagaattcggcacgagcgaccntctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgnccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtca

SEQ ID NO: 10422 - DNA, 400 bp, Homo sapiens
  misc_feature 12, 22, 63, 134, 212, 288, 337, 386: n = A,T,C or G
aagctggagctngtgcgcctgnggtcgacactagtggatccaaagaattcggcacgagacatncagaaggtggtgaagcaggcgtcggagggccccctcaagggcatcctgggctacactgagcaccaggtggnctcctctgacttcaacagcgacacccactcctccacctttgacgctggggctggcattgccctcaacgaccactttgncaagctcatttcctggtatgacaacgaatttggctacagcaacagggtgggtggacctcatggcccacatggcctncaaggagtaagacccctggaccaccagccccagcaagagcacaagaggnagagagagaccctcactgctgggggaggccgtgccacactcagtccccnaccacactgaatct

SEQ ID NO: 10423 - DNA, 386 bp, Homo sapiens
  misc_feature 29: n = A,T,C or G
gaacaaaaagctggagctcgcgcgcctgnaggtcgacactagtggatccaaagaattcggcacgagagaaaagctgctggcagcaaatccgttgaaactttcatatgtaacagcgtttctatttctgctcttcacatctttgaaagaaagtgtgttttagaaaagaaaatgttaaaaaacagaagatatgatctttcttaaaaatgtatgtgtagctccactttaatatttctcattgtggagatgcatggggtttcattatgtcctatgcactcttggttcccctacctttcccaatcaattctgtcacattgaccaacctaaggatcagatgcattgagagtaagtgtaataggagaagaaatgaaattcacctgcatagagcc

SEQ ID NO: 10424 - DNA, 194 bp, Homo sapiens
  misc_feature 3: n = A,T,C or G
ganaaaagctggagctcgcgcgcctgcaggtcgacactagtggatccaagaattcggcacgagggctcgtgcgtcgatgaagaacgcagctagctgcgagaattaatgtgaattgcaggacacattgatcatcgacacttcgaacgcacttgcggccccgggttcctcccggggctacgcctgtctgagcgtcg

SEQ ID NO: 10425 - DNA, 360 bp, Homo sapiens
aataagctggagctcgctgcgcctgcaggtcgacactagtggatccaaagaattcggcacgagcggcacgaggtgttttctacctcactggtacaggaagaaattagagaaaactggagcaagttcaacaaactatttccagggttgggattaactttagcatcaagttagaggggaaaagtaaggctgtctgtagtcccagaaggggagataaatggttttgaaatcccagtaatggttaagagaatgcagacttttgctgccaaggttggaatcccagatcagcattatataatcctcggcacaactactttctctataaaatatacctactttatatggctcttgtgagaattaaga

SEQ ID NO: 10426 - DNA, 194 bp, Homo sapiens
  misc_feature 2: n = A,T,C or G
gnaaaagctggagctcgcgcgcctgcaggtcgacactagtggatccaaagaattcggcacgagaaaacattctcctccgcataagcctgcgtcagattaaaacactgaactgacaattaacagcccaatatctacaatcaaccaacaagtcattattaccctcactgtcaacccaacacaggcatgctcataag

SEQ ID NO: 10427 - DNA, 365 bp, Homo sapiens
  misc_feature 17, 20, 28, 33, 134, 135, 153, 172, 185, 276, 278, 306: n = A,T,C or G
aataagcgtggaagctncgngcgcctgnaggcncgacactagtggatccaaagaattcggcacgagcctctctccccaagtagaaaatattctcttgccattcctgaaattccacattcatataatggctgtgnngtacatgcttctcaatangaaaattaactgcatgttnactgtgtgctgancacatcggatttttatgtttaaaaaaatctcattatggattgagtccagcccagctctaagagaaaaagaaggcccatatgggagacttcngnctcattattattgcctttatccagcagngcttatgaagccccctaccctgtcccattccagaaaccataagactcaggcagttcttg

SEQ ID NO: 10428 - DNA, 400 bp, Homo sapiens
  misc_feature 45, 88, 96, 108, 116, 150, 199, 329, 377, 399: n = A,T,C or G
aataagctggagctcgcgcgcctgcaggtcgacactagtggatcnaaagaattcggcacgagagaagaaccaactccacattcaaccnggttgtgntgaagaggttgnttatgagncgcaccaaccggccgcctctgtccctttcccggntgatccggaagatgaagcttcctggccgggaaaacaagacggccgtggntgtggggaccataactgatgatgtgcgggttcaggaggtacccaaactgaaggtatgtgcactgcgcgtgaccagccgggcccgcagccgcatcctcagggcagggggcaagatcctcactttcgaccanctggccctggactcccctaagggctgtggcactgtcctgctctccggncctcgcaagggccgagaggtgna

SEQ ID NO: 10429 - DNA, 271 bp, Homo sapiens
  misc_feature 67: n = A,T,C or G
gacaataagctggagctcgcgcgcctgcaggtcgacactagtggatccaaagaattcggcacgaggngtttgataaatgttgtccaggttctattgccaagaatgtgttgtccaaaatgcctgtttagtttttaaagatggaactccaccctttgcttggttttaagtatgtatggaatgttatgataggacatagtagtagccggtggtcagacatggaaatggtggggagacaaaaatatacatgtgaaataaaactcagtattttaat

SEQ ID NO: 10430 - DNA, 231 bp, Homo sapiens
gacaaaaagctggagctcgcgcgcctgcaggtcgacactagtggatccaaagaattcggcacgagaacaaaccatggatttctcttccccgaggaaagggtatccgcctcaccattgctgaagagagagacaaaagactggcggccaaacagagcagtgggtgaaatgggtccctgggtgacatgtcacgatctttgtacgtaattaaaaatattgtggcaggattaatag

SEQ ID NO: 10431 - DNA, 400 bp, Homo sapiens
gaacaataagctggagctcgcgcgcctgcaggtcgacactagtggatccaaagaattcggcacgagcaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgct

SEQ ID NO: 10432 - DNA, 400 bp, Homo sapiens
  misc_feature 222, 363: n = A,T,C or G
aataagctggagctcgtgcgcctgcaggtcgacactagtggatccaaagaattcggcacgagctcgtgccgctttggagtcagattttagttaacaataatgagcctgggagcagtagtactaaggcgtcttttgtaggcttaagaatttatcctaatggcctttataggaccaatgctgattttttttaaaggcagttcctattatgtggagaaattttgnaaataaatgattatacaaaacagtcaccacctagaactgggtattctttgtacattgtcagatatctttcaaagtataaattaggaataaaaatgttccacatgatatgtgtacaaattctttttaagattgtcatcttgnacagcaaaatattatgttggtatattacttccttatt

SEQ ID NO: 10433 - DNA, 257 bp, Homo sapiens
  misc_feature 15, 20, 57, 71, 85, 97, 113, 137, 140: n = A,T,C or G
aataagctggagctngcgcncctgcaggtcgacactagtggatccaaagaattcggnacgagctgaggccnacctggaatttggntcttatcccttnctttataagcccttgnagacagggctctttgggggatggnggnttaattgaatggcagtcttttaagcctgggacatggaacaaaatagggcttaatagatgaatgttaagataagtcagcttcccttatgtaactgctagccctatttcttgtgatatt

SEQ ID NO: 10434 - DNA, 249 bp, Homo sapiens
  misc_feature 2: n = A,T,C or G
anaaaagctggagctcgcgcgcctgcaggtcgacactagtggatccaagaattcggcacgagcaccactgtggcctctccaagcgtcctgcacatgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgcgtgcatgtgtgtgtgtgtgtgt

SEQ ID NO: 10435 - DNA, 149 bp, Homo sapiens
  misc_feature 3, 105: n = A,T,C or G
ganaaaagctggagctcgcgcgcctgcgggtcgacactagtggatccaaagaattcggcacgaggttcatgttagttttgctccttctgtgtttttttctgaacnatatccatgttgctgacttttccaaataaaggttttcactcctc

SEQ ID NO: 10436 - DNA, 142 bp, Homo sapiens
  misc_feature 3: n = A,T,C or G
ganaataagctggagctcgcgcgcctgcaggtcgacactagtggatccaaagaattcggcacgagcttgagctttagtgtgctatacctatgtgtcttatcgtgggccactgtgccaataaacaaaaacaactgtttggttt

SEQ ID NO: 10437 - DNA, 400 bp, Homo sapiens
  misc_feature 5, 17, 30, 37, 148, 171, 210, 225, 341: n = A,T,C or G
tgggnaaaaagctgganttcgtgcgcctgnaggtcgncactagtggatccaaagaattcggcacgagcttggctgcctgtgggcttccccaggtggcctggaggtgggcaaagggaagtaacagacacacgatgttgtcaaggatggntttgggactagaggctcagtggngggagagatccctgcagaacccaccaaccagaacgtggnttgcctgaggctgtnactgagagaaagattctggggctgtgttatgaaaatatagacattctcacataagcccagttcatcaccatttcctcctttacctttcagtgcagtttcttttcacattaggctgntggttcaaacttttgggagcacggactgtcagttctctgggaagtggtcagcgcatcct

SEQ ID NO: 10438 - DNA, 397 bp, Homo sapiens
  misc_feature 13, 14, 145, 282, 341: n = A,T,C or G
acattaatctggnnctccgcgcgccttgaggtcgacactagtggatccaaataattcggcacgagcttctcagacagactctactcagaagatgagctgccggcagagttcaaactgtatctcccagttcagaacaaggcaaagnaataactggaattgtgactcgagggatagacccctggatgtgactcttctttttaaaaggaaactatgtggaggacgatgcaaaaacatatttatcttagtttgctctgctgtagttctgttatttatacttggggntgcttgtcatggacaccggtgaacatgccgtaactctgtgactgcattgtaagtgcagngggggtaagcagtcctgtgagtggcgcatgaacgctggagcttattccgccgcctg

SEQ ID NO: 10439 - DNA, 339 bp, Homo sapiens
  misc_feature 107, 129, 160, 180, 208, 261, 264, 291, 305, 315: n = A,T,C or G
gacaataagctggagctcgcgcgcctgcggtcgcactagtggatccaaagaattcggcacgagctcgtgccgaattcggcacgagcttaatcaatggggttttattnaatggtttgttctttgaatggntgcaaaaactgtagataatcttactgagggnctgtacaaacatgaaggggnggtatcaaacttcaggttgaaactgttngaagcattataaacattcatttcacaactagattgtataaggatattagctgngangagactcactgcattattttttttagngaattttatgaaanccccgttccnttcaacaggcacatgtttaaaaga

SEQ ID NO: 10440 - DNA, 393 bp, Homo sapiens
  misc_feature 2, 363, 393: n = A,T,C or G
gnaaaagctggagctcgcgcgcctgaggtcgacactagtggatccaaagaattcggcacgaggctctgcctgctgaggatctcctgctctacctgaagaggctggaacacagcgggactgatggccgaggggataatgtccccagaaggaacacagactcccgcttgggtgagatcccccggaaagagattccctccccaggctgtccctcgccgccttgctacagccccccaaagactgaaaaacctcccgaacgggaagaaaaagtgggccacccctgccccgagtagcatgagggagcccggggggggagtctggagatgagccccccctaccctctctcctttttgttctctcattggnggtatttttaataaatgctcattagtctgn

SEQ ID NO: 10441 - DNA, 400 bp, Homo sapiens
  misc_feature 363: n = A,T,C or G
gacaaaaagctggagcctcgcgcgcctgcaggtccgacactagtggatccaaagaattcggcacgagcagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactggnaggtttttcttcaacatcaatgttcattgtaatgtta

SEQ ID NO: 10442 - DNA, 400 bp, Homo sapiens
  misc_feature 17, 46, 71, 74, 296, 299, 363, 393: n = A,T,C or G
aataagctggagctcgngccgcctgcaggtcgacactagtggatcnaaagaattcggcacgagctcgtgcnganttcggcacgagaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggnagnaacaacacttctggatcttaaggcttcataaataatgcctatgatcaccttgcatggacagcantcctgtaaacatcacagagtggcatcattngtataat

SEQ ID NO: 10443 - DNA, 400 bp, Homo sapiens
  misc_feature 2, 12, 62, 109, 212, 217, 278, 382: n = A,T,C or G
tngtgcgcctgnggtccgacactagtggatccaaagaattcggcacgagcttcttactaccntagctttggtgagtccagagataaggcaaatttcagtgggctctgcnttgatgttgctgtagcatgaaggactagtctggcaaatgttatgttaatatgtttatcacgctatggagataatgagaccaaggttgcattttgatgccaggnaaggntattctgtttagtcacatactcctgaccctagccagctgactgcttgaaaagatatactgnagttgctttagtataagcaattactaaaaaattaattgatataatttaaaaattttaggcaacctttaaagcccacaaatagtaatcatacatgaaaatgttgncttgactatattttttgg

SEQ ID NO: 10444 - DNA, 359 bp, Homo sapiens
  misc_feature 323, 326, 337: n = A,T,C or G
gaaataagctggagctcgcgcgcctgcaggtcgacactagtggatccaagaattcggcacgagcccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctnttnatcagctcagnacatgctttaagaaagcaaaac

SEQ ID NO: 10445 - DNA, 400 bp, Homo sapiens
gacaaaagctggagctcgcgcgcctgcaggtcgacactagtggatccaaagaattcggcacgagcatttagaaagatccatggacctgtagctagcacttcttccatcaattacttcttaaaatgaattcacaatatttttggcttttgacattctacaataaggcccctaatataaatcgatacaacagaaatttgacaatgacagtattaagataattggcctggaagagaaaatatgtaaaaatggctttgaaaagattaaagtattgtgcaaataagagatatttctttcttaatatttttattcaaagaatcttatgaatgttttcattttataacagaaaatggaagattgcattgtagactcctgcaaatttgggacgtcagtttcaaacatc

SEQ ID NO: 10446 - DNA, 221 bp, Homo sapiens
gacaaaagctggagctcgcgcgcctgcaggtcgacactagtggatccaaagaattcggcacgagctcgtgccgctagaaattgccctccttttacccctaccatgagccctacaaacaactaacctgccactaatagttatgtcatccctcttattaatcatcatcctagccctaagtctggcctatgagtgactacaaaaaggattagactgaaccgaat

SEQ ID NO: 10447 - DNA, 153 bp, Homo sapiens
gaaaaagctggagctcgcgcgcctgcaggtcgacactagtggatccaaagaattcggcacgaggaatggcgtgaacccgggaggtggagcttgcagtgagccgagattgcgccactgcactccagcctgggcaacagagtaagactctgtctc

SEQ ID NO: 10448 - DNA, 129 bp, Homo sapiens
gacaaaagctggagctcgcgcgcctgcaggtcgacactagtggatccaaagaattcggcacgagattttctattttctttaaaaactgattgttaaaatttgtatttagtaccatgatcacgaataatt

SEQ ID NO: 10449 - DNA, 396 bp, Homo sapiens
  misc_feature 395: n = A,T,C or G
gacaaaagctggagctcgcgcgcctgcaggtcgacactagtggatcaaagaattcggcacgagccgaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggcttgtgccccccgagctgcccccaccccctcacagggtccctcagattataggtgcccaggctgaggng

SEQ ID NO: 10450 - DNA, 252 bp, Homo sapiens
gaaaaagctggagctcgcgcgcctgcaggtcgacactagtggatccaaagaattcggcacgagccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatc

SEQ ID NO: 10451 - DNA, 233 bp, Homo sapiens
  misc_feature 183: n = A,T,C or G
gaaaaaagctggagctcgcgcgcctgcaggtcgacactagtggatccaaagaattcggcacgagtggctccggggagacgttcagctaccctgactttctcaggatgatgctgggcaagagatctgccatcctaaaaatgatcctgatgtatgaggaaaaagcgagagaaaaggaaaagccancaggccccccagccaagaaagctatctctgagttgccctgatttgaaggg

SEQ ID NO: 10452 - DNA, 400 bp, Homo sapiens
gaacaaaagctggagctcgcgcgcctgcaggtcgacactagtggatccaaagaattcggcacgagaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggatttcgtgttcgccgtggtggccgaaaacgcccagttcctaagggtgcaacttacggcaagcctgtccatcatggtgttaaccagctaaagtttgctcgaagccttcagtccgttgcagaggagcgagctggac

SEQ ID NO: 10453 - DNA, 376 bp, Homo sapiens
  misc_feature 16, 28, 72, 102, 150, 207, 210, 302: n = A,T,C or G
aaaagctggagctcgngcgcctgcaggncgacactagtggatccaaagaattcggcacgagctcgtgccganttcggcacgaggaaaagaatggatcttaantacctcagaaacaattttatctagattaaaacttccccgttgtggccnctgcgacttcaaattatttcttgtaggcacacccatttttctagaatggcacaagtntgnggtctataatttctaaataaaaaatttgctggtgttccccaactcatgaattacttcttactcaaataaactctaaaattttgctgagcttnagattttctttaagtttggtgtcagaagtgggattcaaaggagacccccccccactacgccccaaatccttggg

SEQ ID NO: 10454 - DNA, 173 bp, Homo sapiens
aaaaagctggagctcgcgcgcctgcaggtcgacactagtggatccaaagaattcggcacgagtgttgatggccgccatcctcatgacatcatcgatgacatcaacagtggtgctgtggaatgcccagccagttaagcacaaaggaaaacatttcaataaaggatcatttgaca

SEQ ID NO: 10455 - DNA, 400 bp, Homo sapiens
gaacaaaagctggagctcgcgcgccctgcaggtcgacactagtggatccaaagaattcggcacgagcggcacgagctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaaca

SEQ ID NO: 10456 - DNA, 400 bp, Homo sapiens
gacaaaagctggagctcgcgcgcctgcaggtcgacactagtggatccaaagaattcggcacgagccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggaagtaagaatcctaccaaagggaaaatagaacagacacaagcaagtgaaaagaagttttacttcggtggctcaccaatcagtgctcagtatgctaatttcactggctgcataagtaatgcct

SEQ ID NO: 10457 - DNA, 111 bp, Homo sapiens
  misc_feature 95, 104, 107: n = A,T,C or G
acaaaagctggagctcgcgcgcctgcaggtcgacactagtggatccaaagaattcggcacgaggagttttttttttatgattcatttgccaggtnttaaaatgnttncaca

SEQ ID NO: 10458 - DNA, 397 bp, Homo sapiens
  misc_feature 16, 44, 80, 100, 113, 123, 177, 273: n = A,T,C or G
aaaagctggagctcgngcgcctgcaggtcgacactagtggatcnaaagaattcggcacgaggccctccagactgaggaanacccggaaacttaggggccncgtgagccacggncacggccgcntaggcaagcaccggaagcaccccggcggccgcggtaatgctggtggtctgcatnaccaccggatcaacttcgacaaataccacccaggctactttgggaaagttggtatgaagcattaccacttaaagaggaaccagagcttctgcccanctgtcaaccttgacaaattgtggactttggtcagtgaacagacacgggtgaatgctgctaaaaacaagactggggctgctcccatcattgatgtggtgcgatcgggctactacaaagttctggg

SEQ ID NO: 10459 - DNA, 398 bp, Homo sapiens
gaaaaagctggagctcgcgcgcctgcaggtcgacactagtggatccaaagaattcggcacgagccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattacccacttaaagaggaaccagagcttctgcccaactgtcaaccttgacaaattgtggactttggtcagtgaacagacacgggtgaatgctgctaaaaacaagactggggctgctcccatcattgatgtgggggcgatcggggctactac

SEQ ID NO: 10460 - DNA, 400 bp, Homo sapiens
gacaaaagctggagctcgcgcgcctgcggtcgacactagtggatccaaagaattcggcacgagcggcacgagacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgcctgatgggcaagaacaccatgatgcgcaaggccatccgagggcacctgggaaaacaacccagctctggagaaactgctgcctcatatccgggggaaatgtgggcttttgggttcaccaagga

SEQ ID NO: 10461 - DNA, 400 bp, Homo sapiens
  misc_feature 294, 308, 341, 387, 389: n = A,T,C or G
gaaaaagctggagctcgcgcgcctgcaggtcgacactagtggatccaaagaattcggcacgagccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggncaatccagcagggngttcgacaatggcagcatctacaaccctgaagngcttgatatcacagaggaaactctgcattctcgcttcctggggggngnccgcaatgttg

SEQ ID NO: 10462 - DNA, 398 bp, Homo sapiens
  misc_feature 74: n = A,T,C or G
gacaaaagctggagctcgcgcgcctgcaggtcgacactagtggatccaagaattcggcacgagattcgggaccngcctggccagcgtggtgaaaccccatctctgctgaaaacacaaagggtagccgggtgtggtggtgagcacctgtaatcccagctacttgggaggctgaggcaggagaattgcttgaacccacaggaggcggagcttgcagtgagcagagatcgcaccacggcactccagcctgggcaagagagcgagactcaatctcaataaataaataaataaataaataaaaatctttacaagtagagattttactgtaggcaaaatagttggcccaaccctgctaggtgtggtaagtatgatgaggaaacctgaagaaaagtgcctgtgtt

SEQ ID NO: 10463 - DNA, 400 bp, Homo sapiens
  misc_feature 2: n = A,T,C or G
gnaaaagctggagctcgcgcgcctgcaggtcgacactagtggatccaaagaattcggcacgagcggcacgagcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgc

SEQ ID NO: 10464 - DNA, 183 bp, Homo sapiens
  misc_feature 12, 20, 29, 45: n = A,T,C or G
ataagctggagntcgtgcgncctggaggncgacactagtggatcnaaagaattcggacgagcggcacgagagtacttctagagcggccggggcgccatcgattttccacccgggtggggtaccatggtaagtgtacccaattcgccctatagtgagtcgtattacaattcactgggccggaat

SEQ ID NO: 10465 - DNA, 397 bp, Homo sapiens
  misc_feature 19, 23, 27, 139, 153, 226, 234, 262: n = A,T,C or G
aagctggaagctcgtgcgnctgnaggncgacactagtggatccaaagaattcggcacgaggaaagttcagtaaagacctaaaaggaaaagcatcctaccacaccacactcatgttgtatgtgcaagctattatagtggnttagagacactagntcgtgttcttcgtttctatattagtaaagatgttagaggaaattaatctgtttgttgcatcaggggttaatgngaccatgntgtataactattctgaaaggtaagaagnttttcactggagtacaggcactggctgagaacatttaagttttcttttgaagcatacacagttaacaactattgcaggaagaactctgaattaaatttcaggcccagagttttgatttaaactccaaacccttgg

SEQ ID NO: 10466 - DNA, 400 bp, Homo sapiens
  misc_feature 19: n = A,T,C or G
gacaaaagctggagctcgngcgcctgcggtcgcactagtggatccaaagattcggcacgagcttagttgttgatataactaggagttaatgtatcaattaagccaaggaaaaggcagcttgagctgaactgggaacaattaatgaaaatagtttacctttctgatattctatctagtccctgtcattaaaatgtatcaaacatttctggacttttaacaggatacaagaataaaagtgaaaataacctatacaaacacctatagaaaattaaagttattttcaagtataggaagaaaatatatttttagcaagacatccaacatcatctacttatctttctatggaagctatgcaaggatttaatttctttttacaaaatgttttcatagataactttga

SEQ ID NO: 10467 - DNA, 400 bp, Homo sapiens; identical to SEQ ID NO: 9311

SEQ ID NO: 10468 - DNA, 158 bp, Homo sapiens
  misc_feature 2, 4: n = A,T,C or G
anantctggggctcgcgcgcctgcaggtcgacactagtggatccaaagaattcggcacgaggcagcgccaggtgacaagatgttgtgaggggttttgagtcatccagtcctgggcactgaggtctgttagatgaaaggatatgagaaaggtaatattg

SEQ ID NO: 10469 - DNA, 400 bp, Homo sapiens
  misc_feature 17, 29, 73, 108, 142, 162, 263, 278, 297, 308, 340: n = A,T,C or G
aataagctggagctcgngcgcctgcaggncgacactagtggatccaaagaattcggcacgagcttcgcctggngtgagggccagcggcttggaggttaaagcagcagngccaataatgagacccagctgggaaggactcggngatacccactgggatctttnatcctttgttgcaaaagtgtggacacttttgacagcttggcagattttaactccagaagcactttatgaaatggtacactgactaatccagaagacatttncaacagtttgccagnggttcctcactacactggnactgaaagtgnaatttcttagagccaaaaaactggagaaacanatatcctgccacctctaacaagtacatgagtacttgatttttatggtataaaggcaggag

SEQ ID NO: 10470 - DNA, 400 bp, Homo sapiens
  misc_feature 15, 25, 29, 45, 73, 74, 89, 115, 154, 176, 199, 218, 226,265, 284, 316, 354, 388: n = A,T,C or G
aataagctggagctngtgcgcctgnaggncgacactagtggatcnaaagaattcggcacgagctgcggcgganntaggccggccgcagngggaaaaccctgggcgccctctgggnctcagcgtcccattaggacggttccgcgctgggtgccgnacgccgcacagtgggcaacagntttcacaggggtctttgcatttnacccgcacacagcagcttnctggaggnaggccaaggaaaacactttaacccattttgcagacaganaactaaggctcaaagtggngaggagacttgcccaggtacacccagcgaggnttggggccttgggactcggttcctacttcccccacatncagcgccctttgccaccagaccactctgcctcanctggcaaaggat

SEQ ID NO: 10471 - DNA, 359 bp, Homo sapiens
  misc_feature 133: n = A,T,C or G
gaaaaagctggagctcgcgcgcctgcggtcgacactagtggatccaaagaattcggcacgaggcaaaatgatcattaatgaggagctgatggcctccctggaccagccaacacagacagtggtgatgcaccgnactgagcccactgcccagcagaacctggctctgcagctggccgagaagctgggcagcctggtggagaacaacgaacgggtgtttgaccacaagcagggcacctacgggggctactttccgagaccagaaggacggctaccgcaaaaacgagggctacatgcgccggggtggctaccgccagcagcagtctcagacggcctactgagctctccactctgtttccccg

SEQ ID NO: 10472 - DNA, 274 bp, Homo sapiens
gaaaaagctggagctcgcgcgcctgcaggtcgacactagtggatccaagaattcggcacgagcctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 10473 - DNA, 400 bp, Homo sapiens
gacaaaagctggagctcgcgcgcctgcaggtcgacactagtggatccaaagaattcggcacgaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagagg

SEQ ID NO: 10474 - DNA, 385 bp, Homo sapiens
  misc_feature 24: n = A,T,C or G
gacaaaagctggagctcgcgcgcntgcggtcgcactagtggatccaaagaattcggcacgaggcattcttataagttctaaattttatgtttattataattcatttcttgtggaatcttagtgttttaacatttgaaatccacttaaattgcaaattgttctttatatttgattgtgttttctggattttctaaataaaaatattgaatgctttttaacaaaacagaatatttcaaagaaattagcaagcttcattaaagaacatgttttaataaaaatgtgttatagtaaaaattattttcatttttctggcataaatatattcaaatatgtttactcctaccttcattttccttttcttccagaaaacataaaaaagttttta

SEQ ID NO: 10475 - DNA, 400 bp, Homo sapiens
  misc_feature 18, 22, 29, 31, 122, 130, 344, 383: n = A,T,C or G
accatatagtgagtctgngtgngcctgcngngcgacgactagtggatccaaagaattcggcacgagggcaaactgacatgcctgatcactccacccaaagtatgttcatagaaagctcttgnaactctgncccaaagaacatttaaaatctactttggatgtctttcagcagttgatattctccagcaacttcagcagcagcctctcctacaaaatgagggttttattttcctttgagaaccaaagaagcaggttccttccacctgtccagagttgtttgagtatctcctcttcagcccagtccaggtcccagcactgagccattggcccctagatagagcagncatattaacggagttcagtgagtccgttcagtttgcagnttgggtctatagtccca

SEQ ID NO: 10476 - DNA, 126 bp, Homo sapiens
  misc_feature 13, 28, 65, 66, 67, 78, 80: n = A,T,C or G
aataagctggagntggtgcgcctggggncgacactagtggatccaaagaattcggacgagctcgnnnagattgcggcncnagctcagtccatcctgaacccctggaaaacccataaaggccgttct

SEQ ID NO: 10477 - DNA, 399 bp, Homo sapiens
  misc_feature 2: n = A,T,C or G
anaagctggagctcgcgcgcctgcaggtcgacactagtggatccaaagaattcggcacgagcaaacttttatgctctgcttcctcttcaaatatgggttttcactttaagtcttttcttcactcctacatctgaatataggttgttagaagcagccaggtcacttcttgaatgttttgctgcttagaaatttctatttcaccagataccctaaatactctcaaattcaaacttccacagatcttgcgggcatgaatagaattcagccaagctctttgctaagacataacacttgtgacctttgctccatgatatggtttggctgtgtccccacccaaatctcatcttgaattgtgatcccaataatccccaagtgtccagggagacctggtggcaggtt

SEQ ID NO: 10478 - DNA, 140 bp, Homo sapiens
  misc_feature 4, 36, 47, 84, 90, 91, 99, 107, 133: n = A,T,C or G
gccnattggggcgtcaaaagaattcggcacgagagnaacacccaggnaaaggtgtgagctgaaagcactgaacctacctcatcntcctgnngggtgtgnctaccctngccaccccaaattccatgtcaataanagaacag

SEQ ID NO: 10479 - DNA, 100 bp, Homo sapiens
  misc_feature 8, 18, 57, 91: n = A,T,C or G
tgtgtgancctgcagtgngacgctagtggctccaaagaattcggcacgagcttatgngccctttcctccacttattcgacctctcacctgnattgatgct

SEQ ID NO: 10480 - DNA, 140 bp, Homo sapiens
  misc_feature 2, 14, 46, 88, 133: n = A,T,C or G
anaagcgtggaagntggtgcggctggagggcgacactagtggctcnaaagaattcggcacgagaacccactccaccctactaccagcncaatccttagccaaaccatttacccaattaaagtataggcgatanaaattga

SEQ ID NO: 10481 - DNA, 349 bp, Homo sapiens
gaacaaaagctggagctcgcgcgcctgcaggtcgacactagtggatccaaagaattcggcacgagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatggcctttggtcttttttgactaaacctcttttataacatgttcaataaaaagctgaacttt

SEQ ID NO: 10482 - DNA, 370 bp, Homo sapiens
aaaagctggagctcgcgcgcctgcaggtcgacactagtggatccaaagaattcggcacgagttttgcagcagttgcgattcttgcagcatcaaatggctatggcagcagcagcagcacaaacagctcagctacatcatcatcggcatacaggcagccagtcaaaaagtaaaatgaagagaggcatgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacaggg

SEQ ID NO: 10483 - DNA, 398 bp, Homo sapiens
  misc_feature 24, 28, 109, 119, 169, 186, 239, 262, 292, 355: n = A,T,C or G
aaaagctggagctcgtgcgcctgnaggncgacactagtggatccaaagaattcggcacgagagatggcggacattcagactgagcgtgcctaccaaaagcagccgaccntctttcaaancaagaagagggtcctgctgggagaaactggcaaggagaagctcccgcggnactacaagaacatcggnctgggcttcaagacacccaaggaggctattgagggcacctacattgacaaganatgccccttcactggtaatgtgnccattcgagggcggatcctctctggcgtgntgaccaagatgaagatgcagaggaccattgtcatccgccgagactatctgcactacatccgcnagtacaaccgcttcgagaagcgccacaagaacatgtctgtaca

SEQ ID NO: 10484 - DNA, 400 bp, Homo sapiens
  misc_feature 11, 15, 80, 110, 148, 198, 232, 250, 296, 337, 378, 395: n = A,T,C or G
ccctatagtgnagtntgtgtgagcctgcagtgcgacactagtggatccaaagaattcggcacgagtttgcttaggcgcanacggggaagcggagccaacatgccagtggnccggagctgggtttgtcgcaaaacttatgtgaccccgnggagacccttcgagaaatctcgtctcgaccaagagctgaagctgatcggngagtatgggctccggaacaaacgtgaggtctggngggtcaaatttaccctgnccaagatccgcaaggccgcccgggaactgctgacgcttgatgaganggacccacggcgtctgttcgaaggcaacgccctgctgcgcnggttggtccgcattggggtgctggatgaggccaagatgaanctggattacatcctggncctga

SEQ ID NO: 10485 - DNA, 396 bp, Homo sapiens
  misc_feature 3, 15, 166, 350, 355: n = A,T,C or G
cgngcgcctggaggncgacactagtggatccaaagaattcggcacgagtaatggctttcactttctcttttgttttaaatgactcataggtccctgacatttagttgattattttctgctacagacctggcacactctgattttagataaagtaagcctaggtgtngtcagcaggcaggctggggaggccagtgttgtgggcttcctgctgggactgagaaggctcacgaagggcatccgcaatgttggtttcactgagagctgcctcctgggctcttcaccactgtagttctctcatttccaaaccatcagctgcttttaaaataagatctctttgtagccatcctgtnaaatntgtaaacaatctaattaaatggcatcagcgctttaaccaat

SEQ ID NO: 10486 - DNA, 208 bp, Homo sapiens
  misc_feature 7, 12, 33, 58, 65, 72, 115, 140, 197, 204: n = A,T,C or G
cgtgcgncctgnaggtcgacactagtggcatcnaaagaattcggcacgagctcgtgcngcatttnggcgcgngtagaaggtagggtgtgtatatataaaaggttgtgtacaactnccacgaggtgaaaaatattcagtancttgtttacttagcatttgtgtaaagactatgatctcatccccaataaagtgatttntttgacnttgc

SEQ ID NO: 10487 - DNA, 147 bp, Homo sapiens
  misc_feature 7, 20, 37, 44, 48, 76, 94, 96, 107, 120: n = A,T,C or G
tagtggntcccaaaaaattnggcacgagctaggtcgnggggacntggncaaacgtaccaagaaagtcgggatcgtnggtaaatacgggacccgntntggggcctccntccggaaaatggngaagaaaattgaaatcagccagcacgc

SEQ ID NO: 10488 - DNA, 100 bp, Homo sapiens
  misc_feature 10, 14, 57, 79: n = A,T,C or G
aggccgacantagnggatccaaagaattcggcacgaggttcattgccgccgagggcnttcacacgggccagtttgtgtnttgcggcaagaaggcccagct

SEQ ID NO: 10489 - DNA, 400 bp, Homo sapiens
  misc_feature 4, 12, 72, 181, 341, 352, 397: n = A,T,C or G
tcgngcgcctgnaggccgacactagtggatccaaagaattcggcacgagctggaaccttcactaacctgatncaggcagccttccgggagccacggcttcttgtggttactgaccccagggctgaccaccagcctctcacggaggcatcttatgttaacctacctaccattgcgctgtgtnacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtncttctacaganatcctgaagagattgaaaaagaagagcaggctgcttgctgataangca

SEQ ID NO: 10490 - DNA, 142 bp, Homo sapiens
  misc_feature 13, 17, 124: n = A,T,C or G
tgaaggccgacantagnggatccaaaaaatttggcacgagctcgtgccgaattcggcacgagcctggtccccccggccctcgaggactggccgggaaccgaggcgtgccaggacagcccggganacagggcgtggagggccg

SEQ ID NO: 10491 - DNA, 328 bp, Homo sapiens
  misc_feature 4, 30, 34, 43, 53, 78, 98, 112, 136, 179, 187, 196, 225,242, 252, 289, 303: n = A,T,C or G
gcangagggggaacctgagccctacctggnagtntacctacantcggagcccnggcccaatgagcacaactgctcggntggcaggaggatccgcccanagtcactccagggngctgaccaccggccctacaccttnttaatttccccggggggcagagacccagcagggagttaccatntgaacctntccagccanttccgctggtcggcgctgcaggtgtccgngggcctgtccacgtccntgtgccagtncttcagcgaggaggacatggggtggcggacagagggnctgctgccccttgnaggagacctcgccccgccgggccgg

SEQ ID NO: 10492 - DNA, 251 bp, Homo sapiens
  misc_feature 4, 19, 43, 97, 185, 248: n = A,T,C or G
tagnggatccaaagatttnggcacgagggtcaacagggccacngggttgctttctgtctttgggggggcaggggagttgacagggatgagggtccanggaataagcttgaatgacaagaaaacaagggaaagagttaacctgtcacatagcaggttaactttttcagggtttgcggttagaggtnttcgaccattcactggctgagccagatcacgggaacttgagagcttttactgtgattcttcantgt

SEQ ID NO: 10493 - DNA, 400 bp, Homo sapiens
  misc_feature 3, 42, 57, 215, 216, 220, 292, 327, 366, 379, 387: n = A,T,C or G
cgngcgcctgcaggtccgacactagtggatccaaagaatttngcacgaggccatctnggctcctgggtctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagcttnnagancagttaaaacattgcaatggcattttgaaggagttactctctaagaagcatgctgcctatgcttggcctttntataaaccagtggatgcttctgcacttggcctgcntgactaccatgacatcattaagcaccccatggacctcancactgtcaagcgnaagatggngaaccgtgattac

SEQ ID NO: 10494 - DNA, 400 bp, Homo sapiens
  misc_feature 4, 12, 61, 126, 209, 214, 219, 318: n = A,T,C or G
tcgngcgcctgnaggccgacactagtggatccaaagaattcggcacgaggttaagaccctngaaaagatctaagaaagtgtgcatcctaaaacacctgacgaatttcagaatgtgacaaagcgcanaggatgcattatttcaaaacaaaacagaaggctaaaatttgcaggaaaaagaaaatcagtaaaccgggaatcctcggactggnttgtnagcangatttgaatgaataagaagctgaaggtattaaggctgtgatatagaaggtacatatttcatcccacaagagaaaacaataataatcagaaattttcggngaaaaaaacgcaaaactgtacaggaaaatcatcctccaagtaccagacataaaatgctgcaagcttttgaactaatggcgag

SEQ ID NO: 10495 - DNA, 100 bp, Homo sapiens
  misc_feature 4, 9, 27, 49, 64, 91: n = A,T,C or G
tcgngcgcntgcaggcccgacactagnggaacccaaaaaattcggcacnagggaagccttgctnattcttgaggagcattaaggtatttcnaaactgcca

SEQ ID NO: 10496 - DNA, 100 bp, Homo sapiens
  misc_feature 10, 14, 39, 43, 62, 92: n = A,T,C or G
aggccgacantagnggatccaaaaaattcggcacgaggntgancagacttcccgctgctggngtgggtgacatggtgatggccacagtcaanaaaggcaa

SEQ ID NO: 10497 - DNA, 388 bp, Homo sapiens
  misc_feature 5, 9, 47, 49, 52, 66, 68, 71, 74, 140, 152, 155, 199, 201,256, 285, 326, 332, 335: n = A,T,C or G
gacantagnggtatccaaagtattttggcacgagcagtatccctagntngangcacaaaaaaatcntnttnttntagaccaaagtctagaaaggcctatgttactgacggaagaagtattggttccagacttcctataanactgtctgcatnggngctttagtatctcaggcctccaaggattccatgatgattttaangnctttctcaaaactctgatatttgtcacacctagaaagtatgtagcctgattgatncttgccttgactaaattttgggacctctnggggcattttgaagtatttaactgtcttgaccagttggaanaagatncgngggccataagcatcttctggacaggggaactgctttcagagagaaaacctttc

SEQ ID NO: 10498 - DNA, 395 bp, Homo sapiens
  misc_feature 3, 32, 61, 64, 121, 200, 213, 217, 329: n = A,T,C or G
cgngcgcctgcaggctcgacactagtggatcnaaagaattcggcacgagtcactatgtagnggnggggcagacaccctcccgcaaattctggaaggttcttagtctcgactagggcagtanccccaggactcctagtcgccggcttcaggtcactgccggctgaacggagctgccgtcgccatgtttggctgcttggtgncggggaggctggngcanacagctgcacagcaagtggcagaggataaatttgtttttgacttacctgattatgaaagtatcaaccatgttgtggtttttatgctgggaacaatcccatttcctgagggantgggaggatctgtctacttttcttatcctgattcaaatggaatgccaggatggcccctccctagga
